(12) United States Patent
Kern et al.

(10) Patent No.: US 9,309,511 B2
(45) Date of Patent: Apr. 12, 2016

(54) FUNCTIONAL ASSAY FOR IDENTIFICATION OF LOSS-OF-FUNCTION MUTATIONS IN GENES

(75) Inventors: Scott E. Kern, Hunt Valley, MD (US); Eike Gallmeier, Germering (DE); Tomas Hucl, Baltimore, MD (US)

(73) Assignee: The Johns Hopkins University, Baltimore, MD (US)

( * ) Notice: Subject to any disclaimer, the term of this patent is extended or adjusted under 35 U.S.C. 154(b) by 398 days.

(21) Appl. No.: 12/675,968

(22) PCT Filed: Aug. 28, 2008

(86) PCT No.: PCT/US2008/010233
§ 371 (c)(1),
(2), (4) Date: Aug. 9, 2010

(87) PCT Pub. No.: WO2009/032185
PCT Pub. Date: Mar. 12, 2009

(65) Prior Publication Data
US 2010/0305001 A1    Dec. 2, 2010

Related U.S. Application Data

(60) Provisional application No. 60/966,404, filed on Aug. 28, 2007, provisional application No. 61/067,610, filed on Feb. 29, 2008.

(51) Int. Cl.
*C12Q 1/68* (2006.01)
*C12N 15/10* (2006.01)
*C40B 30/06* (2006.01)

(52) U.S. Cl.
CPC ............ *C12N 15/1082* (2013.01); *C40B 30/06* (2013.01)

(58) Field of Classification Search
None
See application file for complete search history.

(56) References Cited

U.S. PATENT DOCUMENTS

| 5,527,676 A | 6/1996 | Vogelstein et al. |
| 2004/0253727 A1 | 12/2004 | Harrington et al. |

FOREIGN PATENT DOCUMENTS

WO    WO 2004/061082    7/2004

OTHER PUBLICATIONS

Gallmeier et al.(2007) "Gene-specific selection against experimental Fanconi anemia gene inactivation in human cancer" Cancer Biology & Therapy 6(5):654-660.*
Muller (1999) "Ten years of gene targeting: targeted mouse mutants, from vector design to phenotype analysis" Mechanisms of Development 82(1-2):3-21.*
Marcelo A. Carvalho et al., "Functional Assay for BRCA1 and BRCA2", Int. J. Biochem. Cell Biol., vol. 39(2), pp. 298-310, Aug. 18, 2006.
Tomas Hucl et al., "A Syngeneic Variance Library for Functional Annotation of Human Variation: Application to BRCA2", Cancer Res., Vo. 68(13), pp. 5023-5030, Jul. 1, 2008.
Sergey G. Kuznetsov et al., "Mouse Embryonic Stem Cell-Based Functional Assay to Evaluate Mutations in BRCA2", Nature Medicine vol. 14(8), pp. 875-881, Jul. 6, 2008.

* cited by examiner

*Primary Examiner* — Tracy Vivlemore
*Assistant Examiner* — Karen S Weiler
(74) *Attorney, Agent, or Firm* — Mintz Levin Cohn Ferris Glovsky and Popeo, P.C.; Peter F. Corless, Esq.; Daniel W. Clarke

(57) ABSTRACT

Provided herein are compositions and methods for assaying the deleteriousness of putative loss-of-function mutations, especially in genes known to be or suspected of being tumor-suppressor genes. The invention includes syngeneic variance libraries and methods of construction and use of syngeneic variance libraries.

9 Claims, 5 Drawing Sheets

FUNCTIONAL ASSAY FOR IDENTIFICATION OF LOSS-OF-FUNCTION MUTATIONS IN GENES

RELATED APPLICATIONS

This application is the U.S. National Phase Application, pursuant to 35 U.S.C. §371, of PCT International Application Serial No. PCT/US2008/010233, Filed Aug. 28, 2008, designating the United States and published in English on Mar. 12, 2009 as publication WO 2009/032185, which claims priority to U.S. Provisional Patent Application Ser. Nos. 60/966,404 and 61/067,610 filed on Aug. 28, 2007 and Feb. 29, 2008, respectively, all of which applications are incorporated by reference herein in their entirety.

STATEMENT OF RIGHTS TO INVENTIONS MADE UNDER FEDERALLY SPONSORED RESEARCH

This work was supported in part by the NCI grants CA62924 and CA88843. The government has certain rights in the invention.

SEQUENCE LISTING

The instant application contains a Sequence Listing which has been submitted via EFS-Web and is hereby incorporated by reference in its entirety. Said ASCII copy, created on Aug. 28, 2008, is named 82363_71699.ST25.txt and is 4.11 megabytes in size.

BACKGROUND OF THE INVENTION

It generally accepted that cancer results from the accumulation of sequential mutations in a cell that confer a selective growth advantage to the cell. The tumor is a clonal expansion of the cell containing the mutations, and cells within the tumor likely accumulate further mutations during proliferation. This accumulation of mutations results in genetic instability that leads to uncontrolled growth due to hyper-proliferation or insufficient apoptosis. The loss of genomic stability occurs early in the process of carcinogenesis and represents a key molecular step in the development of cancer by providing a permissive environment in which further mutations can accumulate.

Mutations that result in a gain of function (e.g., activation of Ras by mutation at amino acid 12) can result in the development of cancer alone. However, mutations that result in genomic instability are often loss-of-function mutations in genes responsible for DNA repair, cell division cycle checkpoints, cell motility, transcriptional regulation, and apoptosis. These genes are often called tumor-suppressor genes. A large number of genes identified in screens to be involved in cancer have undefined or incompletely defined relationships uniting their structure with their biological function (e.g., BRCA2), making it difficult, if not impossible, to determine which mutations, if any, are deleterious to gene function. Loss of a first allele does not lead directly to cancer, but makes the cell susceptible to increasingly severe consequences upon acquisition of further mutations. For example, loss of a second allele on the same gene, or mutation of another gene in a pathway in which the first mutation occurred can lead to loss of cell cycle control.

Although some cancers have a strong hereditary component, the large majority of cancers are not associated with a specific genetic predisposition. Moreover, a large number of familial cancers associated with loss-of-function of genes (e.g., BRCA1, BRCA2, MLH1, MSH2) may not manifest overt disease until after the individual has produced children. Similarly a number of other later onset diseases that may have a genetic component (e.g., alpha- or beta-synuclein mutations or APO-E variants in Alzheimer's disease, HTT mutations in Huntington disease, and late-onset forms of diseases more commonly known as affecting the young, such as Tay Sachs or cystic fibrosis, that do not manifest overt disease until the individual has produced children.

Large scale analyses have been performed on tumor samples to identify mutations associated with cancer (e.g., Dutt et al., *Curr. Opin. Oncol.* 2007. 19:43-49; Greenman et al., *Nature* 2007. 446:153-158; Ottini et al., *Ann. Oncol.* 2006. 17:vii97-vii102; Sjöblom et al., *Science*, 2006. 314: 268-314; Lea et al., *Carcinogenesis* 2007. 28:1851-1858, each incorporated herein by reference). However, such analyses were performed on tumor samples or cancer cell lines which have accumulated multiple mutations. For example, analysis of 13,023 genes in 11 breast and 11 colorectal cancers by Sjöblom revealed that individual tumors accumulate about 90 mutant genes, but that only a subset of the mutations contribute to the neoplastic process. Mutations that were germline variants (i.e., present in the patients' genomes at birth) but resulting in no changes in the amino acid sequence of the protein encoded, as well as germline variants identified from the published human sequence present in SNP databases or in two control samples, were disregarded as not being related to cancer. Using these stringent criteria, 189 genes were identified that were mutated with a significant frequency, with an average of 11 genes mutated per tumor. However, despite the identification of such genes and mutations, such a screen does not identify which mutations are deleterious, causing a change of function in the gene product, or are benign. The screens are also not useful for determining which of the less common tumor mutations or which of the germline variants result in an alteration of function that results in a greater susceptibility to disease in a subject as compared to the general population.

SUMMARY OF THE INVENTION

The invention provides a method for functional analysis and classification of potential loss of function mutations in genes putatively associated with disease. The invention further provides reagents such as libraries and kits for use in the methods of the invention.

The invention provides methods for classifying the relative deleteriousness of a mutation in a nucleic acid sequence of a gene to a mammalian cell (e.g., deleterious, benign, or somewhere therebetween) using mammalian cells having only a single functional copy of a first gene and transforming the cells with a nucleic acid sequence from a second gene having one or more the mutations to be classified. The nucleic acid for transformation into the cell includes sequences to allow for recombination of the transformed nucleic acid sequence into a functional gene of the cell, although in certain embodiments, recombination into a non-functional gene may be possible. The frequency of recombination of nucleic acid sequence into the genome of the cell is determined, and the relative frequency of recombination of the nucleic acid containing one or more mutations into a functional gene as compared to a control is indicative of the relative deleteriousness of the mutation. The frequency of recombination of the nucleic acid into the functional copy of the gene as compared to the control non-functional copy of the gene can be determined. Alternatively, the frequency of recombination of a nucleic acid containing potentially deleterious mutations can be compared to the frequency of recombination of a control wild-type sequence or sequence known to not contain deleterious mutations.

In some embodiments, the nucleic acid with one or more mutations is flanked by sequences to allow recombination with the single functional gene in the cells. In an alternative embodiment, the nucleic acid with the mutations is flanked by sequences to allow recombination with a gene other than the single functional gene present in the cell. The number of mutations present in the nucleic acid for recombination can be, for example, at least 1, 2, 3, 4, 5, 10, 15. 20, 25, 30, 35, 40, 45, or 50 mutations. The number of mutations is limited only by the requirement that the nucleic acid be able to recombine with the genome of the cell into which it is transformed. In some embodiments, one or more portions of the non-functional copy of the gene corresponding to the single functional copy of the gene are present in the cells. In other embodiments, the non-functional copy of the gene is substantially deleted from the cells. In some embodiments, portions of the non-functional gene are deleted to prevent recombination of the nucleic acid containing mutations into the non-functional copy of the gene.

The methods of the invention are preferably for use with loss-of-function mutations or mutations that result in a recessive phenotype. Such mutations cannot typically be detected by functional assays due to the presence of a wild-type or at least fully functional gene. Two mutations that alone would not be deleterious to the cell may be deleterious when in combination with each other. The methods of the invention are useful, for example, for the characterization of tumor-suppressor genes. The methods are also useful for the characterization of genes involved in diseases that have relatively late onset, or onset after individuals have reached child bearing age. The methods allow for the characterization of natural variants in the population or artificially generated mutations as deleterious or benign.

In some embodiments, the invention provides methods for the use of a library of cells each containing a different single functional copy of a gene. Such a library of cells is transformed with a nucleic acid construct for recombination. In an embodiment, the cells for use in the methods of the invention are somatic cells. In an embodiment, the cells are human cells.

In some embodiments, the cells including a single functional copy of a gene are transformed with a library of constructs including different genes, or different mutations in a single gene. In some embodiments, the methods are performed iteratively to identify mutations that are deleterious to the cell. For example, if a nucleic acid for recombination includes 50 mutations and has a very low recombination frequency, indicating one or more deleterious mutations, a series of nucleic acid constructs including fewer muations can be generated (e.g., 10 nucleic acids each with about 5 mutations). The recombination frequency of the new constructs can be determined to identify deleterious or benign mutations. Deleterious mutations can be further characterized by generation of constructs with single mutations.

The invention provides methods for characterization of mutations anywhere in the genomic sequence of the gene or genes of interest. For example, mutations can be in any region of the gene, for example in an intron, an exon, a 3'-UTR, 5'-UTR, transcriptional regulatory region, translational regulatory region, or a region at a junction between two of the juxtaposed regions.

The methods of the invention further include functional testing of cells in which the nucleic acid construct containing the mutations has recombined into the genome of the cell containing only a single functional copy of the gene. Functional assays include, but are not limited to, drug or agent sensitivity assays, radiation sensitivity assays, kinase assays, migration assays, proliferation assays, apoptosis assays, chromosome counting assays, nutrient sensitivity assays, transcription assays/reporter construct assays, DNA repair assays, or any combination thereof (e.g., apoptosis assays after exposure to drugs).

The invention further provides cells, preferably somatic cells, preferably human somatic cells having a single functional copy of a first gene transformed with a nucleic acid construct have a sequence from a second gene having at least one mutation to be classified as deleterious flanked by nucleic acid sequences to allow recombination of the nucleic acid sequence from the second gene into a functional gene of the genome of the cell. Such cells include cells in which the construct has been transformed into the cells in which recombination may or may not have taken place. That is, the construct can be present in the cell or incorporated into the genome of the cell, or a combination thereof. In some embodiments, the nucleic acid sequence from a second gene having at least one mutation is a fragment of the first gene that is present as a single functional copy in the cell. In other embodiments, the nucleic acid sequence from a second gene comprising a mutation is not a fragment of the first gene that is present as a single functional copy in the cell. In an embodiment, mutation of the first gene and the second gene is expected to result in a loss of function of the gene in which the mutation is present. In an embodiment, the first gene, or the second gene, or both genes are suspected of being tumor-suppressor genes.

In some embodiments, the cells contain a non-functional copy of the first gene that is present as a single functional copy in the genome of the cell. In some embodiments, at least one of the flanking sequences in the nucleic acid construct is not present in the non-functional copy of the first gene in the mammalian cell, preventing recombination of the nucleic acid construct with the non-functional copy of the cell. In a preferred embodiment, the non-functional copy of the gene in the cell is disrupted in a way to prevent correction of the mutation by recombination with the construct.

The invention provides libraries of nucleic acid constructs having a group of nucleic acid members. The library members include a nucleic acid sequence of a gene flanked by sequences to allow for recombination with a genomic sequence of a functional gene. The members of the library preferably include at least one mutation as compared to a wild-type sequence of the gene. Members of the library can include for example, at least 1, 2, 3, 4, 5, 10, 15. 20, 25, 30, 35, 40, 45, or 50 mutations. Members of the library can include wild-type sequences to act as controls. The mutations present in the sequences in the library can correspond to known, naturally occurring mutations and variations within the genome (either SNPs or VUS), or can be generated randomly or by site directed mutagenesis. The specific sites and numbers of mutations is not a limitation of the compositions and their methods of use herein. For example, mutations can be in any region of the gene, for example in an intron, an exon, a 3'-UTR, 5'-UTR, transcriptional regulatory region, translational regulatory region, and a region at a junction between two juxtaposed regions. The number and sites of mutations are limited only by the variation that is tolerated while allowing for recombination of the nucleic acid sequence with the genome of the cell. Therefore, sufficient regions of homology must be present to allow for recombination.

The invention further provides an isolated population of mammalian cells, preferably somatic cells, preferably human cells, wherein the genome of the cells includes a single functional copy of a first gene in the genome, and the cell further includes a nucleic acid construct comprising a nucleic acid sequence from a second gene comprising at least one mutation flanked by nucleic acid sequences to allow recombination within a functional gene of the genome of the cell. For example, the nucleic acid sequence can include at least 1, 2, 3, 4, 5, 10, 15. 20, 25, 30, 35, 40, 45, or 50 mutations. Such cells include cells in which the construct has been transformed into the cells in which recombination may or may not have taken place. That is, the construct can be present in the cell or incorporated into the genome of the cell, or a combination thereof. In some embodiments, the nucleic acid construct comprises a library of nucleic acid constructs. In some embodiments, the second gene is the same as the first gene. In other embodiments, the second gene is not the same as the first gene. The mutations present in the sequences in the library can correspond to known, naturally occurring mutations and variations within the genome, or can be generated randomly or by site directed mutagenesis, and the mutations can be present in any portion of the genomic sequence. In some embodiments, at least one of the flanking sequences is not present in a non-functional copy of the first gene in the mammalian cell, preventing recombination of the nucleic acid sequence with the non-functional copy of the gene. In an embodiment, mutation of the first gene and the second gene is expected to result in a loss of function of the copy of the gene. In an embodiment, the first gene, or the second gene, or both genes are suspected of being tumor-suppressor genes.

The invention further provides method for screening for a mutation in a nucleic acid sequence as deleterious to a mammalian cell using cells having a single functional copy of a first gene and transforming the cell with a library of nucleic acid construct members having a sequence with at least one mutation to be screened flanked by nucleic acid sequences to allow recombination with the genome of the cell in a functional gene. The frequency of recombination of nucleic acid sequence into the genome of the cell is determined, and the relative frequency of recombination of the nucleic acid containing one or more mutations into a functional gene as compared to a control is indicative of the relative deleteriousness of the mutation. The frequency of recombination of the nucleic acid into the functional copy of the gene as compared to the non-functional copy of the gene can be determined. Alternatively, the frequency of recombination of a nucleic acid containing potentially deleterious mutations can be compared to the frequency of recombination of a wild-type sequence or sequence known to not contain deleterious mutations. For example, the nucleic acid sequence can include at least 1, 2, 3, 4, 5, 10, 15. 20, 25, 30, 35, 40, 45, or 50 mutations. In some embodiments, the first gene and the second gene are the same. In other embodiments, the first gene and the second gene are not the same. The invention provides methods for characterization of mutations anywhere in the genomic sequence of the gene or genes of interest. For example, mutations can be in any region of the gene, for example in an intron, an exon, a 3'-UTR, 5'-UTR, transcriptional regulatory region, translational regulatory region, and a region at a junction between two juxtaposed regions. The methods of the invention are particularly useful for the characterization of loss-of-function mutations in one or more genes.

The methods of the invention further include functional testing of cells in which the nucleic acid construct containing the mutations has recombined into the genome of the cell containing only a single functional copy of the gene. Functional assays include, but are not limited to, drug or agent sensitivity assays, radiation sensitivity assays, kinase assays, migration assays, proliferation assays, cell cycle assay, apoptosis assays, chromosome counting assays (i.e., ploidy determination), nutrient sensitivity assays, transcription assays/reporter construct assays, DNA repair assays, or any combination thereof (e.g., apoptosis assays after exposure to drugs).

The invention provides a database including information regarding the significance of variants in sequences and their relative deleteriousness to a cell, particularly mutations identified and/or characterized using the methods provided herein.

The invention further provides kits for practicing the methods herein. For example, a kit can include a library of cells or a library of nucleic acid constructs with instructions for use. The kits can further include control cells or nucleic acid sequences. Kits can be packaged in appropriate containers.

DEFINITIONS

"Loss-of-function" as used herein refers to a reduction or elimination of the normal activity of a gene or gene product. Loss of activity can be due to a decrease in transcription and/or processing of the RNA, a decrease in translation, stability, transport, or activity of the gene product, or any combination thereof.

As used herein, "deleterious" is understood as harmful, often in a subtle or unexpected way. For example, a deleterious mutation may not result in any overt phenotypic change (e.g., cell morphology, doubling time, maintenance of cell cycle checkpoints, DNA repair, alterations in motility, etc.) when present alone in the cell, however, a deleterious mutation can increase the susceptibility of the cell to genomic instability, or result in an overt phenotypic change when present in combination with a mutation in the second copy of the gene in the cell, or with one or more other gene mutations in the cell which, alone, do not result in any overt phenotypic change in the cell. Genomic instability can manifest, for example, as an increased mutation accumulation, aneuploidy, apoptosis, and mitotic catastrophe.

As used herein, "benign" or "neutral" is understood as a mutation that does not threaten health or life; especially: not becoming cancerous or having no significant effect on tissue function. For example, benign mutations do not alter the function of the gene or gene product e.g., a silent mutation in the coding sequence that does not alter the amino acid sequence of the final protein, mutations of intron or untranslated sequences that do not alter splicing or processing of the mRNA transcript.

As used herein, "hypomorphic" is understood as a mutation that reduces, but does not completely eliminate, the function of a gene.

As used herein, the terms "deleterious" and "benign" are understood as being the two ends of a continuum encompassing the natural complexity of human genetics. For example, specific mutations of p53 or retinoblastoma gene (Rb) in a subject typically result in onset of cancer in the first or second decade of life and with multiple, independent tumors/types of cancer arising during the lifetime of the subject, whereas mutations in BRCA1 and 2 tend to result in later onset of cancer (in the late third decade of life, or later), with often with only one tumor/type of cancer arising during the lifetime of the subject. Therefore, a deleterious BRCA1 or 2 mutation can be less obvious in a clinical setting and would be considered less deleterious than a deleterious p53 or Rb mutation, but would not be considered benign As another example, a known "permutation" in the APC gene is not in itself dysfunctional, but is more prone to additional mutation and thus an increased risk of colorectal cancer, it likewise could not be considered benign.

As used herein, "frequency of recombination" or the "frequency of recombination into a functional gene" of a specific gene segment during an experimental investigation is the number of recombination events of a specific gene fragment containing a mutation relative to the number of recombination events expected to be observed or observed for a control sequence not including a deleterious mutation (e.g., a control sequence may be used that preferably includes one or more silent mutations to allow for detection of its recombination into the genome of the cell). For example, we can consider a hypothetical gene whose function is required for cell survival. If two possible sites for recombination in the cell are possible, one in the wild-type copy of the gene and one in an inactive mutated copy of the gene, and the insertion of an introduced sequence containing a new, different mutation into both the wild-type and mutant copy of the gene (i.e., the recombination frequency) is observed to be nearly the same, the new mutation is concluded to be neutral. However, if insertion (recombination) of the gene fragment including the new mutation into the inactive mutated copy of the gene is highly preferred, the new mutation in the gene fragment is concluded to be deleterious to the cell. Similarly, the recombination frequency of a gene fragment including a mutation can be compared to the recombination of a comparable gene fragment not including the mutation. A substantial reduction in the number of recombinants generated using the sequence including the mutation is indicative of a deleterious mutation. For example, the frequency of recombination of a gene fragment containing a potentially deleterious mutation may be about 75%, 50%, 25%, 10%, 5%, 1%, 0.5%, 0.1%, 0.01%, 0.001%, or less, including none detectable, of that found when testing a fragment not containing a deleterious mutation. In a preferred embodiment, the control sequence is about the same size and will insert into the genome of the cell at about the same locus as the gene segment containing the potentially deleterious mutation. The use and selection of appropriate controls is within the ability of those skilled in the art.

A "tumor-suppressor gene", as used herein, is a gene that when mutated to functionally alter or inactivate the gene product results in an increased susceptibility to genomic instability and cancer. Mutation of a tumor-suppressor gene often results in a loss-of-function such that the gene product does not induce genomic instability alone, but instead allows for cell growth and division to occur without the proper controls. Tumor-suppressor genes, as used herein, have a number of functions within the cell including DNA-repair, cell cycle checkpoints, transcriptional regulation, cell adhesion and motility, signal transduction, transport, metabolism including RNA metabolism, and intracellular trafficking. (The DNA-repair genes and other genes involved in genome maintenance are sometimes considered as a distinct subset, but herein we will include them among the tumor-suppressor genes.) There are also many tumor-suppressor genes for which specific functions have not been assigned. Some tumor-suppressor genes are associated with specific cancers, whereas others are not. Tumor-suppressor genes and genes suspected of being tumor-suppressor genes include, but are not limited to, BRCA1, BRCA2, MLH1, MSH2, MSH6, EPHA3, EPHA4, APHB2, INI1, AXIN1, AXIN2, MLL3, EP300, NF1, TP53, APC, VHL, SMAD2, SMAD4, KEAP1, CDKN2A, RB1, MEN, NF2/SCH, PTCH, TGFBR1, TGFBR2, ACVR1B, AVCR2, MRE11, MAP2K4, and LKB1/STK11. GenBank and SEQ ID NOs are provided in Table 2. Genes suspected of being tumor-suppressor genes include genes that are known tumor-suppressor genes.

Other genes for use in the method of the invention, some of which may be suspected of being tumor-suppressor genes include, but are not limited to ATM, ATR, FANCD2, FANCA, FANCB, FANCC, FANCD1, FANCE, FANCF, FANCG, FANCL, FANCM, FAAP100, FLNB, TMPRSS6, RAPH1 1.4 PKHD1, CNTN4, MYH1, COL11A1, PCDHB15, ADAMTSL3, CRL1, SPTAN1, DNAH9, CMYA1, OBSCN, HAPLN1, DBN1, OBSCN, MACF1, ADAMTS18, MGC33407, TECTA, COL7A1, SYNE2, MMP2, MAP2, ADAM12, MAGEE1, NRCAM, TTLL3, GSN, CDH10, COL19A1, EVL, CDH20, SULF2, SEMA5B, ADAM29, BGN, CNTN6, ITGA9, CSMD3, ICAM5, THBS3, ADAMTS15, VEPH1, PFC, PRPF4B, APC, PTPRD, SBNO1, GAB1, CENTG1, KRAS, MCP, DNASE1L3, ARHGEF4, MAP3K6, RAP1GA1, NALP8, APC2, GUCY1A2, PTPRU, EGFL6, RGL1, STARD8, EPHB6, CD109, AMFR, PPM1E, PTPN14, PHIP, CENTB1, PKDREJ, IRTA2, GNAS, GPNMB, CNNM4, RASGRF2, RET, INHBE, ALS2CL, MTMR3, P2RY14, FLJ10458 L. RASAL2, LGR6, CHD5, ZFP64, TP53, ZNF442, FLJ13479, CIC, ZNF569, SMAD3, SIX4, KEAP1, EHMT1, MLL3, EYA4, KIAAO934, HOXA3, ZFYVE26, TBX22, PKNOX1, LRRFIP1, TCF1, BCL11A, MKRN3, GLI1, HDAC4, ZNF318, TCF7L2, RFX2, MYOD1, HIST1H1B, ZCSL3, NCOA6, RUNX1T1, ATP8B1, ABCB8, ABCB10, ABCA1, C6orf29, CUBN, KPNA5, SCNN1B, SLC29A1, GRIN2D, ABCA3, NUP133, SCN3B, HDLBP, SLC9A2, P2RX7, NUP214, SLC6A3, KCNQ5, ACADM, NCB50R, PHACS, UQCRC2, PRPS1.ASL, XDH, ACSL5, CYP1A1, GALNT5, GALNS, OTOF, PLEKHA8, KTN1, SYNE1, PRKD1, LRBA, LOC283849, GGA1, SEC8L1, LRP2, AEGP, SORL1, SDBCAG84, C14orf155, RNU31P2, KIAA0427, SFRS6, SP110, C22orf19, DDX10, FLJ40869, SERPINB1, FBXW7, K6IRS3, UHRF2, CD248, MRE11A, LMO7, ERCC6, KIAA1632, KIAA0999, C10orf137, KIAA1409, MGC24047, LOC157697, and C15orf2.

As used herein, "DNA repair" refers to a collection of processes by which a cell identifies and corrects damage to the DNA molecules that encode its genome. In human cells, both normal metabolic activities and environmental factors such as UV light and radiation can cause DNA damage, resulting in as many as 1 million individual molecular lesions per cell per day. Many of these lesions cause structural damage to the DNA molecule and can alter or eliminate the cell's ability to transcribe the gene that the affected DNA encodes. Other lesions induce potentially harmful mutations in the cell's genome, which affect the survival of its daughter cells after it undergoes mitosis. Consequently, the DNA repair process is constantly active as it responds to damage in the DNA structure. Disruption of DNA repair results in chromosomal instability and aneuploidy which frequently results in abnormal cell division, mutation accumulation, mitotic catastrophe (i.e., cell death), or cell cycle checkpoint failure resulting in apoptosis.

Loss of function of DNA repair pathways or cell cycle checkpoints can result in double-strand breaks (DSBs), in which both strands in the double helix are severed, are particularly hazardous to the cell because they can lead to cell death or genome rearrangements. Two major mechanisms exist to repair DSBs: non-homologous end joining (NHEJ) and recombinational repair (also known as template-assisted repair or homologous recombination repair).

As used herein, a "cell cycle checkpoint" is a series of tests or evaluations performed by the cell that pause the cell cycle and gives the cell time to repair the damage before continuing to divide. DNA damage checkpoints occur at the G1/S and G2/M boundaries. An intra-S checkpoint also exists. Checkpoint activation is controlled by two master kinases, ATM and ATR. ATM responds to DNA double-strand breaks and disruptions in chromatin structure, whereas ATR primarily responds to stalled replication forks. These kinases phosphorylate downstream targets in a signal transduction cascade, eventually leading to cell cycle arrest. A class of checkpoint mediator proteins are also required for transmitting the checkpoint activation signal to downstream proteins to promote or inhibit progress through the cell cycle.

p53 is an important downstream target of ATM and ATR, as it is can induce apoptosis or aid cell cycle arrest to prevent further injury following DNA damage. At the G1/S checkpoint, p53 functions by causing arrest. At G2/M checkpoint p53 maintains the arrested state.

Inherited mutations that affect DNA repair genes are strongly associated with high cancer risks in humans. Hereditary nonpolyposis colorectal cancer (HNPCC) is strongly associated with specific mutations in the DNA mismatch repair pathway. BRCA1 and BRCA2, two mutations conferring a hugely increased risk of breast cancer on carriers, are both associated with a large number of DNA repair pathways, especially crosslink repair and homologous recombination.

As used herein, a "transcription factor" is a protein that binds to specific sequences of DNA using DNA binding domains and is part of the system that controls the transcription of genetic information from DNA to RNA.

Transcription factors perform this function alone, or by using other proteins in a complex, by increasing (as an activator), or preventing (as a repressor) the presence of RNA polymerase, the enzyme which activates the transcription of genetic information from DNA to RNA. Many transcription factors, especially some that are oncogenes or tumor-suppressors, help regulate the cell cycle and, as such, determine how large a cell will get and when it can divide into two daughter cells. One example is the Myc oncogene, which has important roles in cell growth and apoptosis. Many transcription factors are tumor-suppressor genes or oncogenes, and thus mutations or aberrant regulation of them are associated with cancer. For example, Li-Fraumeni syndrome is caused by mutations in the tumor-suppressor p53. Other transcription factors associated with cancer and/or believed to be tumor-suppressor genes include, but are not limited to SMAD2 and SMAD4.

"Apoptosis" refers to an active process of programmed cell death, which occurs normally during growth and development and also under conditions of cellular damage or stress; it is distinguished from necrosis, which is not an active process on the part of the dying cell. Apoptosis is a result of signal transduction cascades activated in the cell, for example by failed cell cycle checkpoints or by alterations in extracellular signaling, e.g., loss of growth factor receptor binding of a ligand such as a growth factor.

As used herein, "signal transduction pathway" refers to any process by which a cell converts one kind of signal or stimulus into another. Most processes of signal transduction involve ordered sequences of biochemical reactions inside the cell, which are carried out by enzymes, resulting in a signal transduction pathway.

Mutation of multiple genes within a single signal transduction pathway can result in a synthetic lethal mutation, wherein a viable cell can contain a mutation in either one gene or the other, but not both. Combination of the mutations in a single cell results in senescence or death of the cell.

As used herein, an organism is referred to as being "homozygous" (basically meaning of the same alleles) at a specific locus when it carries two identical copies of the gene affecting a given trait on the two corresponding homologous chromosomes (e.g., the genotype is PP or pp when P and p refer to different possible alleles of the same gene). Such a cell or such an organism is called a homozygote. A homozygous dominant genotype occurs when a particular locus has two copies of the dominant allele (e.g. PP). A homozygous recessive genotype occurs when a particular locus has two copies of the recessive allele (e.g. pp). Herein single alleles are referred to not as "homozygous" as "hemizygous" is the more instructive term for such a state.

A "functional assay" is a method to detect the activity of a gene, protein, or cell in response to a stimulus or insult. The specific functional assay performed depends on the specific mutation or mutations incorporated into the genome of the cell. Functional assays include, but are not limited to, kinase assays, transcription assays using, for example, reporter constructs, proliferation assays, apoptosis assays, migration/chemotaxis assays, nutrient sensitivity assay, agent (e.g., drug, chemotherapeutic agent, mutagen) or radiation sensitivity assays, nucleic acid-binding assay or protein-binding assay, all of which are within the ability of those of skill in the art.

As used herein, "hemizygous" describes an individual or cell which has only one full allele of a gene or chromosome segment rather than the usual two. A hemizygote refers to a cell or organism whose genome includes only one full allele at a given locus, whether the allele is wildtype or mutant. Therefore, a diploid hemizygous individual or cell can be P-null or p-null. For organisms where the male is heterogametic, such as humans, it refers in particular to X-linked genes, since males normally possess only one X-chromosome. They are hemizygous for (nearly) all genes that are located on the X-chromosome. An individual can also be hemizygous at a single locus due to genetic rearrangements and/or targeted deletions. When a rearrangement or large deletion of a chromosome renders one of the original two alleles so incomplete as to practically and irreversibly lose all potential function, herein it will be referred to as a hemizygous state.

As used herein, "heterozygosity" refers an individual having two different alleles of a gene. Heterozygous as used herein can refer to an individual having a dominant and a recessive allele of a gene, e.g., Pp, or to an individual who is hemizygous for a locus, e.g., P-null or p-null. Heterozygous can also refer to an individual or a cell that includes a mutation, e.g., point mutation, mis-sense mutation, non-sense mutation, deletion, introduced at a specific site. In population genetics, it is commonly extended to refer to the population as a whole, i.e. the fraction of individuals in a population that are heterozygous for a particular locus.

As used herein, "loss of heterozygosity" refers to the process of mutation (e.g., point mutation, insertion, deletion, translocation, copy number changes) by which a heterozygous somatic cell becomes homozygous or hemizygous for the allele, for example a mutated tumor-suppressor gene.

As used herein, having a "single functional copy" of a gene refers to a cell in which all of the copies of a particular gene except one is inactivated by mutation, either by manipulation using molecular biology techniques, or naturally occurring mutation, or both. Primary cells, for example from transgenic animals, may include only a single functional copy of a gene, e.g., heterozygous or hemizygous for a gene knockout or disruption. Although mammalian cells are typically diploid, it is within the scope of the invention to use cell lines that are immortalized that include more than two copies of a gene of interest; therefore, more than one copy of the gene may need to be disrupted to make the cell line include only a single copy of the gene. Methods of determining copy number of a gene for example using Southern blot or quantitative PCR is well within the ability of those of skill in the art.

As used herein, "gene" refers to the genomic sequence including introns, exons, control regions, 3'- and 5'-untranslated regions. A cDNA is a copy of the mRNA which is translated into the protein after splicing and other post-transcriptional processing events.

As used herein, an "exon" is a nucleic acid sequence that is represented in the mature form of an RNA molecule after a) portions of a precursor RNA, introns, have been removed by cis-splicing or b) two or more precursor RNA molecules have been ligated by trans-splicing. The mature RNA molecule can be a messenger RNA or a functional form of a non-coding RNA such as rRNA or tRNA. Depending on the context, exon can refer to the sequence in the DNA or its RNA transcript.

As used herein, "UTR," which stands for "untranslated region," refers to either of two sections on each side of a coding sequence on a strand of mRNA. If it is found on the 5' end, it is called the 5' UTR, or if it is found on the 3' end, it is called the 3' UTR. The untranslated regions typically include control regions involved in translation, RNA targeting, and post-transcriptional processing.

The term "intron," derived from the term "intragenic region" and also called intervening sequence (IVS), are DNA regions in a gene that are not translated into proteins. These non-coding sections are present in precursor mRNA (pre-mRNA) and some other RNAs, and removed by splicing during the processing to mature RNA. After intron splicing, the mRNA consists only of exons, which are translated into a protein. Mutations present in introns are often silent. However, intronic mutations can result in aberrant or alternative splicing.

As used herein, "database" refers to a collection of information, preferably in an electronic searchable format, that includes a specific class of information. For example, the information included in the database can be a list of mutations present in a gene and a scoring of the mutation or site of mutation as to the deleteriousness of the specific mutation or site of mutation, and/or the specific disease associated with the specific mutation or site of mutation.

As used herein, "library" is a collection of nucleic acid sequences, typically corresponding to a specific gene where the members of the library include one or more mutations in the gene as well as to the corresponding "normal" gene or a known, benign SNP of a "normal" gene. A library can include sequences from multiple genes. The nucleic acid sequence members typically contain a fragment of the sequence of the gene, e.g., intron, exon, and/or transcription or translational regulatory region, for example the 3'-UTR, 5'-UTR, or in a region at the junction of two of the juxtaposed regions, for example intron/exon junction or 5'-UTR/exon junction. In an embodiment, the library includes a series of mutations, either generated randomly or by design in a gene known to or suspected of being a tumor-suppressor gene or otherwise associated with cancer. Library members also preferably include sequences that facilitate replication of the library, e.g., plasmid sequences for replication in E. coli, chromosomal sequences in mammalian or yeast cells, in viral vectors, e.g., adenoviral vectors, adeno-associated viral vectors. A library can have essentially any number of members greater than 1, for example about 2, 5, 10, 15, 20, 25, 50, 100, 150, 200, 250, 500, 750, 1000, 1500, 5000, or more.

As used herein, a "nucleic acid fragment of a gene" is a portion of a gene large enough to include a mutation (e.g., 1 nucleotide) that is flanked by regions that allow for recombination of the fragment into the genome of a cell. Regions that allow for recombination into the genome of mammalian cells are at least about 50, 100, 250, 500, 750, 1000, 1500, or 2000 bp on each side of the mutation. Therefore, the overall length of a gene fragment for recombination should be about 100 to 4000, 250 to 4000, 500 to 2000, or 500 to 3000 bp with the mutation relative to the genomic sequence at least about 50, 100, 250, 500, 750, or 1000 bp of nucleotides from the end of the fragment. The portion of the fragment including the mutation need not necessarily be distinct from the flanking regions to allow recombination. The specific length of the nucleic acid fragment used is not a limitation of the methods of the invention as long as the fragment is of an appropriate size to allow for recombination.

The methods herein include recombination into a "functional gene" which is understood as insertion of the nucleic acid fragment into any portion or portions of a gene, e.g., intron, exon, transcriptional/translational control region, 3'UTR, 5'UTR, wherein the "functional gene" encodes a protein that has at least partial function of the wild-type gene, for example at least about 50%, 60%, 70%, 80%, or 90% of the activity of the wild-type gene as determined by standard functional assays for the specific gene type. A "functional gene" can include naturally occurring or artificially inserted mutations or alterations, for example silent mutations that do not alter the coding sequence of the expressed protein, to detect integration of a nucleic acid fragment into the gene, or to determine which strand the gene fragment integrated into.

As used herein, "transforming a cell" is understood as contacting a cell with a nucleic acid under conditions to promote uptake of the nucleic acid into the cell. The method of transfection may be selected based on the cell type into which the nucleic acid is to be introduced. Commonly used transfection methods include electroporation, calcium phosphate precipitation, cationic lipid reagents (e.g., Lipofectamine®, Oligofectamine®), dendrimer reagents. The invention is not limited by the method of transfection. As used herein, a cell transfected with a construct includes cells that contain the construct in the cell, as en episomal plasmid, or integrated into the genome of the cell. It is understood that upon recombination of the fragment into the genome, other sequences included in the originally transfected construct can be lost.

Cell culture is the process by which prokaryotic, eukaryotic or plant cells are grown under controlled conditions. In practice the term "cell culture" refers to the culturing of cells derived from multicellular eukaryotes, especially animal cells. The historical development and methods of cell culture are closely interrelated to those of tissue culture and organ culture.

Cells that are cultured directly from a subject are known as primary cells. With the exception of some derived from tumors, most primary cell cultures have limited lifespan. After a certain number of population doublings cells undergo the process of senescence and stop dividing, while generally retaining viability. Primary cells can be obtained from essentially any source, including transgenic animals.

An established or immortalized cell line has acquired the ability to proliferate indefinitely either through random mutation or deliberate modification, such as artificial expression of the telomerase gene. There are numerous well established cell lines representative of particular cell types. The methods herein can use essentially any cell line, preferably cell lines that are easily transfected by one or more methods. Cell lines for use in the methods of the invention include, but are not limited to cancer cells, near-diploid cancer cell lines having DNA mismatch-repair defects, CHO (Chinese hamster ovary) cells, 293 cells, and cells immortalized with viral transforming proteins or viral infection. Immortalized cell lines are frequently not precisely diploid, and can be aneuploid.

Cells for use in the invention "syngeneic" cells which is understood herein as cells preferably derived from, or being genetically identical. In some embodiments, cells can be derived from similar individuals of the same species especially with respect to antigenic interaction. Syngeneic cells can be cells from the same cell line, primary or immortalized. Syngeneic cells can be derived from isogenic mice or other animals, including transgenic animals.

As used herein, "diploid" is understood as having normal number of chromosomes in a somatic mammalian cell, which is frequently referred to as 2n, with the XX or XY chromosomes being considered as a "pair." During cell cycle phases G2 and M prior to the completion of cell division, the cell has a complement of 4n chromosomes. Gametes have a complement of 1n chromosomes.

As used herein, "aneuploid" is understood as having an abnormal number of chromosomes in a cell (i.e., not diploid in somatic cell, or haploid in gamete). Cells can have double the complement of chromosomes during G2 and M phases of the cell cycle.

The term "single nucleotide polymorphism" or "SNP" is understood as a naturally occurring DNA sequence variation occurring when a single nucleotide—A, T, C, or G—in the genome (or other shared sequence) differs between members of a species (or between paired chromosomes in an individual). For a variation to be considered a SNP, it must occur in at least 1% of the population. SNPS may fall within coding sequences of genes, non-coding regions of genes, or in the intergenic regions between genes. SNPs within a coding sequence will not necessarily change the amino acid sequence of the protein that is produced, due to degeneracy of the genetic code. A SNP in which both forms lead to the same polypeptide sequence is termed synonymous (sometimes called a silent mutation). If a different polypeptide sequence is produced they are non-synonymous. SNPs that are not in protein-coding regions may still have consequences for gene splicing, transcription factor binding, or the sequence of non-coding RNA.

As used herein, "selecting" is understood as identifying one or more members of a group.

The term "detectable label" is understood as a chemical modification, binding agent, or other tag that can be readily observed, preferably in a quantitative manner, such as a fluorescent tag that has a specific wavelength of absorption and emission to allow detection of the compound associated with the detectable label. Detectable labels include vital dyes for use with living cells wherein the dye has little or no effect on cell viability, growth, and function.

The term "reporter gene" which is typically used in the context of a "reporter construct" which is understood as a coding sequence for a polypeptide that is operably linked to a promoter sequence, typically an inducible promoter. The coding sequence for a polypeptide encodes a polypeptide that can be readily detected, preferably in a quantitative manner, such as alkaline phosphatase, beta-galactosidase, luciferase, green fluorescent protein, etc. Methods to detect the presence of such proteins is well known in the art and can be performed using any of a number of commercially available kits and automated readers. The selection of a reporter gene is a matter of choice.

As used herein, a "normal cell" is a cell that is derived from tissue that does not include any known mutations or disruptions that predispose the cell to a particular disease or disorder.

As used herein, "isolated" or "purified" is understood as being removed from its usual environment or other components with which they are naturally associated. For example, an isolated cell can be removed from an animal and placed in a culture dish or another animal. Isolated is not meant as being removed from all other cells. A group of cells can also be isolated (e.g., bone marrow cells, an organ) from one organism and placed in another organism or in culture. A polypeptide or nucleic acid is isolated when it is about 80% free, 85% free, 90% free, 95% free from other cellular material typically associated with the nucleic acid or polypeptide (e.g., material in a cell in which the nucleic acid or peptide is expressed), or substantially free of chemical precursors or other chemicals when chemically synthesized. An "isolated polypeptide" or "isolated polynucleotide" is, therefore, a substantially purified polypeptide or polynucleotide, respectively. Alternately an isolated nucleic acid or polypeptide may be present in a non-native environment for the molecule, e.g., a heterologous cell, tissue, or animal. As used herein, a "homogenously purified" polypeptide or nucleic acid is about 90%, 95%, 98%, or 99% pure and removed from biological or synthetic contamination from the synthesis of the polypeptide or nucleic acid. A homogeneously purified polypeptide or nucleic acid can be present in a buffer or other carrier such as a pharmaceutically acceptable carrier.

The terms "polypeptide," "peptide" and "protein" are used interchangeably herein to refer to a polymer of amino acid residues. The terms apply to amino acid polymers in which one or more amino acid residue is an artificial chemical mimetic of a corresponding naturally occurring amino acid, as well as to naturally occurring amino acid polymers and non-naturally occurring amino acid polymer.

As used herein, "nucleic acid sequence fragment" or "gene fragment" and the like are understood as a portion of a gene that includes at least about 8, 10, 12, 15, 17, 20, 25, 30, 35, 40, 45, 50, 55, 60, 65, 70, 75, 100, 150, 200, 250, 500 contiguous nucleotides from a full length naturally occurring gene or genomic sequence. A nucleic acid sequence fragment can include one or more mutations, naturally occurring or artificially (e.g., randomly) generated.

As used herein, nucleic acid sequences from "the same gene" and the like are nucleic acid sequences that are fragments of the same genomic sequence and may or may not include mutations or polymorphisms. A nucleic acid sequence from a gene includes fragments of the gene. A fragment from the same gene has at least 80%, 90%, 95%, or more identity with the wild-type sequence of the gene over the length of the fragment.

As used herein, "mutation" or a "gene comprising a mutation" includes alterations in one or more nucleic acids in a genomic sequence, including one or more base changes, deletions, and/or insertions, that result in silent mutations, nonsense mutations, mis-sense mutations, mutations that result in premature stop codons, aberrant splicing, transcription or translation. A gene comprising a mutation can have more than one mutation.

The terms "identical" or percent "identity," in the context of two or more nucleic acids or polypeptide sequences, refer to two or more sequences or subsequences that are the same or have a specified percentage of amino acid residues or nucleotides that are the same (e.g., 60% identity, optionally 65%, 70%, 75%, 80%, 85%, 90%, or 95% identity over a specified region), when compared and aligned for maximum correspondence over a comparison window, or designated region as measured using one of the following sequence comparison algorithms or by manual alignment and visual inspection. Such sequences are then said to be "substantially identical." This definition also refers to the compliment of a test sequence. Optionally, the identity exists over a region that is at least about 20 amino acids or nucleotides in length, or more preferably over a region that is about 25-50, 50-100, 100-200, 20-300, 50-500, 50-1000, 500-1000 amino acids or nucleotides in length.

For sequence comparison, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters can be used, or alternative parameters can be designated. The sequence comparison algorithm then calculates the percent sequence identities for the test sequences relative to the reference sequence, based on the program parameters.

Sequence alignments can be used to determine amino acids that are more or less conserved between species. Alteration of non-conserved amino acids is typically has less of an effect on the activity of a polypeptide than mutation of a conserved amino acid. Similarly, more conservative mutations, based on charge and/or size of the amino acid, typically have less of an effect on the activity of a polypeptide. For example a conservative mutation would include substitution of one small, neutral, non-polar amino acid such as alanine, glycine, isoleucine, leucine, proline, and valine for another. Similarly, mutation of a glutamic acid to an aspartic acid, or vice versa would also be considered a conservative mutation. Exchange of phenylalanine, tyrosine, and tryptophan for each other would be considered a conservative mutation. Protein tolerance to random mutations is understood in the art, for example, see Guo et al. (Protein tolerance to random amino acid change. *Proc. Natl. Acad. Sci. USA* 101:9205-9210, 2004, incorporated herein by reference). SNPs or other natural variations associated with disease can be used to identify essential amino acids that do or do not tolerate mutation.

Unless otherwise indicated, a particular nucleic acid sequence also implicitly encompasses conservatively modified variants thereof (e.g., degenerate codon substitutions) and complementary sequences, as well as the sequence explicitly indicated. Specifically, degenerate codon substitutions may be achieved by generating sequences in which the third position of one or more selected (or all) codons is substituted with mixed-base and/or deoxyinosine residues (Batzer et al., *Nucleic Acid Res.*, 19:5081 (1991); Ohtsuka et al., *J. Biol. Chem.* 260:2605-2608 (1985); Rossolini et al., *Mol. Cell Probes*, 8:91-98 (1994)). The term nucleic acid is used interchangeably with gene, cDNA, mRNA, oligonucleotide, and polynucleotide.

By "analog" or "derivative" is meant a molecule that is not identical, but has analogous functional or structural features.

By "small molecule" is meant a compound having a molecular weight of no more than about 1500 daltons, 1000 daltons, 750 daltons, 500 daltons. A small molecule is not a nucleic acid or polypeptide.

As used herein, the term "polymerase chain reaction" (PCR) refers to the methods of U.S. Pat. Nos. 4,683,195, 4,683,202, and 4,965,188, all of which are hereby incorporated by reference, directed to methods for increasing the concentration of a segment of a target sequence in a mixture of genomic DNA without cloning or purification. As used herein, the terms "PCR product" and "amplification product" refer to the resultant mixture of compounds after two or more cycles of the PCR steps of denaturation, annealing and extension are complete. These terms encompass the case where there has been amplification of one or more segments of one or more target sequences.

Of the PCR techniques, RT-PCR (Reverse Transcription-PCR), competitive RT-PCR and the like are used for detecting and quantifying a trace amount of mRNA, and show their effectiveness. A real-time quantitative detection technique using PCR has been established (TaqMan® PCR, *Genome Res.*, 6 (10), 986 (1996), ABI PRISM™ Sequence Detection System, Applied Biosystems, incorporated herein by reference).

The use of PCR and methods to design primers and select polymerases to identify single nucleotide changes are well known in the art. For example, the importance of hybridization of the 3' ends of primer sequences to allow for extension is well known. Methods to distinguish genomic sequences that have undergone recombination, or not, are well known in the art, including primer design, and methods are further provided herein.

As used herein, the term "recombinant DNA molecule" as used herein refers to a DNA molecule, which is comprised of segments of DNA joined together by means of molecular biological techniques.

As used herein, a nucleic acid sequence, even if internal to a larger oligonucleotide, also may be said to have 5' and 3' ends. In either a linear or circular DNA molecule, discrete elements are referred to as being "upstream" or 5' of the "downstream" or 3' elements. This terminology reflects the fact that transcription proceeds in a 5' to 3' fashion along the DNA strand. The promoter and enhancer elements which direct transcription of a linked gene are generally located 5' or upstream of the coding region. However, enhancer elements can exert their effect even when located 3' of the promoter element and the coding region. Transcription termination and polyadenylation signals are located 3' or downstream of the coding region.

By "detecting" or "detection" and the like is meant the process of performing the steps for determine if an analyte or nucleotide sequence is present, or to determine if a compound, gene, or mutation has an effect, or if a recombination or insertion has taken place, and the like. The amount of analyte present or the effect may be none or below the level of detection of the method.

As used herein "correlating an mutation in a gene with a diagnosis or predisposition to a disease or condition" is understood as detecting a mutation determined to be deleterious (or not) present in a sample from a subject and associating the presence of the specific mutation with an increased incidence or chance of occurrence (or not) of the development of a specific disease or condition, e.g., a specific type of cancer.

By "ameliorate" is meant decrease, suppress, attenuate, diminish, arrest, or stabilize the development or progression of a disease. Amelioration can require administration of more than one dose.

The term "treated," "treating" or "treatment" includes the diminishment or alleviation of at least one symptom associated or caused by the state, disorder, condition, or disease being treated. For example, treatment can be diminishment of one or several symptoms of a disorder or complete eradication of a disorder. Treatment can also include prophylaxis (i.e., prevention). Treatment can result in amelioration of a disease. Treatment and prophylaxis can require administration of more than one dose.

As used herein, "susceptible to" or "prone to" or "predisposed to" a specific disease or condition and the like refers to an individual who based on genetic, environmental, health, and/or other risk factors is more likely to develop a disease or condition than the general population. An increase in likelihood of developing a disease may be an increase of about 10%, 20%, 50%, 100%, 150%, 200%, or more.

By "diagnosing" as used herein refers to a clinical or other assessment of the condition of a subject based on observation, testing, or circumstances for identifying a subject having a disease, disorder, or condition based on the presence of at least one sign or symptom of the disease, disorder, or condition. Typically, diagnosing using the method of the invention includes the observation of the subject for other signs or symptoms of the disease, disorder, or condition in addition to detection of a loss-of-function mutation in a gene that makes the subject susceptible to a particular disease or condition.

By "alteration" is meant a change (increase or decrease) in the expression levels or activity of a gene or polypeptide" as detected by standard art known methods (e.g., ELISA, PCR, mass spectrometry based methods, immunohistochemistry, RIA, functional assays). An alteration in activity for example from a gene mutation may only be detectable when present in combination with a second mutation or alteration.

As used herein, "obtaining" is understood as purchase, procure, manufacture, or otherwise come into possession of the desired material.

"Providing," refers to obtaining, by for example, buying or making the, e.g., polypeptide, drug, polynucleotide, probe, and the like, including libraries of nucleic acids or cells having a targeted heterozygous for a mutation or deletion in a gene. The material provided may be made by any known or later developed biochemical or other technique, e.g., standard molecular biology techniques.

The term "subject" includes organisms which are capable of suffering from a disease of interest that could otherwise benefit from detection of a mutation in a gene that can result in a loss of function of the gene, or predispose the subject to a specific disease or condition such that the subject would benefit from screening. The term "non-human animals" of the invention includes all vertebrates, e.g., mammals, e.g., sheep, dog, cow, and primates including non-human primates; e.g., rodents, e.g., mice, and non-mammals, e.g., chickens, amphibians, reptiles, etc. A human subject can be referred to as a patient.

The term "differential" or "differentially" generally refers to a statistically significant different level in the specified property or effect. Preferably, the difference is also functionally significant. Thus, "differential binding or hybridization" is a sufficient difference in binding or hybridization to allow discrimination using an appropriate detection technique. Likewise, "differential effect" or "differentially active" in connection with a therapeutic treatment or drug refers to a difference in the level of the effect or activity that is distinguishable using relevant parameters and techniques for measuring the effect or activity being considered. For example, identification of a specific loss of function mutation can provide an indication of a drug that may be most useful for the treatment of a specific disease (e.g., cells having mutations in a DNA repair gene may be more susceptible to treatment with a drug that induces DNA double strand breaks). Preferably the difference in effect or activity is also sufficient to be clinically significant, such that a corresponding difference in the course of treatment or treatment outcome would be expected, at least on a statistical basis.

As used herein, "antibody" is understood as whole antibodies such as IgG, IgM, IgA, IgD or IgE, or fragments, such as a Fab, F(ab')$_2$, Fv, disulphide linked Fv, scFv, closed conformation multispecific antibody, disulphide-linked scFv, whether derived from any species naturally producing an antibody, or created by recombinant DNA technology; whether isolated from serum, B-cells, hybridomas, transfectomas, yeast or bacteria). Antibodies can be monoclonal or polyclonal. Antibodies can be humanized (e.g., see U.S. Pat. No. 5,565,332, incorporated herein by reference) or otherwise modified to facilitate administration. Antibodies preferably are specific for their target antigen. Preferably an antibody is specific for its target antigen with at least $10^4$-fold, $10^5$-fold, $10^6$-fold specificity as compared to binding to a non-specific antigen as determined, for example, using a competition binding assay.

Techniques for preparing and using antibody molecules are well known to those skilled in the art (see Harlow and Lane (1989) *Antibodies*, Cold Spring Harbor Laboratory, pp. 1-726; O'Brien and Aitken (2002) Antibody Phage Display, Humana Press).

Ranges provided herein are understood to be shorthand for all of the values within the range. For example, a range of 1 to 50 is understood to include any number, combination of numbers, or sub-range from the group consisting 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50.

Unless specifically stated or obvious from context, as used herein, the term "or" is understood to be inclusive.

Unless specifically stated or obvious from context, as used herein, the terms "a", "an", and "the" are understood to be singular or plural.

As used herein, "about" is understood to mean approximately or reasonably close to, and within the tolerances generally accepted in the specific experiment or result, for example within two standard deviations of the mean of a specific result.

The recitation of a listing of chemical groups in any definition of a variable herein includes definitions of that variable as any single group or combination of listed groups. The recitation of an embodiment for a variable or aspect herein includes that embodiment as any single embodiment or in combination with any other embodiments or portions thereof. For example, any single point mutation or alteration of the wild-type sequence can be combined with any other mutation or alteration of the wild-type sequence.

Any compositions or methods provided herein can be combined with one or more of any of the other compositions and methods provided herein.

DETAILED DESCRIPTION OF THE INVENTION

Figure 1:
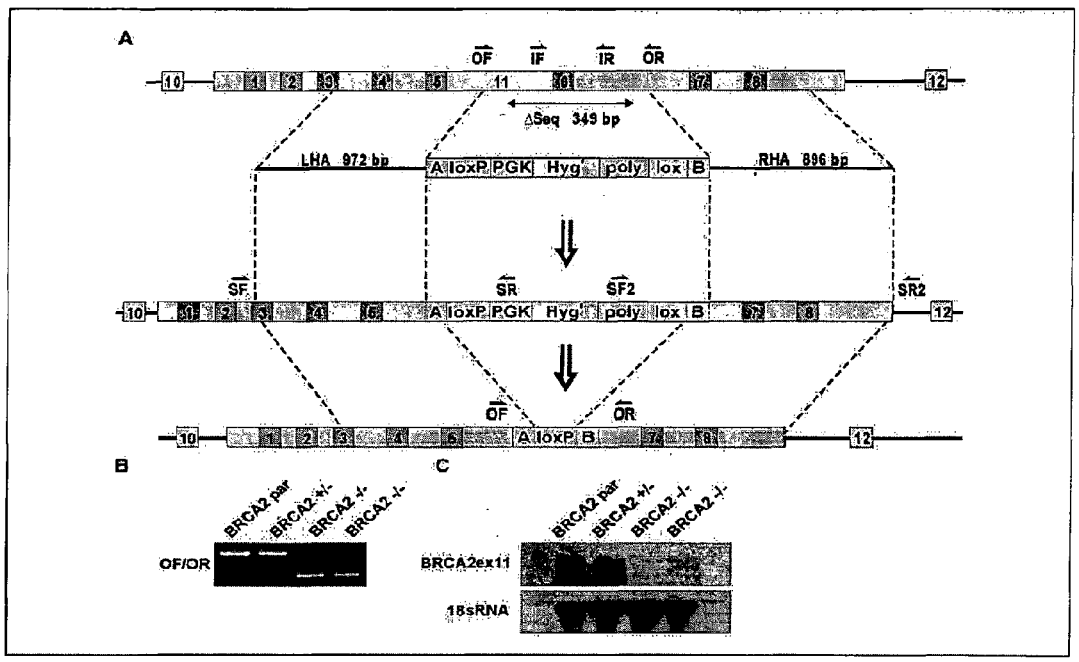
FIG. 1. Structural and functional demonstration of BRCA2 gene disruption. A. Targeting scheme. OF and OR primers outside the deleted sequence. IF and IR primers inside the deleted sequence; SF, SR, SF2, SR2, screening primer pairs; LHA (forward, 5'-GATCAGAAACCAGAAGAATTGC-3' (SEQ ID NO: 36) and reverse 3'-CTGGCTCAATACCA-GAATCAAG-5'(SEQ ID NO: 37)) and RHA (forward, 5'-AGGTTGTTACGAGGCATTGG (SEQ ID NO: 38) and reverse 3'-CGTTTTAGGTGAAGCCTGTTC-5' (SEQ ID NO: 39)), left and right homology arms. Numbers on light background indicate exons, and numbers on dark background indicate BRC repeats. B. PCR detecting the wt and targeted alleles using genomic DNA as a template. C. Northern blot detecting the targeted exon 11 mRNA transcript. D. Structural demonstration of BRCA2 exon 27 targeting. Targeting scheme. OF primer, outside the deleted sequence; IR primers, inside the deleted sequence; SF, SR, SF2, and SR2, screening primer pairs; INF and INR, intron 25 spanning primers; LHA and RHA, left and right homology arms.
Figure 1:
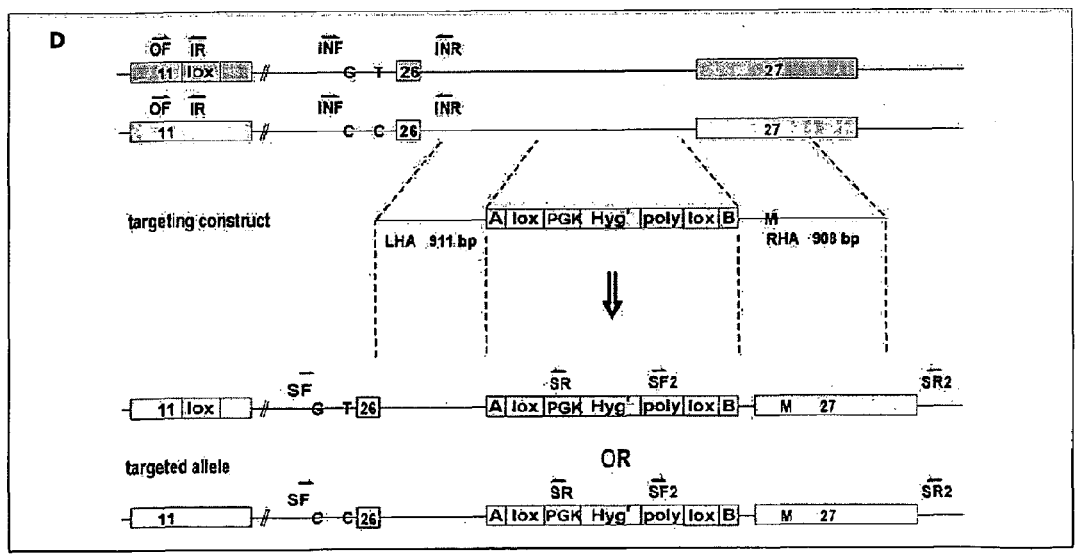

The invention provides compositions, methods, databases, and kits for the identification and characterization of the relative deleteriousness of potential loss of function mutations in genes, for example in suspected tumor-suppressor genes, and for determining susceptibility of a subject to a disease or condition based on the presence of one or more mutations in a gene determined to be deleterious.

The present invention provides a method for distinguishing inactive from active forms of a gene. More specifically, the invention provides a functional assay for distinguishing inactive and active forms of a gene, and the means to classify variants of unknown significance to gene function. By functional evaluation of clones harboring mutations, the invention provides a method to classify sequence variants as deleterious, hypomorphic, or neutral. A hypomorphic mutation reduces, but does not completely eliminate, the function of a gene.

The invention may be used to analyze any gene of interest. In an embodiment, mutation of the gene can results in a loss-of-function of the gene. In an embodiment the gene is a tumor-suppressor gene. For example, the gene is selected from the group consisting of BRCA1, BRCA2, MLH1, MSH2, MSH6, EPHA3, EPHA4, APHB2, 1NI1, AXIN1, AXIN2, MLL3, EP300, NF1, TP53, APC, VHL, SMAD2, SMAD4, KEAP1, CDKN2A, RB1, MEN, NF2/SCH, PTCH, TGFBR1, TGFBR2, ACVR1B, AVCR2, MRE11, MAP2K4, and LKB1/STK11

The present invention also provides hemizygous mammalian cell lines comprising a first functional copy (allele) of a gene of interest and a second allele of the same gene with a deleted region abrogating gene function or a region intentionally altered such that the second allele produces a functionally inactive gene product. For example, the gene is selected from the group consisting of BRCA1, BRCA2, MLH1, MSH2, MSH6, EPHA3, EPHA4, APHB2, INI1, AXIN1, AXIN2, MLL3, EP300, NF1, TP53, APC, VHL, SMAD2, SMAD4, KEAP1, CDKN2A, RB1, MEN, NF2/SCH, PTCH, TGFBR1, TGFBR2, ACVR1B, AVCR2, MRE11, MAP2K4, and LKB1/STK11

The invention provides methods of introducing into a hemizygous cell line by homologous recombination a gene sequence comprising a single variant of the sequence of the gene of interest or a fragment of a gene of interest. The resulting syngeneic clone differs from the parental line by a single sequence variant. More preferably, the gene is selected from the group consisting of BRCA1, BRCA2, MLH1, MSH2, MSH6, EPHA3, EPHA4, APHB2, INI1, AXIN1, AXIN2, MLL3, EP300, NF1, TP53, APC, VHL, SMAD2, SMAD4, KEAP1, CDKN2A, RB1, MEN, NF2/SCH, PTCH, TGFBR1, TGFBR2, ACVR1B, AVCR2, MRE11, MAP2K4, and LKB1/STK11.

The present invention further provides a panel or library of such syngeneic cell lines, a syngeneic variance cell line library. Preferably the syngeneic variant cell line library comprises five or more syngeneic variant cell lines. In the syngeneic variant cell line library, members of the library include genomes that vary at specific, and optionally defined sites. Preferably at specific defined sites within one or more tumor-suppressor genes in the genome, or suspected tumor-suppressor genes in the genome. More preferably, the cell lines of the syngeneic variant library vary at specific, and optionally defined sites within the genomic sequence of a single gene, for example a single tumor-suppressor gene, or the genomic sequence of a suspected tumor-suppressor gene. For example, syngeneic variant library includes cell lines derived from the same source that include a series of mutations at various sites in BRCA1, BRCA2, MLH1, MSH2, MSH6, EPHA3, EPHA4, APHB2, INI1, AXIN1, AXIN2, MLL3, EP300, NF1, TP53, APC, VHL, SMAD2, SMAD4, KEAP1, CDKN2A, RB1, MEN, NF2/SCH, PTCH, TGFBR1, TGFBR2, ACVR1B, AVCR2, MRE11, MAP2K4, or LKB1/STK11.

Current means are often inadequate to determine whether a variant of tumor-suppressor genes found upon the genetic study of individual patients is likely to cause an elevated cancer risk. These variants are often termed Variants of Unknown Clinical Significance (UVs, VUSs, etc). Unlike the well-known deleterious mutations of tumor-suppressor genes, such as BRCA2, a large number of variants are, individually, uncommon. Thus the assigned risk for each variant cannot be assessed to a reasonable level of statistical certainty. When a patient is identified to have a UV, it is difficult to provide an unambiguous laboratory interpretive result to the ordering physician, it is difficult to convey to the patient the appropriate genetic counseling, and it is uncertain what should be the appropriate medical management of the patient. The BRCA2 status of the patient, i.e., whether the BRCA2 gene variants are deleterious or nondeleterious (i.e., benign or neutral), are used to advise on cancer risk, frequency and mode of cancer screening, advisability of prophylactic mastectomy or ovarectomy, rationalize a cancer-rich family history, advise on family planning before the birth of offspring, and in an experimental therapeutic setting dictate the selection of specific anticancer drugs thought to be more efficacious when a patient has a deleterious BRCA2 gene. The assignment of a BRCA2 status of "UV" to a patient leads not only to uncertainty as to these issues, but considerable anxiety among the patient and their family members, many of whom are expected to also carry the UV BRCA2 status even if they are not yet tested genetically.

Current epidemiologic techniques to make this decision include the following. If there is considerable past medical experience with other patients having the variant, the statistical association with higher cancer risk will already be known. If the variant has been identified in persons who, in addition, have a known deleterious BRCA2 sequence, the variant is thought less likely to itself be deleterious. If the status of the variant does not track with the disease status among the members of a family having multiple incidents of a BRCA2-related cancer, the variant is also thought less likely to be deleterious. Many variants remain in the UV status even after consideration of these epidemiologic patterns. The cost of testing multiple family members can be prohibitive even when consent and samples can be obtained from a sufficient number of individuals.

Thus, laboratory studies of the biological function of the variant BRCA2 genes have been proposed. This is done because of considerable evidence that the mutations in BRCA2 convey an increased cancer risk only due to the consequential loss of Brca2 protein function. Unfortunately, functional testing cannot be performed directly on the blood cells of the patient, because the patients have two BRCA2 alleles in each normal cell, and the function of the normal allele will mask any deficiencies in the variant allele. On the other hand, the tumor cells of the patient could be studied, for the tumor cells will have lost the normal allele, but such studies are impractical since the patient may not have yet developed cancer, and any cancers that develop cannot be readily obtained in a pure and numerous manner. Moreover, cancer cells typically accumulate mutations as the tumor grows; therefore, it was not possible to determine what mutations were essential to promote the uncontrolled growth of the cells originally, and what mutations were accumulated during the clonal expansion of the initial tumor cell.

Thus, more indirect laboratory techniques have been explored, including the following. Efforts at molecular modeling of the variant sequence use the predicted protein modifications that would be created by each UV, followed by algorithms to score the likelihood of serious protein dysfunction that might result; such efforts have worked when the variant is able to truncate the protein translation (such as nonsense or splice site mutations), but have been unreliable for missense variants. A transgenic mouse or mouse embryonic stem cells can be created that incorporates a mouse analog of the human variant BRCA2 gene, and subsequently studied for Rad51 focus formation, sensitivity to ionizing radiation, or homologous recombination of a plasmid. This assay is prohibitively expensive, and has predominantly been used for obvious deleterious mutations, and is of unclear relevance in studies of subtle human variant sequences because human and mouse proteins differ in their amino acid sequences already. Individual pure clones of the variant or normal BRCA2 cDNA sequences can be introduced into and exogenously expressed in a mammalian cell line, and the cell line is subsequently studied for Rad51 focus formation upon treatment with DNA damaging agents, homologous recombination of a plasmid, or centrosome amplification (Carvalho et al, *J Biochem Cell Biol*, 2007. 39:298-310. Epub 2006 Aug. 18, incorporated herein by reference) in that technique, a number of UVs gave different results in the different assays, leading to confusion as to which of the results to use in assigning clinical risk.

Provided herein are reagents and methods to classify mutations of an interrogated gene as deleterious or benign, or somewhere therebetween, particularly loss of function mutations in loss-of-function genes.

The invention provides a human cell line engineered using DNA recombinant techniques to be genetically constituted as follows: hemizygous for a single native and functional copy of the interrogated gene, and to contain at least one copy at the site of the same gene having been engineered to render it functionally inactive by mutation. A cell containing this resultant allelic arrangement is termed hemizygous for the interrogated gene.

The invention provides introduction of fragments of the interrogated gene, some of which may contain inactivating variants, in a manner leading to homologous recombination of the fragment and replacing a portion of one of the two endogenous gene alleles of the hemizygous cell, one allele (or more, in the case of polysomy wherein the gene may exist in three or more copies) of which was previously engineered to be inactive, one of which had remained native.

The invention includes methods for identification and isolation of recombinant clones including the gene fragment and the inactivated interrogated gene (e.g., tumor-suppressor gene), followed by differential enumeration of the number of hemizygous clones having integrated the fragment into the engineered-inactive and, alternatively, into the native-functional allele of the interrogated gene, to determine the recombination frequency into each the functional allele and the non-functional allele of the same gene.

The recombination frequency of each variant is used to determine the relative deleteriousness of a specific mutation. A variant resulting in live clones having homologous integration only in the engineered-inactive allele, but not in the native-functional allele, would be considered a dysfunctional or deleterious variant, one likely to be pathogenic when inherited by a person. A variant resulting in equal numbers of integrants affecting the engineered and the native alleles would be considered a variant having normal function, one unlikely to be pathogenic (i.e., benign or neutral). Results intermediate between these two scenarios would be assessed statistically to determine whether the results were significantly likely to be intermediate, i.e., not representing a chance departure from either "pure" scenario. Appearance of preferential integration into the active allele could additionally indicate that the mutation promotes cell division or inhibits apoptosis by increasing the apparent rate of proliferation. Similarly, a confidence interval or recombination frequency for the results could be reported, using a spectrum of values from 0 (the emergence of integrants solely into the engineered allele, attributable to dysfunctional variants) to 1 (the equal emergence of the two types of integrants, attributable to a normally functioning variant). The recombination frequency can be expressed as the number of integrants into the normal allele/number of integrants into the non-functional allele.

In an alternative embodiment of the invention, the interrogated gene need not influence cell viability or proliferation, and mutations are classified as deleterious or benign by a biological assay of the recombinant clones containing the mutated fragments. This assay would test for a biochemical property in vivo or in vitro, such as but not limited to alterations in a protein, an RNA species, DNA integrity, activity of a transcriptional reporter, or drug sensitivity.

In another alternative embodiment of the invention, the inactive allele is inactivated in a manner to prevent recombination of the gene fragment with the inactivated gene. In another embodiment, the gene fragment to be tested is a fragment of a gene other than the gene that is inactivated. Such a screen is typically known as a synthetic lethal screen. In such methods, the ratio of integration of the fragment into the functional allele and non-functional allele cannot be compared as preferably only a single site for possible integration exists. The recombination frequency is the frequency of recombination of a gene fragment including a mutation of interest, optionally with other silent mutations/a gene fragment that will result in expression of a wild type gene product (i.e., a gene fragment containing silent mutations, a control sequence) under the same conditions. The use of silent mutations allows for the identification of integrants within the wild type sequence to determine frequency of integration. It is understood that the mutation in the fragment to be tested must be a sufficient distance from the end of the gene fragment to not alter the recombination frequency due to inability to generate stable structures to allow for recombination. Such considerations are routine for those of skill in the art.

In another embodiment of the invention, introduced mutations can be "multiplexed", wherein a mutant allele comprises more than one (optimally three to ten or three to 25 or 3 to 50) discrete variations as compared to the wildtype allele. Using multiplexed variant sequences allows a single recombinant clone to be informative as to the classification of more than one discrete variant. This is especially useful when the fraction of variants exhibiting dysfunction is relatively low.

The variants having a statistically significant departure from a value of 1 for recombination frequency, yet having given rise to at least one integrant into the native-functional allele, can be further studied and potential subgroups of dysfunctional classes assigned functionally according to the residual capabilities of the clones as assessed by tests of gene function. These follow-up tests for example for BRCA2 or other tumor-suppressor genes thought to be involved in DNA repair could include, but are not restricted to, Rad51 focus-formation, sensitivity to anticancer agents, centrosome amplification, and homologous recombination of introduced plasmids. Other tests to assess gene function include, but are not limited to, kinase assays, transcription assays using, for example, reporter constructs, proliferation assays, apoptosis assays, or migration assays, all of which are within the ability of those of skill in the art.

The invention provides kits for the practice of the methods of the invention.

The invention provides syngeneic libraries of dozens or hundreds of engineered cell lines, each line containing a different gene variant. Libraries can included variants of a single interrogated gene or multiple interrogated genes. Libraries can include a mixed population of cells in a single tube, or multiple cell lines each present in a separate tube, or some combination thereof, e.g., a series of mixed populations of cells each mixture including mutations in a single intron, exon, or regulatory control region of an interrogated gene, a series of mixed populations of cells each mixture including mutations in a single interrogated gene.

The invention further provides a database of results obtained by the methods provided herein that lists mutations in interrogated genes and their recombination frequency that correlate with the relative deleteriousness of the specific mutation or combination of mutations. The database can further include, for example, results from other experiments, either in vivo or in vitro, to further characterize the activity of the various mutants.

The scope of natural human genetic variation is now becoming evident but is enormous (Sjoblom, T., et al., 2006 Science 2006. 314, 268-74; Greenman, C., et al., Genetics 2006. 173, 2187-98.). To accurately annotate these variants, and to identify which of them have medical importance through functional assays may be difficult for several reasons. Natural cell lines expressing the variants homozygously are often unavailable and do not allow isogenic experimental controls. Artificially introduced null states can be inviable. For some genes, such as the medically important BRCA2 gene and other tumor-suppressor genes, even the exogenous expression of wild-type gene fragments can cause interference with endogenous gene function (squelching) unless assays are performed with extreme technical care and multiple controls (Esashi, F. et al., Nature 2005. 434, 598-604; Yuan, S. S., et al., Cancer Res. 1999. 59, 3547-51; Davies, A. A., et al., Mol Cell. 2001. 7, 273-82; Wu, K., et al., Cancer Res. 2005. 65, 417-26).

The BRCA2 gene exhibits allelic differences in its sequence among members of the human population. Some of the variants are known to be deleterious, causing inherited susceptibility to breast, ovarian, and other cancer types (King, M. C., et al., Science 2003. 302, 643-6; Goggins, M., et al., Cancer Res. 1996. 56, 5360-4). Unfortunately, in many patients who are tested and have a BRCA2 variant identified, the alteration is subtle, changing a single amino acid (Frank, T. S., et al., J Clin Oncol 2002. 20, 1480-90). For many of these variants, it is not possible to use epidemiological data or laboratory studies of protein function to determine unambiguously nor efficiently whether one should classify the variant as either deleterious or benign.

BRCA2 gene on chromosome 13q12-13 encodes a 3418 amino acid protein. Its sequence reveals only a few clues to its cellular function and thus variation in the sequence is not readily interpreted. The protein's role in DNA repair specifically involves homologous recombination, mediated by its interaction with Rad51 (Connor, F., et al., Nat Genet. 1997. 17, 423-30; Moynahan, M. E., et al., Mol Cell. 2001. 7, 263-72; Wong, A. K., et al., *J Biol Chem*. 1997. 272, 31941-4.). BRCA2 interacts with Rad51 through highly conserved BRC repeats in exon 11 and an interaction domain mapped to exon 27 (Howlett N G, et al., *Hum Mol Genet*. 2005. 14:693-701; Montes de Oca R, *Blood* 2005. 105:1003-1009.). The interaction of Rad51 with exon 27 has been proposed to be down-regulated by CDK-dependent phosphorylation of S3291, which is reduced during S phase and after DNA damage. However, most functional studies of BRCA2 have been hampered by the lack of well-controlled human cancer cellular models. Such absence was in the past overcome by employing methods of considerable technical difficulty.

To accurately annotate sequence variations of the BRCA2 gene in an unambiguous and technically facile model, targeted disruption of BRCA2 exon 11 was performed by homologous recombination, yielding the first available syngeneic human cancer BRCA2 knock-out cell line. Using hemizygous BRCA2 cells, we constructed a library of syngeneic exon 27 genetic variant lines (a SyVaL). By functional evaluation of multiple clones harboring individual mutations, sequence variants were able to be classified as deleterious, hypomorphic, or neutral. A pseudo-phosphorylated BRCA2 variant was also created, replacing the normal gene. The studies disclosed herein support the importance of exon 27 in recombination-mediated DNA repair and the role of serine 3291 in phosphorylation-regulated BRCA2-Rad51 interaction, and provide a proof of concept of the methods of the invention.

The BRCA2 gene exhibits allelic differences in its sequence among members of the human population. Some of the variants are known to be deleterious, causing inherited susceptibility to breast, ovarian, pancreatic, and other cancer types. Unfortunately, in many patients who are tested and have a BRCA2 variant identified, the variant is subtle, changing a single amino acid of the BRCA2 protein. For most of the BRCA2 variants, it is not possible to use epidemiologic data or laboratory studies of protein function to determine unambiguously nor efficiently whether one should classify the variant as either "deleterious" or "benign".

Provided herein is a database that provides an unambiguous numerical functional assessment and interpretation of individual variant alleles, as measured along a continuous spectrum of "deleterious" to "benign". That is, a variant may be classified within the database as belonging to one of these extremes, or as a numerical value intermediate between "deleterious" and "benign".

This database corresponds also to a library, from which it is derived. The library comprises a sizable panel of cell lines derived by recombinant DNA engineering from a heterozygous cell line having only a single functional allele of the gene to be interrogated, e.g., BRCA2. The library is constructed in a cell line for which the loss of the function of the gene to be interrogated is detrimental to cell growth or cell survival. The presence or absence of a variant in the library depends upon the residual function of the allele of the gene to be interrogated after variants are introduced. Relative to a control value, the presence of a threshold fraction of cell lines in the library having an introduced variant in the gene to be interrogated reflects a "benign" function, while the relative or absolute absence of the variant from the library reflects a "deleterious" function. A given cell line in the library may contain many simultaneous variants, permitting the library to be a highly efficient source for the measurements and interpretations accrued into the database.

The invention provides a model in which human gene function could be evaluated based on comparative assessments of the functional impact of individual in-situ sequence alterations of one allele. A syngeneic stable library of sequence variants of BRCA2 exon 27 was constructed. The library enabled the functionally classification of BRCA2 genomic sequence variants of previously unknown significance in a robust manner to help to predict the cancer risk associated with presence of the same mutations in heterozygous patients. Furthermore, the protein based on functional evaluation of subtle protein residue substitutions was investigated.

The SyVaLs of BRCA2 provide a proof of concept of the libraries and methods of the invention for the characterization of mutations in tumor-suppressor genes, or suspected tumor-suppressor genes, or mutations in other genes that result in a loss of function resulting in an increased susceptibility to a specific disease or condition.

First, as a positive control for functional evaluation of SyVaL clones, BRCA2-null cells were generated. Previously, no BRCA2 engineered human gene knock-out cells had been reported. BRCA2 knock-out models exist in mouse, rat, hamster and chicken cells. The pancreatic cancer cell line CAPAN1, the only BRCA2-deficient human cancer cell line, is cumbersome for its low transfectability, poor clonogenicity and lack of isogenic controls. The $BRCA2^{\Delta ex11/\Delta ex11}$ cells disclosed herein provide a stable human cancer syngeneic BRCA2 knock-out model.

The $BRCA2^{\Delta ex11/\Delta ex11}$ cells demonstrated features of BRCA2 deficiency, being defective in homologous recombination as assessed by absence of induction of Rad51 foci upon DNA damage, having chromosomal instability after treatment with mytomycin C (MMC), and being modestly more sensitive to irradiation than syngeneic cells not having the mutation.

To further confirm the BRCA2 phenotype and explore potential treatment options for patients having BRCA2 deficient tumors, an informative panel of drugs was tested in the library of cells. An increased sensitivity to various interstrand cross-linking (ICL) agents and the PARP inhibitor NU1025 was demonstrated, producing pharmacogenetic windows between 10 and 20 (Hucl, T., et al., *Cell Cycle*. 2007. 6, 1336-41).

In the well-controlled human cancer model provided herein, the etoposide hypersensitivity of BRCA2-deficient cells, first reported by Holt and Zdzienicka in CAPAN1 cells and syngeneic hamster cells (Abbott, D. W., et al., *J Natl Cancer Inst*. 1998. 90, 978-85; Wiegant, W. W., et al., *Mutat Res*. 2006. 600, 79-88) was confirmed. Further, it was shown that the difference in sensitivity of the BRCA2 deficient cells to the drug may be even greater (10-fold) than recently reported by Treszezamsky (2.75-fold) in fibroblasts from a Fanconi D1 patient (Treszezamsky, A. D., *Cancer Res*. 2007. 67, 7078-81.). In yeast, the requirement of homologous recombination for topoisomerase-associated toxicity was demonstrated (Hay, T., et al., *Oncogene*. 2005. 24, 3842-6). Not all models have been in agreement. For example, no increased etoposide sensitivity was observed in BRCA2-deficient mouse thymocytes (Flores, K. G., et al., *Mol Carcinog* 2002. 35, 103-9) or small intestines (Walker, J. V., et al., *J Biol Chem*. 2004. 279, 25947-54). The findings thus distinguish cells having defects of the distal (BRCA2, etoposide-hypersensitive) and proximal (no etoposide hypersensitivity) FA pathway (Gallmeier, E., et al., (2006) *Gastroenterology*. 2006. 130, 2145-54). Experiments were extended herein to additional topoisomerase inhibitors. Given the rather low side-effect profile of some of these drugs and the measured pharmacogenetic window of up to 10, data provided herein support their use as candidates for rational treatment of patients with BRCA2-deficient tumors.

The BRCA2$^{\Delta ex11/\Delta ex11}$ cells together with various SyVaL clones thus also represent an optimal model suitable for high-throughput drug screening of compound libraries to identify novel agents having selective toxicity in cells containing pathogenic mutations. No intermediate phenotype of the heterozygous clones was observed, suggesting that use of these drugs may be permissible in cancer patients who are carriers of heterozygous germline BRCA2 mutations.

The lack of understanding of the functional importance and associated cancer risk of sequence variants in the BRCA2 gene represent a serious medical problem. The strongest interpretive evidence tends to come from segregation analyses and observed co-occurrence with known pathogenic mutations, both of which require information that is often not available. Functional studies of human BRCA2 have proven very difficult. Prior cell-based in vitro assays depended upon expression of either partial or complete wild-type or mutant proteins. Testing of partial gene and protein sequences may not fully reveal the influence of the variant on the activity of the intact protein, and findings obtained by their use were not always confirmed using independent types of assay (Goldgar, D. E., et al., *Am J Hum Genet*. 2004. 75, 535-44.). The use of full-length wild-type or mutant constructs has been mostly limited to transient expression since it has proven difficult and at times impossible to generate stably expressing lines. Expression of exogenous BRCA2 including the BRC repeats may result in BRCA2 deficiency, perhaps due to squelching (titrating-out) of free Rad51. Studies utilizing cells having endogenous wild-type BRCA2 alleles depend on the presumption that the co-dominant or dominant-negative effects of exogenous mutated constructs will govern the assay results. Thus, evaluating BRCA2 function utilizing exogenous expression constructs is of extreme technical difficulty.

Provided herein is a new approach to evaluate genomic variants by applying a simple and fast homologous recombination replacement technique to produce syngeneic clones. This syngeneic replacement strategy was approximately as rapid as the stable transfection of routine expression plasmids, a technique with which it shares many invariant steps. Such approach allows an unambiguous read-out by generating multiple clones of stable cell lines having the endogenous gene altered.

A panel of functional assays were applied to a syngeneic knock-out pair and selected two robust assays that in combination provided a clear and unambiguous read-out of BRCA2 function that was applied to a library of variants provided herein: Rad51 focus-formation and MMC sensitivity. By applying these two assays, the positive control was found to have a detrimental phenotype, the negative control to have a neutral phenotype (same as proficient cells), and the two variants of uncertain significance to have a neutral phenotype.

The high ratio, relating the number of clones having integrated a construct into the already targeted allele and the clones having integrated a construct in the wild type allele, observed for the BRCA2$^{\Delta ex11/\Delta ex11}$ cells (80:1) was not observed for any of the exon 27 variants. It is believed that the ratio is influenced by selection against emergence of clones with a detrimental phenotype (Gallmeier, E. et al., *Cancer Biol Ther* 2007. 6:654-60). In addition, the ratio may be potentially influenced by differences in the targeting construct as well as sequence variation or regional differences of chromatin at the targeted locus. This interesting aspect of the technique deserves further investigation.

SyVaLs can also be used to test the function of individual in-situ residues of a protein or regulatory code, unrestricted by the limited number of known natural variants. For such a purpose, the 3291 serine residue of BRCA2, recently evaluated for its phosphorylation, was selected. Cyclin-dependent phosphorylation of this site was shown to inhibit both interaction of BRCA2 with Rad51 and recombination repair. This site was discovered and initially evaluated using expression of partial protein sequences. By mimicking constitutive phosphorylation by substituting serine with glutamate, we observed a hypomorphic phenotype characterized by a decrease in induced Rad51 focus formation and a slight increase in sensitivity to MMC was observed. When serine was replaced with alanine to prevent phosphorylation, neither a decrease in Rad51 focus-formation, nor increased sensitivity to MMC, was observed.

The findings of inhibition of Rad51 focus-formation by the glutamate mutation, and no effect of the alanine mutation, do support the hypothesis of phosphorylation-dependent inhibition of Rad51 interaction. Yet, the use of variant endogenous BRCA2 genes provided a nuanced relation that was not previously determinable. This inhibition was found to be partial, not complete. In addition, where the prior authors saw a surprising inhibitory effect on Rad51 binding also of alanine 3291 when partial peptides were tested, studies herein suggest differently. Phosphorylation of S3291 was found to be dispensable for BRCA2-governed cellular phenotype as judged by the intact function of the alanine 3291 variant, as assayed by a set of robust tests employed herein. The syngeneic lines provided herein thus serve as a staring point in addressing the teleologic purpose, if any, of cell-cycle regulation of the Rad51-BRCA2 interaction.

As demonstrated herein, SyVaLs provide a technically facile, ethically acceptable, means to compare the effects of subtly altering human genomes. Such libraries and methods can be applied to other medically relevant genes, particularly disease associated loss-of-function genes, thus permitting high-throughput annotation of natural human genetic variation. SyVaLs also enable the interrogation of individual codons and regulatory codes in human chromosomes, while avoiding many common artifacts of introducing exogenous genes and gene fragments.

Using methods provided herein, genes associated with Fanconi anemia (FA) were also investigated to detect interaction between different FA genes. Fanconi anemia is a rare, recessively inherited disorder, consisting of congenital skeletal abnormalities, progressive bone marrow failure, and increased cancer risk (D'Andrea A D, and Grompe M. *Nat Rev Cancer* 2003. 3:23-34). The disease comprises at least 12 complementation groups (FANCA, FANCB, FANCC, BRCA2/FANCD2, FANCD2, FANCE, FANCF, FANCG, FANCI, FANCJ, FANCL, and FANCM). All of these genes have been identified except for FANCI (Levitus M, et al., *Blood* 2004; 103:2498-2503; Levitus M, et al.; *Nat Genet*. 2005; Meetei A R, et al., *Nat Genet;* 2005; Meetei A R, et al., *Nat Genet*. 2004. 36:1219-1224).

The FA genes appear to act in a common pathway, distal parts of which interact with regulators of cell cycle control and DNA repair, especially the repair of DNA interstrand crosslinks and double-strand breaks. There are at least three distinguishable compartments of the FA pathway. The upstream element consists of a protein core complex, assembled by FANCA, FANCB, FANCC, FANCE, FANCF, FANCG, FANCL, FANCM, and a yet unidentified 100 kDa protein FAAP100. This complex enables the monoubiquitination of the central protein FANCD2, which subsequently translocates to nuclear DNA repair foci and colocalizes with various DNA repair proteins including BRCA2 (Pichierri P, et al., *Embo J*. 2004. 23:3154-3163; Nakanishi K, et al., *Nat Cell Biol* 2002; 4:913-920; Pichierri P, et al., *Hum Mol Genet*. 2002. 11:2531-2546; Taniguchi T, et al., *Blood* 2002; 100:

2414-2420; Hussain S, et al., *Hum Mol Genet.* 2004. 13:1241-1248; Howlett N G, et al. *Hum Mol Genet.* 2005. 14:693-701; Montes de Oca R, et al., *Blood* 2005; 105:1003-1009; Wang X, et al. *Mol Cell Biol.* 2004. 24:5850-5862). Monoubiquitinated FANCD2 interacts directly with BRCA2 and promotes loading of BRCA2 into chromatin complexes (Wang X, et al., *Mol Cell Biol.* 2004. 24:5850-5862). Whereas defects in any of the proximal FA core proteins preclude FANCD2 monoubiquitination, BRCA2 is not required for this event, supporting that BRCA2 acts downstream of FANCD2. In addition to an intact FA core complex, the checkpoint kinase ATR is also required for FANCD2 monoubiquitination (Andreassen P R, et al. *Genes Dev.* 2004. 18:1958-1963).

Disruption of the proximal FA pathway occurs in different tumor types from non-FA patients, implicating these genes in tumor suppression or genome maintenance among the general population. A subset of pancreatic cancers harbor inactivating mutations of FANCC or FANCG (Couch F J, et al., *Cancer Res.* 2005. 65:383-386; van der Heijden M S, et al., *Am J Pathol.* 2004. 165:651-657; van der Heijden M S, et al., *Cancer Res.* 2003. 63:2585-2588) and FANCF promoter hypermethylation along with gene silencing has been reported in a variety of tumors (Marsit C J, et al., *Oncogene* 2004. 23:1000-1004; Narayan G, et al., *Cancer Res.* 2004. 64:2994-2997; Taniguchi T, et al., *Nat Med.* 2003. 9:568-574). All of these alterations abrogate FANCD2 monoubiquitination.

Disruption of the distal FA pathway also occurs in tumors via mutations in BRCA2. The complete inactivation of BRCA2 function, paradoxically, might predominantly be an adverse event for cancer cells (Van der Heijden M S, et al., *BMC Genet.* 2006; 7:3; Daniels M J, et al., *Science* 2004. 306:876-879). BRCA2 inactivation appears late during tumorigenesis and the mutations almost exclusively yield truncated BRCA2 proteins, which retain partial function (Goggins M, et al., *Am J Pathol.* 2000. 156:1767-1771). In addition, BRCA2 mutations are mainly of germline origin, even in apparently sporadic tumors (Goggins M, et al., *Cancer Res.* 1996. 56:5360-5364; Hahn S A, et al., *J Natl Cancer Inst.* 2003. 95:214-221; Murphy K M, et al. *Cancer Res.* 2002. 62:3789-3793; Ozcelik H, et al., *Nat Genet.* 1997. 16:17-18).

It is demonstrated herein that, similar to complete BRCA2 inactivation, the complete inactivation of FANCD2, but not the mere reduction of FANCD2 protein levels, was detrimental in an experimental human cancer model. It was further confirmed that human cancer cells that harbor the "Seckel" ATR mutation display defective FANCD2 monoubiquitination, FANCD2 nuclear focus formation and increased sensitivity to DNA interstrand-crosslinking agents. Nevertheless, these ATR Seckel cells were viable, suggesting that the detrimental phenotype in human cancer cells upon complete FANCD2 inactivation in our model is not readily attributable to the major known functions of FANCD2.

Using somatic cell gene targeting, both alleles of several FA genes were sequentially targeted at different levels of the FA pathway. In contrast to the complete disruption of FANCC and FANCG, it was not possible to disrupt both alleles of BRCA2 or FANCD2. The BRCA2 gene differs from other FA genes in that it serves essential functions, which might be either related to or independent from the FA pathway (Venkitaraman A R. *Nat Rev Cancer* 2004. 4:266-276). BRCA2 exhibits a high degree of conservation within the BRC-repeat regions (Sharan S K, and Bradley A. *Genomics* 1997. 40:234-241), whereas the proximal FA genes are not well conserved. Consistently, knockout mice having null mutations of BRCA2 are embryonic lethal. Only truncating mutations in BRCA2 that spare some of the BRC repeats can confer a viable phenotype (Bennett L M, et al. *Mol Carcinog.* 2000. 28:174-183; Connor F, et al., *Nat Genet.* 1997. 17:423-430; Friedman L S, et al., *Cancer Res.* 1998. 58:1338-1343; Ludwig T, et al., *Genes Dev.* 1997. 11:1226-1241; McAllister K A, et al., *Cancer Res.* 2002. 62:990-994; Sharan S K, et al., *Nature* 1997. 386:804-810; Suzuki A, et al., *Genes Dev.* 1997. 11:1242-1252). FANCA, FANCC, and FANCG knockout mice display normal viability and do not display gross growth abnormalities (Chen M, et al., *Nat Genet.* 1996. 12:448-451; Cheng N C, et al., *Hum Mol Genet.* 2000. 9:1805-1811; Koomen M, et al., *Hum Mol Genet.* 2002. 11:273-281; Whitney M A, et al., *Blood* 1996. 88:49-58; Wong J C, et al., *Hum Mol Genet.* 2003. 12:2063-2076; Yang Y, et al., *Blood* 2001. 98:3435-3440). Similarly, the complete disruption of BRCA2 is a lethal event in chicken DT40 cells (Warren M, et al., *Hum Mol Genet.* 2003; 12:2645-2656), whereas the introduction of truncating BRCA2 mutations that spared two BRC repeats, only decreased the growth rate in these cells (Hatanaka A, et al., *Mol Cell Biol.* 2005. 25:1124-1134). Disruption of FANCC (Hirano S, et al., *Embo J.* 2005. 24:418-427; Niedzwiedz W, et al., *Mol Cell* 2004. 15:607-620) or FANCG (Yamamoto K, et al., *Mol Cell Biol.* 2003. 23:5421-5430) did not impair cell viability in DT40 cells. Therefore, the results provided herein are consistent with the hypothesis that the complete inactivation of BRCA2 function might predominantly be an adverse event for cancer cells.

In contrast, the data provided herein suggest that FANCD2 inactivation was selected against in cancer cells were rather unexpected and two different cancer cell lines were employed to rule out cell line-specific artifacts. No significant differences were found between FANCD2 protein-depleted and control cells in regard to cell death, proliferation, or cell cycle profile, and additionally, observed no functional haploinsufficiency in FANCD2$^{+/-}$ clones, the remaining FANCD2 protein was likely sufficient to prevent any detrimental phenotype dependent upon a complete FANCD2 loss. A similar phenomenon can be observed in cancer cells having impairment of the FA pathway-related gene ATR, which is required for the major known functions of FANCD2 (Andreassen P R, et al., *Genes Dev.* 2004; 18:1958-1963) complete ATR gene disruption is a lethal event (Cortez D, et al., *Science* 2001. 294:1713-1716), whereas subtotal ATR protein depletion has no gross effects on cellular viability (Hurley et al., *Oncogene* 2007. 26:2535-42. Epub 2006 Oct. 16). Using ATR$^{s/s}$ cancer cells, it was demonstrated herein that the DNA damage-induced FANCD2 monoubiquitination and nuclear focus formation, representing the best-characterized functions of FANCD2 (Gregory R C, et al., *Semin Cancer Biol.* 2003. 13:77-82), are both ATR-dependent (Andreassen P R, et al. *Genes Dev.* 2004. 18:1958-1963). Maybe surprisingly, by using p53-mutant cells, it was demonstrated herein that these ATR/FA pathway interactions are p53-independent. ATR$^{s/s}$ cancer cells displayed a quantitatively comparable MMC hypersensitivity as did FANCC$^{-/-/-}$ and FANCG$^{-/-}$ cancer cells (Gallmeier E, et al., *Gastroenterology* 2006; 130:2145-2154), indicating a similar role for ATR, FANCC and FANCG in FA pathway-mediated DNA repair, and further supporting that ATR acts upstream of FANCD2. However, as disruption of FANCC or FANCG also impairs FANCD2 focus formation and completely abrogates FANCD2 monoubiquitination, the loss of ATR-dependent FANCD2 functions alone cannot account for the observed selection against FANCD2 inactivation in our model. These studies demonstrate the utility of the methods of the invention to classify the interaction of multiple potential loss-of-function mutations in a single cell.

The proposition put forth herein that FANCD2 inactivation is predominantly selected against in cancer cells is supported by considerable evidence that the FANCD2 gene, like the BRCA2 gene, might be essential; FANCD2 is highly conserved (Timmers C, et al., *Mol Cell* 2001. 7:241-248), and some FANCD2 knockout mice, depending on the background strain, exhibit perinatal lethality, suggesting the presence of a modifier locus (Houghtaling S, et al., *Genes Dev.* 2003. 17:2021-2035). Furthermore, developing tissues spontaneously undergo apoptosis in the absence of FANCD2, as shown in a zebrafish model (Liu T X, *Dev Cell* 2003. 5:903-914). The hypothesis is also not inconsistent with the existence of patients harboring biallelic FANCD2 mutations, as all of these patients reported to date have at least one mutant allele that could have some residual function (Houghtaling S, et al., *Genes Dev* 2003, 17:2021-2035). Consistently, lymphocytes from some FA patients of the complementation group FANCD2 contain FANCD2 protein. Another explanation would suggest that normal cells might be able to sustain inactivation of FANCD2, in contrast to certain cancer cells, which could be ascribed to defective checkpoints in cancer cells, a deleterious increase in mutation rate, or additional defects in DNA repair genes apart from FANCD2.

On the other hand, FANCD2 gene defects are obviously not always detrimental to cancer cells, as FA patients of the complementation group FANCD2 and FANCD2 knockout mice do indeed get cancers. This could be explained by the mutational profile of a cancer representing the balance of selective pressures for and against any given mutation, with the likely possibility that both directions of selection operate on even single genes. Consequently, cancer cells having naturally selected for a FANCD2 defect may differ significantly from cells on which this gene defect was experimentally superimposed, due to the mutually dependent effects of reduction of fitness and compensatory evolution that might occur upon or even prior to FANCD2 disruption. Cells having naturally selected for a FANCD2 defect already would have evolved, as a precondition, a compensatory genotype. In contrast, when this gene defect was superimposed in an experimental setting, cells would have little opportunity for compensation.

In summary, study herein illustrates the distinct impact of experimental gene disruption of FA genes at different stages of the FA pathway on human cancer cells providing a synthetic lethal type screen. The distal FA genes BRCA2 and FANCD2, in contrast to the proximal FA genes, appear to represent particularly vulnerable parts of this pathway. The extent of reduction of fitness induced by their inactivation may, under most circumstances, override the potentially gained advantage of FA pathway inactivation in tumors. This could explain why certain FA gene defects, despite an apparent selection for FA pathway inactivation in cancer, are rarely observed in tumors among the general population.

It is demonstrated herein that in human cancer cells the experimental gene disruption of the FA genes FANCC and FANCG, which act upstream in the FA pathway, are well tolerated, whereas the disruption of FANCD2 and BRCA2, which act downstream, is detrimental. It is further demonstrated that, similar to BRCA2 inactivation, selection against FANCD2 inactivation is dependent on a complete FANCD2 loss. Finally, the detrimental phenotype of cancer cells having FANCD2 inactivation is not attributable to the major known, ATR-dependent functions of FANCD2. This study establishes that the downstream FA genes FANCD2 and BRCA2 represent particularly vulnerable parts of the FA pathway in cancer cells and provides direct evidence for the paradoxical assumption that their inactivation, despite an apparent selection for FA pathway inactivation in many tumors, could be predominantly selected against in cancer cells.

The libraries and methods provided herein allow for the analysis of the function of various tumor-suppressor genes, allowing for the selection and/or identification of appropriate chemotherapeutic agents for the prevention or treatment of cancer. For example, if a tumor-suppressor gene with an unknown function results in a synthetic lethal phenotype when combined with a tumor-suppressor gene of a known function, e.g., DNA repair, cell cycle regulation, transcriptional regulation, cellular transport, it is likely that the tumor-suppressor gene of unknown function has a role in the same pathway as the tumor-suppressor gene of known function.

Identification of a role for a tumor-suppressor gene can facilitate the rational selection of chemotherapeutic or chemopreventive agents for the treatment or prevention of cancer. As demonstrated herein, cells including a BRCA2 mutation are more susceptible to double-strand breaks, suggesting the use of specific types of agents. The syngeneic variance libraries of cells of the invention can be tested for their sensitivity to various agents. The cells of the variance libraries can be transformed with various mutations observed in a population, or in a specific patient, to determine what agents may be most effective at treating or preventing disease.

Test Compounds and Extracts

In general, agents with desired biological or pharmacological properties are identified from large libraries of natural product or synthetic (or semi-synthetic) extracts or chemical libraries or from polypeptide or nucleic acid libraries, according to methods known in the art. Those skilled in the field of drug discovery and development will understand that the precise source of test extracts or compounds is not critical to the screening procedure(s) of the invention. Agents used in screens may include those known as therapeutics or approved for use in humans. Alternatively, virtually any number of unknown chemical extracts or compounds can be screened using the methods described herein. Examples of such extracts or compounds include, but are not limited to, plant-, fungal-, prokaryotic- or animal-based extracts, fermentation broths, and synthetic compounds, as well as the modification of existing polypeptides.

Libraries of natural polypeptides in the form of bacterial, fungal, plant, and animal extracts are commercially available from a number of sources, including Biotics (Sussex, UK), Xenova (Slough, UK), Harbor Branch Oceangraphics Institute (Ft. Pierce, Fla.), and PharmaMar, U.S.A. (Cambridge, Mass.). Such polypeptides can be modified to include a protein transduction domain using methods known in the art and described herein. In addition, natural and synthetically produced libraries are produced, if desired, according to methods known in the art, e.g., by standard extraction and fractionation methods. Examples of methods for the synthesis of molecular libraries can be found in the art, for example in: DeWitt et al., *Proc. Natl. Acad. Sci. U.S.A.* 90:6909, 1993; Erb et al., *Proc. Natl. Acad. Sci. USA* 91:11422, 1994; Zuckermann et al., *J. Med. Chem.* 37:2678, 1994; Cho et al., *Science* 261:1303, 1993; Carrell et al., *Angew. Chem. Int. Ed. Engl.* 33:2059, 1994; Carell et al., *Angew. Chem. Int. Ed. Engl.* 33:2061, 1994; and Gallop et al., *J. Med. Chem.* 37:1233, 1994. Furthermore, if desired, any library or compound is readily modified using standard chemical, physical, or biochemical methods.

Numerous methods are also available for generating random or directed synthesis (e.g., semi-synthesis or total synthesis) of any number of polypeptides, chemical compounds, including, but not limited to, saccharide-, lipid-, peptide-, and nucleic acid-based compounds. Synthetic compound libraries are commercially available from Brandon Associates (Merrimack, N.H.) and Aldrich Chemical (Milwaukee, Wis.). Alternatively, chemical compounds to be used as candidate compounds can be synthesized from readily available starting materials using standard synthetic techniques and methodologies known to those of ordinary skill in the art. Synthetic chemistry transformations and protecting group methodologies (protection and deprotection) useful in synthesizing the compounds identified by the methods described herein are known in the art and include, for example, those such as described in R. Larock, Comprehensive Organic Transformations, VCH Publishers (1989); T. W. Greene and P. G. M. Wuts, Protective Groups in Organic Synthesis, 2nd ed., John Wiley and Sons (1991); L. Fieser and M. Fieser, Fieser and Fieser's Reagents for Organic Synthesis, John Wiley and Sons (1994); and L. Paquette, ed., Encyclopedia of Reagents for Organic Synthesis, John Wiley and Sons (1995), and subsequent editions thereof.

Libraries can include collections of known chemical agents, for example, agents approved for administration to humans.

Libraries of compounds may be presented in solution (e.g., Houghten, *Biotechniques* 13:412-421, 1992), or on beads (Lam, *Nature* 354:82-84, 1991), chips (Fodor, *Nature* 364:555-556, 1993), bacteria (Ladner, U.S. Pat. No. 5,223,409), spores (Ladner U.S. Pat. No. 5,223,409), plasmids (Cull et al., *Proc Natl Acad Sci USA* 89:1865-1869, 1992) or on phage (Scott and Smith, *Science* 249:386-390, 1990; Devlin, *Science* 249:404-406, 1990; Cwirla et al. *Proc. Natl. Acad. Sci.* 87:6378-6382, 1990; Felici, *J. Mol. Biol.* 222:301-310, 1991; Ladner supra.).

In addition, those skilled in the art of drug discovery and development readily understand that methods for dereplication (e.g., taxonomic dereplication, biological dereplication, and chemical dereplication, or any combination thereof) or the elimination of replicates or repeats of materials already known for their activity should be employed whenever possible.

When a crude extract is found to have the desired activity, further fractionation of the positive lead extract is necessary to isolate molecular constituents responsible for the observed effect. Thus, the goal of the extraction, fractionation, and purification process is the careful characterization and identification of a chemical entity within the crude extract that is useful as a therapeutic. Methods of fractionation and purification of such heterogenous extracts are known in the art. If desired, compounds shown to be useful as therapeutics are chemically modified according to methods known in the art.

Kits

The invention provides kits for the practice of the methods of the invention. Kits can include one or more cell lines of the invention, e.g., a library of syngeneic variant cells, and instructions for use in appropriate packaging. The library can further be packaged with both positive and negative control fragments for use with the cell lines.

The practice of the present invention employs, unless otherwise indicated, conventional techniques of molecular biology (including recombinant techniques), microbiology, cell biology, biochemistry and immunology, which are well within the purview of the skilled artisan. Such techniques are explained fully in the literature, such as, "Molecular Cloning: A Laboratory Manual", second edition (Sambrook, 1989); "Oligonucleotide Synthesis" (Gait, 1984); "Animal Cell Culture" (Freshney, 1987); "Methods in Enzymology" "Handbook of Experimental Immunology" (Weir, 1996); "Gene Transfer Vectors for Mammalian Cells" (Miller and Calos, 1987); "Current Protocols in Molecular Biology" (Ausubel, 1987); "PCR: The Polymerase Chain Reaction", (Mullis, 1994); "Current Protocols in Immunology" (Coligan, 1991); Antibody Phage Display, (O'Brien and Aitken, 2002). These techniques are applicable to the production of the polynucleotides and polypeptides of the invention, and, as such, may be considered in making and practicing the invention. Particularly useful techniques for particular embodiments will be discussed in the sections that follow.

The following examples are put forth so as to provide those of ordinary skill in the art with a complete disclosure and description of how to make and use the assay, screening, and therapeutic methods of the invention, and are not intended to limit the scope of what the inventors regard as their invention.

This invention is further illustrated by the following examples, which should not be construed as limiting.

Examples

Example 1

Materials and Methods

Cell Lines and Cell Culture

DLD1 cells were obtained from ATCC, cultured in conventional media supplemented with 10% fetal calf serum, L-glutamine and penicillin/streptomycin.

Targeted Disruption by Homologous Recombination

Exon 11 of BRCA2 was disrupted by homologous recombination using the technique of Kohli et al. (*Nucleic Acids Res.* 2004. 32, e3, incorporated herein by reference). The targeting construct was designed to excise a part of exon 11, containing a known mutation and including BRC repeat 6, thus causing a premature stop codon after BRC repeat 5. Hygromycin-resistant clones having homologous integration of targeting construct were identified by PCR, using a primer inside the resistance gene and a primer outside of the homology arms (SEQ ID NOs 36039) using known methods. The selection cassette was removed by transiently expressing exogenous Cre recombinase. A recombinant hemizygous clone, indentified by PCR using primers flanking the deletion, was used for second allele targeting. Reusing the same exon 11 targeting construct, clones acquiring biallelic disruption of BRCA2 were identified by PCR screening using a combination of primers described above.

Alternately, exon 27 was targeted in the hemizygous cells using a construct whose right homology arm included intact exon 27 and individual sequence variants. Homologous integration of the construct, the presence of desired sequence variants and allelic phase of the construct were determined by allele-specific PCR and sequencing. An analogous vector design was used by Hurley et al. to introduce an ATR mutation into alleles of a human cell (Hurley, P. J. et al., *Oncogene.* 2007. 26, 2535-42, incorporated herein by reference).

DNA, RNA Isolation, PCR, Sequencing

Genomic DNA was isolated from cells using Lyse-N-Go® (Pierce). RNA was isolated using RNeasy® Mini Kit (Qiagen, Valencia, Calif.). Automated sequencing was performed by a core facility. PCR conditions and primer sequences are available upon request.

Allele-Specific PCR

The presence of the targeting construct and its subsequent cre-mediated removal enabled selective amplification from one of two alleles using primers specific for either the construct or the deleted sequence.

Digital PCR

Digital PCR was performed essentially as described previously (Vogelstein, B. & Kinzler, K. W. *Proc Natl Acad Sci*

USA 1999. 96, 9236-41, incorporated herein by reference). In a duplex reaction, primers specific for deletion-specific sequences at exon 11 and spanning intron 25 were combined.

Site-Directed Mutagenesis

Mutated targeting constructs were generated using the QuickChange Site-Directed Mutagenesis Kit (Stratagene, LaJolla, Calif.).

Northern Blotting

For northern blotting, random primer-labeled cDNA was used to detect BRCA2 exon 11 mRNA, and end-labeled oligomers were used to detect 18S rRNA (Lal, A., et al. *Embo J.* 2004. 23, 3092-102.).

Cell-Cycle Analysis

Cells were treated with MMC for 48 hours, processed as described previously (Vindelov, L. L., et al., *Cytometry* 1983. 3: 323-7, incorporated herein by reference) and analyzed by flow cytometry.

Chromosome Aberration Assay

Cells were treated with equitoxic doses of MMC (80 nM for BRCA2$^{wt/\Delta ex11}$ and 6 nM for BRCA2$^{\Delta ex11/\Delta ex11}$) for 24 h. For each sample, 50 metaphases were analyzed using standard techniques by a core facility.

Cell Proliferation Assay

In each well of 96-well plates, 1000 cells were plated, allowed to adhere and treated with various drugs. The drugs were obtained from Sigma (St. Louis, Mo.) except for SJG-136 which was generously provided by Ipsen Ltd. and the National Cancer Institute, NIH. The cells were washed after 6 days and lysed in 100 uL of water. Fluorescence was measured after addition of 0.5% Picogreen® (Molecular Probes, Eugene, Oreg.) using a fluorometer (Fusion®, Perkin Elmer, Shelton, Conn.). Three independent experiments were performed per drug.

Colony-Formation Assay

Cells were plated in 6-well plates, allowed to adhere and exposed to $^{137}$Cs gamma rays. After 14 days, cells were washed and stained with crystal violet and colonies were counted. For each dose, cells were plated at 3 different concentrations in duplicate. Three independent experiments were performed.

Immunofluorescence

Cells were treated with MMC (2.4 µg/ml) or gamma irradiation and fixed in PBS/2% paraformaldehyde after 24 h incubation. Following permeabilization in PBS/0.5% Triton X-100 and blocking for 30 min in PBS/1% bovine serum albumin/0.15% glycine, the cells were incubated with an anti-Rad51 antibody (1:200, Calbiochem, San Diego, Calif.) for 2 h. Cells were then washed and incubated with a rabbit IgG secondary antibody (1:200, Alexa® 488, Molecular Probes, Eugene, Oreg.) for 1 h. After washing, slides were mounted and analyzed by a fluorescent microscope (Zeiss Axiover 135, Maple Grove, Minn.) and Metamorph 4.6 software (Universtal Imaging, Downington, Pa.). Pictures were acquired, keeping exposure time and software settings constant for all samples.

Baseline or induced Rad51 focus formation was considered "negative" when less than 5% or 20%, respectively, of cells had more than 5 nuclear foci and "positive" when more than 5% or 30%, respectively, of cells had more than 5 nuclear foci. Intermediate phenotypes were not observed.

Somatic Cell Gene Targeting

Figure 3:
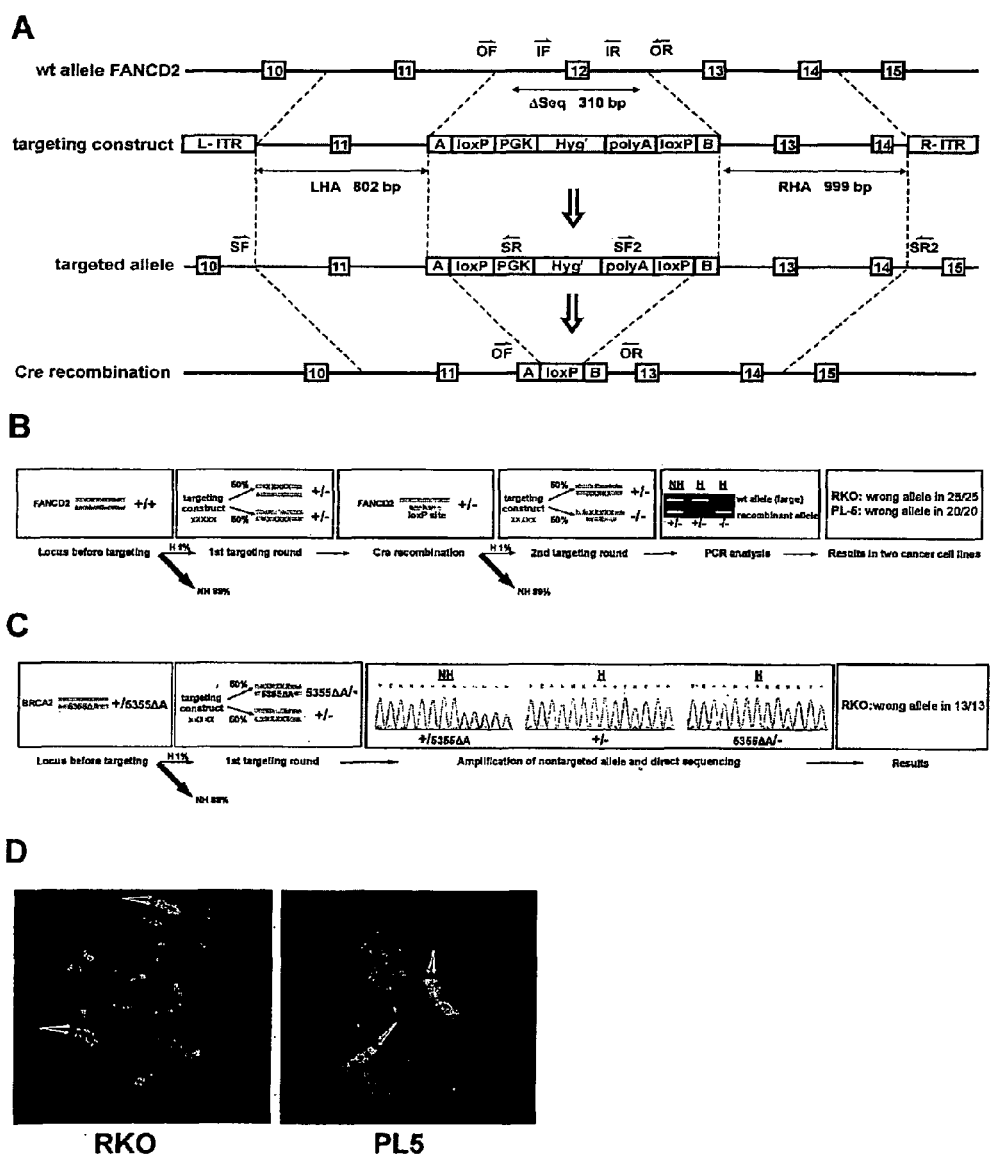
FIG. 3. Gene targeting of FANCD2 and BRCA2 and confirmation of diploidy. (A) Schematic targeting procedure. OF+OR primer set outside and IF-FIR primer set inside the deleted sequence; SF+SR and SF2+SR2 screening primer sets; LHA+RHA left and right homology arms. (B) Schematic representation of targeted allele determination for FANCD2. The integration of the targeting construct (xxxxx) at the FANCD2 locus would result in a very large PCR product when using the primers OF+OR, which would not be amplified unless the construct is removed using Cre recombination (x). Note that most of the resultant clones of a given targeting round represent non-homologous integration (NH) of the targeting construct (~99%). Homologous integration (H) of the construct is presumed to randomly target either FANCD2 allele with a 50% probability. (C) Schematic representation of targeted allele determination for BRCA2. Following one round of gene targeting, direct sequencing of the region surrounding the 5535AA mutation was performed to identify whether the wild-type or the mutant allele was targeted and to distinguish clones having nonhomologous integration from clones having homologous integration of the construct. (D) Whole-chromosome painting of chromosome 3 (red) and FISH analysis, using a FANCD2-specific probe (yellow), confirmed diploidy at the FANCD2 locus in RKO and PL5. Arrows indicate FANCD2-specific probes. Note that the unbalanced translocation of chromosome 3 material to another chromosome in RKO cells does not show a signal from the FANCD2-specific probe.

The endogenous FANCC, FANCG, FANCD2, and BRCA2 genes were disrupted in somatic cells according to a recently developed technique (Kohli M, 2004; Gallmeier E, 2006). The targeting constructs of FANCC, FANCG, and FANCD2 were designed to replace one exon, in each case causing a premature stop codon (Table 2). The targeting constructs were ligated into pAAV-MCS (Stratagene, La Jolla, Calif.) and co-transfected with pAAV-RC and pHelper into colorectal adenocarcinoma RKO and pancreatic adenocarcinoma PL5 cells. Hygromycin-resistant clones were selected and clones having homologous integration of the targeting construct identified by PCR, using one primer inside the resistance gene and one outside of the left or right homology arm, respectively (SF/SR and SF2/SR2). The selection cassette was subsequently removed using Cre recombinase. Recombinant clones, identified by PCR using primer sets inside (IF-HR) and outside (OF-FOR) of the selection cassette, were used to sequentially target the second allele (FIG. 3A). Finally, PCR using primers flanking the targeting construct identified which of the alleles had been targeted in the second targeting round. The absence of a product from the wild-type allele would confirm homozygously targeted clones (FIG. 3B).

BRCA2 gene disruption was performed similarly, but with the following modifications. RKO cells contain a heterozygous frameshift mutation in exon 11 of the BRCA2 gene (BRCA2$^{wt/5355\Delta A}$), allowing the disruption of BRCA2 function through only one round of gene targeting. The targeting construct was designed to replace the distal part of exon 11, causing a premature stop codon after BRC repeat 5, predicted to severely impair BRCA2 function. Clones having homologous integration events were identified by PCR. Subsequently, the nontargeted allele was specifically amplified and sequenced. The presence of the 5355AA mutation in a homozygous state would identify clones harboring a functional disruption of the BRCA2 gene (BRCA2$^{5355A\Delta/-}$) (FIG. 3C).

siRNA-Mediated Knockdown of FANCD2

Cells at about 70% confluency were transfected with three different FANCD2 short interfering RNAs (siRNA) (Ambion, Austin, Tex.) or scrambled siRNA, at final siRNA concentrations of 25 nM, using Oligofectamine® (Invitrogen, Carlsbad, Calif.). Transfection proceeded for four hours before adding serum-containing medium. FANCD2 protein depletion was quantified by immunoblotting 48 h after transfection.

Immunoblotting

Protein lysates from 200,000 cells were separated on 3-8% tris-acetate gels for 165 min at 150V, and transferred to PVDF membranes. After blocking, the membranes were incubated overnight with monoclonal mouse anti-human FANCD2 or polyclonal goat anti-human ATR antibodies (both 1:1000, both Santa Cruz, Santa Cruz, Calif.). Membranes were then washed and probed with the corresponding secondary antibody (1:10,000, Pierce, Rockford, Ill.). Detection was performed using the SuperSignal West Pico Substrate (Pierce). Equal protein loading was verified by membrane staining of total protein with Fast Green® (USB, Cleveland, Ohio).

Immunofluorescence

Cells at about 70% confluency were treated with mitomycin C (MMC) at 100 nM for 24 h, fixed in PBS/4% paraformaldehyde, washed, and fixed in −20° C. methanol. Following permeabilization in TBS/0.5% Triton X-100 and blocking for 30 min in TBS/2% bovine serum albumin/0.5% Triton X-100, the cells were incubated with a monoclonal mouse anti-human FANCD2 antibody (1:200, Santa Cruz) for 2.5 h. Cells were then washed and incubated with a goat anti-mouse IgG secondary antibody (Alexa® 488, Molecular Probes, Eugene, Oreg.) for 1.5 h. After washing, slides were mounted and analyzed. Pictures were acquired keeping exposure time and software settings constant for all samples.

Cell Proliferation Assays

For siRNA experiments, the cells were plated in 6-well plates at 500,000 cells/well at 24 h after siRNA transfection. Separate aliquots of each sample were counted at six different time points one to four days after transfection, using two separate aliquots for each time point. Dead cells were separately determined by trypan-blue exclusion and were negligible in number in all samples (<2%). For comparisons between parental cells and FANCD2$^{+/-}$ clones, 500,000 cells/well were plated and counted at six time points between 0 and 48 h. Two independent experiments were performed. For MMC sensitivity studies, Picogreen® (Invitrogen) proliferation assays were performed in quadruplicate as described in Gallmeier et al., 2006.

Cell Cycle Analysis

Cells were detached, washed, and fixed in PBS/3.7% formaldehyde/0.5% Nonidet P40 (USB). Nuclei were stained with bisbenzimide (Hoechst 33258, Sigma, St. Louis, Mo.) and analyzed by flow cytometry. 10,000 events were acquired per sample. The data were processed using Cell Quest® software (Becton Dickinson).

Allele-Specific PCR and Direct Sequencing

Genomic DNA was prepared from cells using either the DNA Blood Mini kit (Qiagen, Valencia, Calif.) or Lyse-N-Go® (Pierce). PCR was performed using 38 cycles with differing annealing times for each primer set. The products were resolved on 0.7% agarose gels using tris-free electrophoresis (Faster Better Media LLC, Hunt Valley, Md.). The introduction of the targeting construct in one allele allowed the specific amplification of the non-targeted allele using primers outside the homology arms on either side, which, due to fragment size, did not yield a product from the targeted allele. Automated sequencing was performed by the Biosynthesis and Sequencing Core Facility at Johns Hopkins using routine methods.

Whole-Chromosome Painting and Fluorescence In-Situ Hybridization (FISH)

Whole-chromosome 3 painting and FISH analysis, using the BAC clone RP11-1016H17 (CHORI, Oakland, Calif.), were performed by the Cytogenetics Core Facility at Johns Hopkins using routine methods.

Example 2

Targeted Disruption of BRCA2

Initial attempts to disrupt the remaining wild-type allele in a BRCA2 heterozygous, p53-wild-type cell line RKO (BRCA2$^{wt/5355delA}$), but viable BRCA2-null clones could not be obtained.

Subsequent attempts used the diploid p53-deficient cancer cell line, DLD1. DLD1 cells originally harbored two nonsense mutations of BRCA2. Both mutations are present on one allele. In the first round of BRCA2 targeting, exon 11 of this allele was deleted, ensuring a permanent null state without a possibility of the mutations' reversion. The other allele in the hemizygous clone remained wild-type.

In the second round of BRCA2 targeting, 81 viable clones having homologous integration of the targeting construct were obtained in several independent targeting attempts, of which only 1 clone had integrated the construct in the wild-type allele, producing a homozygous BRCA2$^{\Delta ex11/\Delta ex11}$ knockout. The other 80 clones had re-integrated the construct into the already-knockout out allele.

PCR and northern blot analyses confirmed the heterozygous and homozygous gene disruption. Northern blot revealed the expression of exon 11 transcript in the parental and heterozygous populations. There was no detectable transcript in the homozygous cells.

Example 3

Functional Analysis of BRCA2$^{\Delta ex11/\Delta ex11}$ Cells

Both engineered and natural cells harboring truncated BRCA2 exhibit a proliferative impediment that may worsen with successive passages. The proliferation rate and doubling time in the BRCA2$^{\Delta ex11/\Delta ex11}$ cells generated herein was found to be slower than syngeneic controls, as determined by direct cell counting and by assaying DNA content of the culture. The proliferation rates of the cells corresponded to the following doubling times: BRCA2$^{wt/wt}$ 0.92±0.14, BRCA2$^{wt/\Delta ex11}$ 1.00±0.3, BRCA2$^{\Delta ex11/\Delta ex11}$ 1.47±0.13 days (SEM). This slight proliferation defect appeared stable with successive passage in culture.

Example 4

Rad51 Focus-Formation

Figure 2:
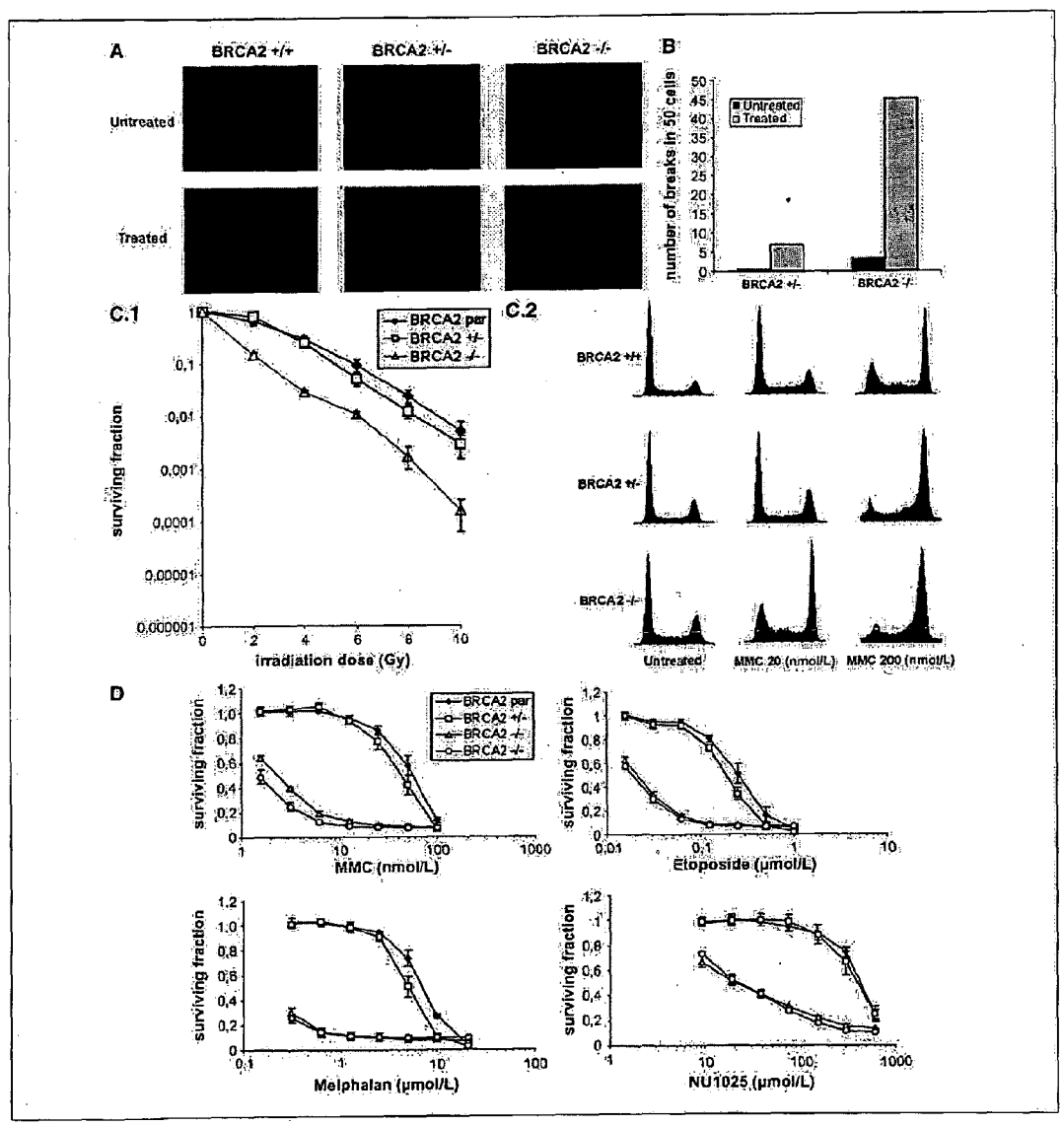
FIG. 2. Characterization of BRCA2-null cells. (A) Immunofluorescence of Rad51 nuclear foci in untreated and treated cells (2.4 mg/ml MMC). $BRCA2^{+/-}$, $BRCA2^{wt/\Delta ex11}$; $BRCA2^{-/-}$, $BRCA2^{\Delta ex11/\Delta ex11}$. (B) Analysis of 50 metaphase chromosomeal aberrations in untreated and treated equitoxic doses of MMC heterozygous and knockout clones. (C.1) Colony formation assays upon irradiation. BRCA2 par, parental $BRCA2^{wt/mut \times 2}$. Points, mean of three independent experiments; Bars SE. (C.2) Cell cycle analysis 48 h after MMC treatment. Representative cell cycle profiles obtained after treatment with indicated concentrations of MMC. Error bars represent SEM of 3 independent experiments. (D) Cell proliferation following treatment with selected drugs. Two $BRCA2^{-/-}$ ($BRCA2^{\Delta ex11/\Delta ex11}$) subclones were analyzed. Error bars represent SEM of 3 independent experiments.

To investigate whether the BRCA2$^{\Delta ex11/\Delta ex11}$ cells were defective in homologous recombination, their ability to form Rad51 foci upon DNA-damage induction was examined. Treatment with MMC induced Rad51 foci (more than 5 foci) in about 60-80% of BRCA2 proficient cells, and with irradiation, in about 50-60% of cells. BRCA2$^{\Delta ex11/\Delta ex11}$ cells had reduced levels of foci in untreated cells, and no induction of foci was observed upon DNA damage (FIG. 2A).

Example 5

Chromosomal Instability

BRCA2-deficient cells display increased chromosomal instability, which was further enhanced after treatment with MMC. Treatment-induced breakage serves as a diagnostic test for the FA syndrome, including the FA-D1/BRCA2 group. BRCA2$^{\Delta ex11/\Delta ex11}$ displayed much higher rates of chromosomal aberrations than BRCA2$^{wt/\Delta ex11}$ cells, including breaks and radials, upon MMC treatment at equitoxic doses (FIG. 2B).

Cell survival after irradiation. There has been conflicting data regarding the sensitivity of BRCA2-deficient cells to irradiation. Therefore, the impact of BRCA2 disruption on survival was assessed after treatment with X-rays. A decrease by half in relative survival of BRCA2$^{\Delta ex11/\Delta ex11}$ cells compared to their controls was observed (FIG. 2B).

Example 6

Cell Proliferation Upon Drug Treatment

The role of BRCA2 in DNA repair and replication fork maintenance is indicated by the hypersensitivity of BRCA2-defective cells to DNA-damaging agents. Survival following exposure to several clinically relevant drugs in parental cells, heterozygous and homozygously deleted cells was assayed.

BRCA2-deficient cells exhibited greatly increased sensitivity to various interstrand-crosslinking (ICL) agents, including MMC, melphalan, cisplatin, carboplatin, SJG and oxaliplatin (FIG. 2D).

Topoisomerase inhibitors affect enzymes incising either one (topoisomerase I inhibitors) or two (topoisomerase II inhibitors) strands of DNA in the process of DNA replication. The BRCA2-deficient cells described herein displayed increased sensitivity to topoisomerase II inhibitors etoposide (10-fold) and doxorubicin (10-fold), and to a smaller extent topoisomerase I inhibitor camptothecin (6-fold) (FIG. 2D). Etoposide hypersensitivity was additive to, but not synergistic with, other anticancer agents.

Hypersensitivity of BRCA2-deficient cells to PARP inhibitors has been reported. The cells described herein having an acute disruption of BRCA2 were more sensitive (20-fold) to NU1025 than control cells (FIG. 2D).

No differences in sensitivities to gemcitabine and vinblastine as well as to agents that have various DNA damaging potential, such as norethindrone, apigenin, curcumin and hesperidin were observed.

(10067C→A, P3280H; 10103C→T, P3292L) listed in the BRCA2 mutation database (http://research.nhgri.nih.gov/bic/) as variants of uncertain significance were examined (Table 1).

TABLE 1

Characterization and proposed classification of BRCA2 SyVaL clones.

| Clone | Rad51 | MMC | Etoposide | Chromosome Instability | Classification |
|---|---|---|---|---|---|
| BRCA2$^{wt/\Delta ex11}$ | Pos | NoΔ | NoΔ | Neg | Neutral |
| BRCA2$^{\Delta ex11/\Delta ex11}$ | Neg | 20-foldΔ | 10-foldΔ | Pos | Deleterious* |
| BRCA2$^{\Delta ex11/Y3308X}$ | Neg | 20-foldΔ | 10-foldΔ | — | Deleterious |
| BRCA2$^{\Delta ex11/Y3308Y}$ | Pos | NoΔ | NoΔ | — | Neutral |
| BRCA2$^{\Delta ex11/P3292L}$ | Pos | NoΔ | NoΔ | — | Neutral |
| BRCA2$^{\Delta ex11/P3280H}$ | Pos | NoΔ | NoΔ | — | Neutral |
| BRCA2$^{\Delta ex11/S3291E}$ | Neg | 3-foldΔ | 3-foldΔ | — | Hypomorphic |
| BRCA2$^{\Delta ex11/S3291A}$ | Pos | NoΔ | NoΔ | — | Neutral |

Pos, positive.
Neg, negative.
Δ, change.
FoldΔ refers to the ratio of the IC50 of cells having the hemizygous wild-type allele to the IC50 of cells having the mutated allele.
—, not done.
*The extreme rarity of knock-out clones may indicate an especially severe deleterious effect.

The increased genotype-dependent toxicity to MMC was confirmed by flow cytometry, indicating a profound G2/M arrest of the cell cycle.

Example 7

Distinguishing Homologous Recombination Events Affecting the Active or Inactive Allele ("Phase" Determination)

The hemizygous BRCA2$^{wt/\Delta ex11}$ cells, having one active and one inactive allele, were used for subsequent experiments. In preparation to target exon 27, residing at a large genomic distance from exon 11, a method was devised to readily distinguish long-distance cis relations of each allele. First automated sequencing of the heterozygous cell line was performed to identify natural, pre-existing heterozygous nucleotide polymorphisms within intron 25. Next analysis was performed to distinguish whether the intronic polymorphisms were on the active or inactive allele (termed the "phase") by determining whether they were in cis or in trans to the deleted exon, using limiting dilution of the template DNA and digital duplex PCR (Couch F J, et al., Cancer Res. 2005. 65:383-386, incorporated herein by reference). Primers were specific for the exon 11 deletion sequence or flanked the identified polymorphisms. Sequencing was performed to identify the allele amplified in each well.

Example 8

Introducing Sequence Variants into Exon 27

The heterozygous clone used for exon 27 targeting was verified to have intact BRCA2 function by demonstrating an absence of mitomycin hypersensitivity and the formation of Rad51 foci upon DNA damage (FIG. 2A, D). A series of mutations was introduced by site mutagenesis into a targeting construct whose original right homology arm included wild-type exon 27 (Table 1). As a positive control, a known deleterious nonsense mutation, (10152C→G, Y3308X) was used. As a negative control, a synonymous mutation was introduced in the same codon (10152C→T, Y3308Y). Two naturally occurring missense human sequence variants Example 9

Analysis of Importance of Phosphorylation of BRCA2 at S3291

The significance of the recently reported phosphorylation site in exon 27, S3291 was investigated by introducing a glutamate (mimicking constitutive phosphorylation of the protein) and alanine (to prevent phosphorylation) at codon 3291.

On average for each mutation, 20 clones having homologously integrated the targeting construct were identified by PCR; between 30 to 80% of these clones harbored the introduced mutation. The phase of the construct was subsequently determined in these clones by PCR and sequencing. Clones having integrated the mutated construct into the inactive allele, as well as clones having integrated the targeting construct at an unrelated genomic site, were used as controls in the functional assays.

Example 10

Functional Evaluation of SyVaL Clones

The robust and reproducible differences between wild-type BRCA2$^{wt/wt}$ and BRCA2$^{\Delta ex11/\Delta ex11}$ cells in drug treatment assays and in Rad51 focus-formation assays (Table 1 and FIG. 1) suggested that these tests were well suited to evaluate the impact of introduced mutations on BRCA2 function.

Example 11

MMC and Etoposide Sensitivity

BRCA2$^{\Delta ex11/Y3308X}$ had profound sensitivity to MMC and etoposide (20 and 10-fold, respectively), whereas BRCA2$^{\Delta ex11/Y3308Y}$ did not differ from control cells. BRCA2$^{\Delta ex11/P3280H}$ and BRCA2$^{\Delta ex11/P3292L}$ were not significantly more sensitive than the corresponding controls. BRCA2Δex11/S3291E, but not BRCA2$^{\Delta ex11/S3291A}$, were 3-fold more sensitive than controls (Table 1).

Example 12

Rad51 Focus-Formation

Rad51 focus-formation was drastically diminished in untreated and treated BRCA2$^{\Delta ex11/Y3308X}$ (a negative assay result), but robust in BRCA2$^{\Delta ex11/Y3308Y}$ cells (a positive, normal result). No significant reduction in focus-formation was observed in BRCA2$^{\Delta ex11/P3280H}$ and BRCA2$^{\Delta ex11/P3292L}$ (each, positive). A significant decrease in focus-formation upon MMC treatment was in BRCA2$^{\Delta ex11/S3291E}$ (negative), but not BRCA2$^{\Delta ex11/S3291A}$ cells (positive) (Table 1).

Example 13

Gene Targeting of FANCD2

The first allele of the FANCD2 gene was disrupted in human adenocarcinoma cells (RKO) by deleting exon 12, predicted to produce a premature stop codon 51 by downstream of the exon 11/13 junction (Table 2 and FIG. 3A). Five FANCD2$^{+/-}$ clones were obtained.

Targeting of the second allele in FANCD2$^{+/-}$ clones did not yield FANCD2 clones having inactivation of both alleles. Instead, 25 clones had reintegrated the targeting construct into the already-targeted allele. Presuming a 50% chance for each allele to be targeted, the probability for this event to occur randomly is very low ($p=0.3\times10^{-8}$). Similar results were obtained when attempting to sequentially disrupt both alleles of FANCD2 in a second human adenocarcinoma line (PL5). Targeting of the second allele in FANCD2$^{+/-}$ PL5 clones yielded 20 clones that had reintegrated the targeting construct into the already-targeted allele ($p=0.1\times10^{-6}$) (FIG. 3B). In contrast, gene targeting of FANCG and FANCC in RKO yielded various nullizygous clones, and the respective alleles were targeted approximately at the expected rates.

Example 14

Gene Targeting of BRCA2

One allele of the BRCA2 gene was disrupted in RKO cells by replacing the distal part of exon 11, causing a premature stop codon after BRC repeat 5. Thirteen viable clones having homologous integration of the targeting construct were obtained during several independent targeting rounds, all of which had integrated the targeting construct into the already-mutant allele (5355AA) ($p=0.0001$) (FIG. 3C). Five clones with presence of both, wild type and mutant alleles were identified as being tetraploid.

Example 15

Exclusion of Common Artifacts During Gene Targeting

Steps were taken to exclude common artifacts that could occur during gene targeting. To exclude that the recombinant FANCD2$^{+/-}$ clones were contaminated with nonrecombinant cells, a PCR assay was performed and cells were reselected with hygromycin. Neither PCR products of the hygromycin gene nor hygromycin-resistant colonies were found. Using allele-specific PCR and direct sequencing, no significant nucleotide differences of the homologous regions between the FANCD2 targeting construct and the nontargeted FANCD2 allele were detected, which could have caused the preferential integration of the construct into one particular allele. The presence of a third FANCD2 allele was excluded by whole-chromosome 3 painting and FISH analysis using a FANCD2-specific probe. In RKO cells, a small piece of chromosome 3 (in addition to two normal chromosome 3 copies) was found attached to another chromosome. However, the signal from the FANCD2-specific probe was observed only on the two normal chromosomes. In PL5, two chromosomes painted completely and probe signal was observed on both copies (FIG. 3D).

Example 16

Cell Proliferation and Cell Cycle Profile Upon Partial Depletion of FANCD2

Figure 4:
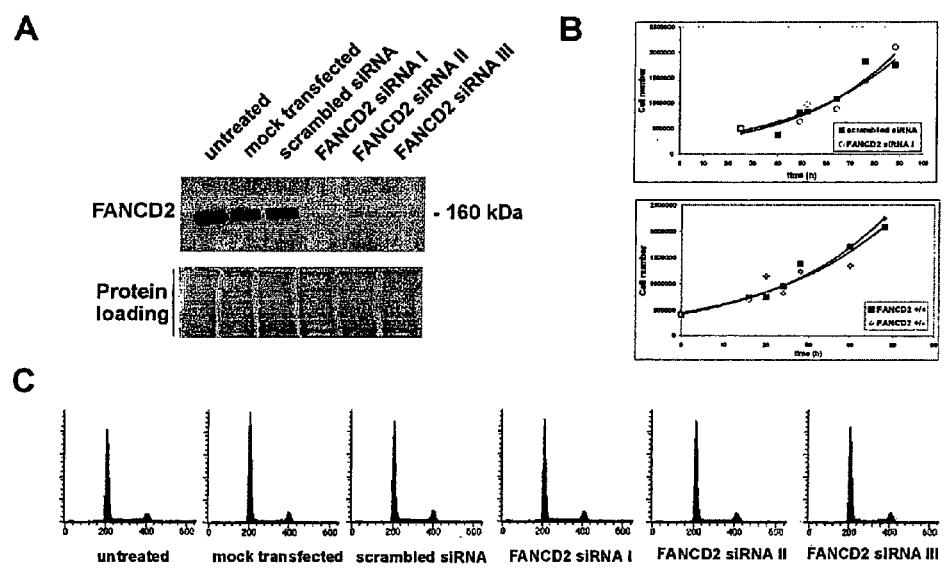
FIG. 4. No obvious selective disadvantage upon partial depletion of FANCD2. (A) FANCD2 immunoblotting to assess the efficiency of siRNA-mediated depletion of FANCD2 protein 48 h after transfection. (B) Cell proliferation of FANCD2-depleted (upper graph) or $FANCD2^{+/-}$ cells (lower graph) as compared to control cells transfected with scrambled siRNA or left untreated, respectively. (C) Cell cycle analysis of FANCD2-depleted cells 72 h after transfection.
Figure 5:
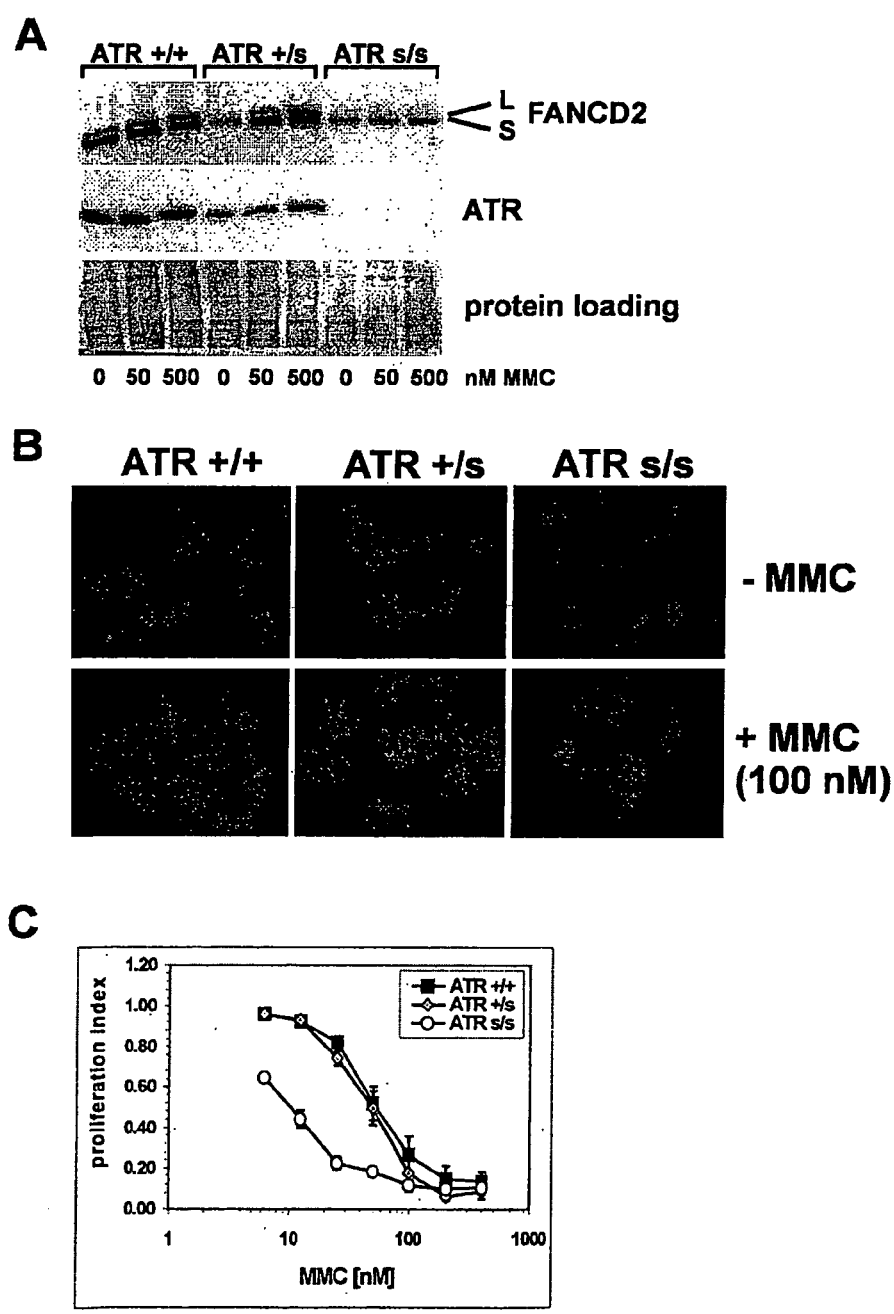
FIG. 5 ATR-dependent FANCD2/FA pathway functions. Parental DLD1 colorectal cancer cells ($ATR^{+/+}$), were compared to DLD1 cells having a heterozygote ($ATR^{+/s}$) or homozygote ($ATR^{s/s}$) knock-in mutation (2101A→G) in the following assays. (A) FANCD2 and ATR immunoblotting to assess ATR-dependent FANCD2 monoubiquitination (S=nonmonoubiquitinated FANCD2, L=monoubiquitinated FANCD2) 24 h after treatment with incremental MMC concentrations) (B) ATR-dependent FANCD2 nuclear focus formation 24 h after MMC at 100 nM. (C) Proliferation assays to assess MMC sensitivity of $ATR^{+/+}$, $ATR^{+/s}$ and $ATR^{s/s}$ DLD1 cells 6 d after treatment. Error bars represent SEM of four independent experiments.

Cell death, proliferation, and cell cycle profiles were assessed in FANCD2 protein-depleted cells, using FANCD2 siRNA. The depletion efficiency was confirmed by immunoblotting 48 h after transfection (FIG. 4A). The fraction of dead cells in the FANCD2-depleted cells as compared to untreated, mock-transfected and scrambled-siRNA transfected control cells was not increased, when examined one to four days after transfection. Also, no gross differences were observed in growth kinetics between FANCD2-depleted and control cells (FIG. 4B, upper graph). Cell cycle analysis did not reveal abnormalities in the FANCD2-depleted cells 72 h after siRNA transfection (i.e. 24 h after demonstrable FANCD2 protein depletion) (FIG. 4C). Similarly, no significant differences in cell death, cell growth and cell cycle profiles were detected between parental and FANCD2$^{+/-}$ cells (FIG. 4B, lower graph and data not shown).

Example 17

ATR-Dependent FANCD2 Modifications and MMC Sensitivity

Using the recently engineered DLD1 colorectal adenocarcinoma cells harboring a knock-in mutation of the ATR gene (2101A→G) that is predicted to drastically decrease ATR protein levels, a p53-mutant cancer cell model a previous report on ATR-dependent FANCD2 modifications was extended. DLD 1 cells having subtotal depletion of ATR protein (ATR$^{th}$) were defective in the upregulation of FANCD2 monoubiquitination (FIG. 4A) and in FANCD2 nuclear focus formation (FIG. 4B) upon DNA-damage induced by treatment with the DNA interstrand-crosslinking agent MMC. Furthermore, ATR$^{th}$ cells were strikingly more sensitive to MMC than control cells (FIG. 4C). This MMC hypersensitivity was quantitatively comparable to that of FANCC$^{14-}$ and FANCG$^{-1"}$ cancer cells.

Example 18

Construction of the Hemizygous BRCA2 Variant Library

The phase-determined BRCA2-hemizygous cells are used for sequential targeting of the remaining functional BRCA2 allele using a complex and partially degenerate library of targeting constructs. First, a series of promoterless AAV vectors are constructed, each of whose flanking homologous arms included a single intact exon of BRCA2, creating a distinct vector for each exon. Second, through site directed mutagenesis, individual silent mutations, those not affecting the amino acid translation, are introduced into the exon sequences of each exon to serve as positive controls for the library and, as appropriate, individual potentially deleterious mutations are introduced that are of medical interest to enrich and ensure their representation at adequate numbers within the library. Third, partially degenerate exons are created using mutation-prone PCR on the arm containing the exon, at a density (tested by sequencing of individual clones from the PCR product) and that is dominated by plasmids containing three to ten amino acid-altering mutations per plasmid. Fourth, for each exon, the AAV constructs are mixed to form a pool containing single-mutant and multiple-mutant exons. Fifth, the AAV constructs are introduced into the phased cells, selected for integration at the correct genomic location, and expand each resultant cell clone. The collection of individual clones resulting from targeting each exon represents an uncharacterized BRCA2 variant library.

To create the hemizygous BRCA2 variant library, it is necessary to determine, for each clone of the uncharacterized library, whether the final targeting event has affected the functional or the nonfunctional allele. To do this, the phase of the new integrant sequence with respect to the intronic markers of the phased cell is determined for each clone. PCR primers, one matching the targeting construct and one flanking the other side of the intronic tag, identifies which of the two alleles has been targeted in the second targeting round. The clones having integrated the final construct into the pre-existing non-functional allele are tabulated and constitute the reference rate of integration, for further deleterious effects could not be expected in such clones. These also constitute the reference variant library. Contrasting to this library, the clones having integrated the final construct into the pre-existing functional allele are tabulated and constitute the hemizygous BRCA2 variant library. In this latter library, the mutant constructs are allelic to an irrelevant nonfunctional allele and they can functionally and for convenience considered as hemizygous for the new variants.

Example 19

Constructing the Database

The reference library is sequenced selectively to form a reference database. For each exon targeted, the same exon within each derived clone is sequenced. The variance among the exonic mutations, and the frequency of wildtype exons, reflected the variation in sequences of the effective AAV construct pool utilized in the final targeting step. The ratio of silent single-site mutations to wild-type exons is expected to be very high, confirming that nearly all clones represent integration of the exogenous exon, which is provided in the homology arm of the vector.

The targeted exons of the hemizygous BRCA2 variant library similarly are sequenced to construct a hemizygous variant database. Unlike the reference database, the hemizygous database reflects both the final AAV construct pool and the effect of deleterious function of the included deleterious mutations, which serve to eliminate some clones from the library. The ratio of exons having silent site mutations to those having wild-type exons is compared to that of the reference library; the comparison is expected to confirm a similar exon-replacement efficiency for the reference and the hemizygous libraries. Mutations creating the same amino acid change were grouped in the analysis of the results. The mutations found frequently in the hemizygous variant library define a database of benign mutations of BRCA2. Some mutations are found at a frequency that is reduced as compared to the reference library, and these mutations constituted a database of hypomorphic variants, and the degree of under-representation constitute a measure of deleterious effect for each mutation. For variants of BRCA2 within exon 27, our results from a syngeneic variance library, studied by such sequencing and database construction, were published (Hucl et al, Cancer Research, 2008, incorporated herein by reference).

Table 2. Information regarding start sites, intro/exon junctions, transcriptional termination sites and other information relevant to the sequence can be found at the Accession number each of which is incorporated herein by reference in the version of the sequence available as of the priority date of the application.

TABLE 2

Information regarding start sites, intro/exon junctions, transcriptional termination sites and other information relevant to the sequence can be found at the Accession number each of which is incorporated herein by reference in the version of the sequence available as of the priority date of the application.

| Name | Abbreviation | Accession No | Region | SEQ ID NO |
|---|---|---|---|---|
| breast cancer 1 | BRCA1 | NG_005905 | 10511 . . . 91665 | 1 |
| breast cancer 2 | BRCA2 | NM_000059 | | 2 |
| mutL homolog 1 | MLH1 | NG_007109 | 5001 . . . 62359 | 3 |
| mutS homolog 2 | MSH2 | NG_007110 | 5001 . . . 85098 | 4 |
| mutS homolog 6 | MSH6 | NG_007111 | 4936 . . . 28807 | 5 |
| ephrin receptor EphA3 | EPHA3 | NC_000003 | 89239364 . . . 89613974 | 6 |
| ephrin receptor EphA4 | EPHA4 | NC_000002 | 221990991 . . . 222145254 | 7 |
| ephrin receptor EphB2 | EPHB2 | NC_000001 | 22909918 . . . 23114410 | 8 |
| integrase interactor 1 | INI1 | NC_000022 | 22459150 . . . 22506705 | 9 |
| axin 1 | AXIN1 | NC_000016 | 277441 . . . 342465 | 10 |
| axin2 | AXIN2 | NC_000017 | 60955143 . . . 60988227 | 11 |
| myeloid/lymphoid or mixed-lineage leukemia 3 | MLL3 | AC_000068 | 151159181 . . . 151460261 | 12 |
| E1A binding protein p300 | EP300 | NC_000022 | 39818553 . . . 39906024 | 13 |
| neurofibromin 1 | NF1 | NC_000017 | 26446121 . . . 26728821 | 14 |
| TP53 tumor protein p53 | TP53 | NC_000017 | 7512445 . . . 7531642 | 15 |
| adenomatous polyposis coli | APC | NC_000005 | 112101483 . . . 112209835 | 16 |
| von Hippel-Lindau tumor suppressor | VHL | NC_000003 | 10158319 . . . 10168762 | 17 |
| SMAD family member 2 | SMAD2 | NC_000018 | 43613464 . . . 43711510 | 18 |
| SMAD family member 4 | SMAD4 | NC_000018 | 46810611 . . . 46860145 | 19 |

TABLE 2-continued

Information regarding start sites, intro/exon junctions, transcriptional termination sites and other information relevant to the sequence can be found at the Accession number each of which is incorporated herein by reference in the version of the sequence available as of the priority date of the application.

| Name | Abbreviation | Accession No | Region | SEQ ID NO |
|---|---|---|---|---|
| kelch-like ECH-associated protein 1 | KEAP1 | AC_000062 | 10491509 ... 10508764 | 20 |
| cyclin-dependent kinase inhibitor 2A | CDKN2A | NC_000009 | 21957751 ... 21984490 | 21 |
| retinoblastoma 1 | RB1 | NC_000013 | 47775884 ... 47954027 | 22 |
| elongation factor RNA polymerase II | MEN | NC_000019 | 18414473 ... 18493918 | 23 |
| neurofibromin 2 | NF2 | NC_000022 | 28329565 ... 28424587 | 24 |
| patched homolog 1 | PTCH | NG_007664 | 5001 ... 78984 | 25 |
| transforming growth factor, beta receptor 1 | TGFBR1 | NC_000009 | 100907233 ... 100956295 | 26 |
| transforming growth factor, beta receptor II | TGFBR2 | NG_007490 | 5001 ... 92641 | 27 |
| activin A receptor, type IB | ACVR1B | NC_000012 | 50631753 ... 50677127 | 28 |
| activin A receptor, type IIA | ACVR2A | NC_000002 | 148319040 ... 148404863 | 29 |
| meiotic recombination 11 homolog A | MRE11 | NC_000011 | 93790114 ... 93866688 | 30 |
| mitogen-activated protein kinase kinase 4 | MAP2K4 | NC_000017 | 11864860 ... 11987776 | 31 |
| serine/threonine kinase 11 | LKB1/STK11 | NG_007460 | 5001 ... 27637 | 32 |
| ataxia telangiectasia mutated | ATM | NC_000011 | 107598769 ... 107745036 | 33 |
| ataxia telangiectasia and Rad3 related | ATR | NC_000003 | 143650767 ... 143780358 | 34 |
| Fanconi anemia, complementation group D2 | FANCD2 | NG_007311 | 5001 ... 80502 | 35 |

SEQUENCE LISTING (39 sequences)

SEQ ID NO: 1 - DNA, 81155 bp, Homo sapiens
cttagcggtagccccttggtttccgtggcaacggaaaagcgcgggaattacagataaattaaaactgcgactgcgcggcgtgagctcgctgagacttcctggacgggggacaggctgtggggtttctcagataactgggcccctgcgctcaggaggccttcaccctctgctctgggtaaaggtagtagagtcccgggaaagggacagggggcccaagtgatgctctggggtactggcgtgggagagtggatttccgaagctgacagatgggtattctttgacggggggtaggggcggaacctgagaggcgtaaggcgttgtgaaccctggggaggggggcagtttgtaggtcgcgagggaagcgctgaggatcaggaagggggcactgagtgtccgtgggggaatcctcgtgataggaactggaatatgccttgagggggacactatgtctttaaaaacgtcggctggtcatgaggtcaggagttccagaccagcctgaccaacgtggtgaaactccgtctctactaaaaatacaaaaattagccgggcgtggtgccgctccagctactcaggaggctgaggcaggagaatcgctagaacccgggaggcggaggttgcagtgagccgagatcgcgccattgcactccagcctgggcgacagagcgagactgtctcaaaacaaaacaaaacaaaacaaaacaaaaaacaccggctggtatgtatgagaggatgggaccttgtggaagaagaggtgccaggaatatgtctgggaaggggaggagacaggattttgtgggagggagaacttaagaactggatccatttgcgccattgagaaagcgcaagagggaagtagaggagcgtcagtagtaacagatgctgccggcagggatgtgcttgaggaggatccagagatgagagcaggtcactgggaaaggttaggggcggggaggccttgattggtgttggtttggtcgttgttgattttggttttatgcaagaaaaagaaaacaaccagaaacattggagaaagctaaggctaccaccacctacccggtcagtcactcctctgtagctttctctttcttggagaaaggaaaagacccaaggggttggcagcaatatgtgaaaaaattcagaatttatgttgtctaattacaaaaagcaacttctagaatctttaaaaataaaggacgttgtcattagttctttggtttgtattattctaaaaccttccaaatcttaaatttactttattttaaaatgataaaatgaagttgtcattttataaaccttttaaaaagatatatatatatgtttttctaatgtgttaaagttcattggaacagaaagaaatggatttatctgctcttcgcgttgaagaagtacaaaatgtcattaatgctatgcagaaaatcttagagtgtcccatctggtaagtcagcacaagagtgtattaatttgggattcctatgattatctcctatgcaaatgaacagaattgaccttacatactagggaagaaaagacatgtctagtaagattaggctattgtaattgctgattttcttaactgaagaactttaaaaatatagaaaatgattccttgttctccatccactctgcctctcccactcctctccttttcaacacaaatcctgtggtccgggaaagacagggactctgtcttgattggttctgcactggggcaggaatctagtttagattaactggcattttggcttttcttccagctctaaaacaagctccatcacttgaaatggcaaaataaaatcatggatgaggccgagggcggtggcttatgcctgtaatcccagcactttgggaggccaaggtggtaggatcacgaggtcaggagatcgagaccatcctggccaacatggtgaaaccccctctccactaaaaatacaaaaattagctgggcgtagtggcatgtgcctgtaatcccagctactcaggaggctgaggcaggagaatcacttgaaccaggaggcagatgttgctgtgagccaatatggcaccactgaactccagcgacagagctaaactccatctcaaaaaaaaaaaaaaaaaaaaaaaaacatggatgatcggtgtcgttgagaggataggtatttggaagaacctttgtttgaaactggctctgtacatacaatgaaattacatacttatttacatacaatgaaatgcagaggttttttttttatataggatctctgtcgagaggctggagtgcagtggtgctatcacagctcactgcagcctcaacctcgtcaggctcaagcaatcctcccacctcagcctccagagtagcagggacgataggtgtgcaccaccatgcccagctaatttttgtatttttttttctttttttgagatggagtcttgctctgttgcccaggctggagtgcagtggcgcgatctcagctcactgcaaactctgcctcccgggttcatgccattcttctgcctgagcctcctgaatagctgggactacaagcacccactaccacgcccggctaattttttgtatttttttttcttttttagtagaggcgggatttcaccgtgttagccaggatagtcttgatctcctgaccttgtgatccacccgcctgggcctcccaaagtgctaggattacaggcataagccactgcgtccagccattcttgtatttttctgttgtagagatagggttttgctatgttggccatgctggtctcaaactcctgacctcaagtgatctaccctcccttggcctctcaaggtgctgggattacaggcctgagccattgcacccagccatggtctaaaaatcttgattgaaataccaccttttcatttccagacacccctatttaaaattaccacacccccagcacacactttatcttctattcctgctgcttctccataacactgattactagctgacattctatgtaatgtatccattttttatctctagtcccacagaatgtaaactccaggatgggatttttgttttgtttacatacatctgtatgttcagtagttagaacggtacttgggacctagttgccactcaataaacatttgtcaaataaataataaactaaactaaattagttctttaatttttttaaatatggtgatggttagtagtgagtaacattcaaaaaataagttgaaaagttgtaccattgcctcttacccacaataaaaaagggtaaattcttttctgctttatgaaagttgtttttcatatttgaagtcaagttaatcagattaaggaaaatgtatgttgtgttttcagagcgatacaagatttataaataaccatcctctcccttgcccttcaacattatagctaaacaaaaataagaggaaaacaggattcacaatttatcaatttattgaaaatcagagccagagaagcaggaaatgacattgtaggaaaaaactgcttttgaaaaagcacaaaacttactcatgacaatcagtgatcaggaaaatcctcaatagtgtggcatttggatacatttatgtttcatttccatgggagagagtcataaaaataggatgttctttctcattctggcaaattaaaccatcaattaaaaactcagatacataaaaattaaagatgtaagaatgaaaatgctaaattgttattttcaatcaactattatgttttctagcttttcattgcttttttctgtttcctgttaagattaatttctttttttttttttttttttttttttgagacagactttggctcttgttgcccaggctggagtgcagtggcacaatctcggctcactacaacctccacctcccgggttcaagcaattctgctgcctcagcctccggagtacctgggattgcaggcatgtgccatcacaccagctaattttgtatttttagtagagacagggtttctccatattggtcaggttggtctcgaactcctgacctcaggtgatcctcctgccttggcctccgaaagtgctgggattacaggcgtgagccaccgctcccagactttttgttttgttttgttttgtttttttgagacacggtctcgctctgctgcctaggctggagtgcagtggcacgatcttggctcactgccagctccgcctcccgggttcaggccattctcctgcctcagcctcccgagtagctgggactacaggcgcccaccactatgcccggctaattttttgtatttttagtagagacggggtttcaccatgttagccaagatggtctcgatctcctgaccttgtgatccacccgcctcagccttccaaagtgctgggattacagtcctgagccactgcgcccggcctggacctttttttttcggggtggggggttggagtctggctctgtcgcccaggctggagtgcagtggcgccatcttggctcactgcaacctccgcctgccaggttcaagttcaagcgcttctcctgcctcagcctcctgagtagctgggattataggcgcacgccaccgtggccggctaattttgtatttttagtagagatagggtttcatcacgttggtcaggctggtcttgaagtcctgatctcgtgatccacccgcctcggccttccaaagtgctggcgtgagccactgcgcctggcttaagattaatttttgtttgttttgtttttgagacggagtctcgctctttcacccaggccggagtgcagtggcgccatctcggctcactgcaagctccgcctcccgggttcacgccattctcctgcctcggccccccaagtagctgggactacaggcgtccaccaccacgcccggctaattttttgtatttttagtagagacggggtttcaccgtgttagccaggatggtctccacttcctgacctcgtgatccgcccacctcggcctcccaaagtgctgggattacaggcgtgagccaccgcgcccggccttaagattaatttttatggtgttttacattcatttgtatggaaagttctaggatagggatcatatttcacttccttttaatatagtacagtatagcacaatttgcagttatgtcttaatatgtgatcaggaatgatcatgactggaaacagtgttatttgtggtagctatagggtaggtaaggttttcagcctgttttaggtttcttgaactaaaattccttctgctgtcttctaagtcaatattggcagctatttctgacaattggtagttctttgtaactttttacctatgactataacatttttgactttcagaagaatttgctaaaatgtgttccccggtgggttgttgtttttcaacctaaacctagctgctttttccagtcacttatccgtattggaagctcaaaatgcaaatatacagtaggcctaaaatattgcctggtttgaaaagtgtttaaaatatttgaatcatttttatagtaaacatttactctcatcaggacctagaaggggaacattttaattttttttcttttcccttttcacagtcttccttcaacattcattacctttttacatatcggagttttcatctgttcaaagtttgtgtttacagtgtgtttatatagtttagattataattaccatactgaaatataattgtttcagaattgagtcagtggtgagaatgaaagccatctggtatgataactgaatccaatttttcttttacggagaatttctttgaaatgtagcttatctcagaaatagggatttagtaaccaatcagagttttctttgtcaaggttgtttttctttttaaagtcacatttggtcccagtaataataccaatgttggtacaagttatctcaggttgtgaagcatttttcccaagtcatctcaggttgtgaagcattttcccaagtagcatttaattttattcttgcaatagcccaaggagtctggcagggtgaatggcaagagaaggaaacaggttcaggtagagtggttagcccaaggtggctctgcttatatacacaactggtagtagaaacccagcctcctgacttagttcattgtttttcttttcactgccctgtgctatgtcaaaaaccccatgattacaagagttgtattacaacccttcacaataaggttactgtccacaagcttttcttgtgatccttttcttttttttttttctttttttgagatggattctctgtcacccaggctggcccgccttggcctcccaaaatgctgggattacagcgtgagccaccgcacctggcccttgtgatccttttctaaaaagttaaatatttaaggaaaaaaccacattcttgtcacactgccaggttagtcgttctttgatatcttgcctggactttatccaaaaaatccgtttcaaaaattcacatttagagctaagtgtagtggctcacgcctgtaatcccggtcgaggcagatggatcacttgaggtcaggacttcaagaccagcctgggcaatatggtgaaaccccttccctaccaaaaatacaaaaaaattagccgggtgtggcagcacgcgcctgtagtcccagctacttggaatgctgaggcacaagaatcacttcaatccgagaggcagaggttgcagtgagccaagaccacaccactgcactccagcctgagcagcagagtgagtgagactccatctccaaaaaaaaaaaaaaaggttcacattcagaagaaagctaaaggccgggtatagtagctcacacctgtaatcccagcactttgggaagccgaagcaggaagattgcttgatgccaggcattcaagaccagcatgggcatcatagtgagatcctgtctctacaaaaattaattaacattaaaaattaaaaagatggctggcatggtggctcactcctgtaatcccagtactttgggaggccaaggcatggtggtgcatgcctttagtcccagctactcgggaggctgaggcaggagaatcacttgaattcaggaggcggaggttacagagagccgagatggtgccactgcactccagcctgggcgacagaacgagactctgtctgaaaaaaaaaaagaaaattaaaaagaccagaataaagctaaagatttaaaatagcctataggttcctaccagaagttaccagctacctctctgatagtctttccctacaatatcctcctggattattacattttagcaccttgacctatctgatgtcctgcatacacaggcatggtcctgctcagggtttgccttctctgctccctctttcttggaatgctcttcccctaattgttgcatagtgtgtttctttacattattaagctatcctctagtctcacctcagtgaaacctttcctgactccccccatgtacatctcacccccacatagatattgaactacctgtttccccttaccctgcttaatttttctctttaatgcacttattcccatgtattctttaattccgtatcaactgtctaccacactagaatatgagctctatgagagcaggctttattttgtaaactgctacatttctatctcctagaatagtacttgaatatagtagtagatacttaataaacacttgttatattagtataataaatgaactaatctcaggaatgccttggttttgtggatagacaggtagggatgggaacttgggtgatgtattttctgaagtttttatttttaagcttattattattttgagatggagtccagctctgtcgcccaggttggagtacagtggcgcgatcttggctcactgcaacgtgcacttccccggttcaagcgattctcctgccttagcctcccaagtagctgggattacaggcgcatgccaccatgcccagttagttttggtatttttagtagagacagcgtttcactgtgttggccaggctggtctcgaaatcctgacctcatgatccgcccgcctcggcctcccaagtgctgggattacaagcatgagcccccgtgtctggccttattttcttttttttgagacagagtcttcctctgtcacctaggctggagtgcagtggcacgatattggctcactctgcaacctccacctccaggattcaagtgatccttctaccttagtctccaaagtagctgagaccacaggcatgcgccaccacgcccggctaatttttgtatttttagcgtagacagggtttcaccatattgtccaggatgatctggaactcctgagctcaggtgatccacccacctcagcctcccaaagtgctaggattacaggcatgaggcaccatgcccggccttaagcttatcattttctaaatttcctttagtgagtacttattacactgtttttacaaagtaatcacaaaccaaacatcatgcctcttctgaagtgatctaataagagtacacagtaccatctgtaaagtgttcttgccagaaagttgaacctgaatgattaagcctgtaagtctagtttataggaaataaggctagaggaacaagttaaacctcaccatagggttatacaatcagcaaaatccagaatgggggaaactccacaggtcaaatgacctaattttaaaaataaatgacaagggagaaaaagtaagagacacctatagatcagaagacacttggggctgggcatggtggctcacacctgtaatcccagcactttgggaggccaaggcaggcggatcacctgaggtcaggagttcaagaccagccggccaacatggtgaaaccccaactctactaaaaatacgaaaaatcagccgggcgtggtggcgcacgcctgtagttccaactacctgggaggctgaggcaggagaatcacttgaacttgggaggcagaggttgcagtgagccgagatcgcaccattgcatgccagtctgggctacaaaagcaaaaccccatctcaaaaaaaagaagacacttgggtttgggtgtgttggctcatgcctgtaaaccccgtgctgggaggattgcttgagcccaggagttcaaggctgcagtgaggtatgtttgcaccactgcactccagcctaggtgacagagtgtgaccttatcttaaaagtaataataattaaaataatctggggtaggggtggatatgggtgaaacagcttggccatgagttgatggttgttggaccagggtgatggtccatatagttcattttattattttatttacttgaaattttgaaatacttgaaattttccatattaagttaaaaaggcatttacagtaaacaaaaaaaagttctaggaaggaattcaaaagaaatataagcagaaaattttgtctttatggagcttaaagatgagatgtgcacccacagtgatagtgcagaaaaatatatcactggaaatgaattcgtacgaactattatcaactaatcttttaaatgctgatgatagtatagagtattgaagggatcaatataattctgttttgatatctgaaagctcactgaaggtaaggatcgtattctctgctgtattctcagttcctgacacagcagacatttaataaatattgaacgaacttgaggccttatgttgactcagtcataacagctcaaagttgaacttattcactaagaatagctttatttttaaataaattattgagcctcatttattttctttttctccccccctaccctgctagtctggagttgatcaaggaacctgtctccacaaagtgtgaccacatattttgcaagtaagtttgaatgtgttatgtggctccattattagcttttgtttttgtccttcataacccaggaaacacctaactttatagaagctttactttcttcaattaagtgagaacgaaaaatccaactccatttcattctttctcagagagtatatagttatcaaaagttggttgtaatcatagttcctggtaaagttttgacatatattatctttttttttttttttgagacaaagtctcgctctgtcgcccaggctggagtgcagtggcatgatcttggctcactgcaacctccgccccccgagttcaagcgattcttctacctcagcctcccaggtagctgggactacaggcacccgccaccatgcttggctaatttttgtacttttagtagagataaggtttcaccatattggccaggctggtctcgaactcctgaccttgtgatccacctgcctcggcctcccaaagttctgggattacaggcgtgagccaccacacccgactgacatatattatctattaggatgtaacatcattttgaacagtgttttgtattttttgtgtccatcagtgaaagcaaactgcaagcagttttgaaataagcacattgtgtttgagccttcccagtttctcctttctgttcatttctgcatatccttatgcattcccccttctaagggtcagtgtttgcccgctttgtaatcattgtgaagacaggaaaggacctgataccagtttctatttaggccaaaattcatttatagcagtgattcaagttatatttacgtatttgatgatcttgtcttttgaaatgaaaatgtttgtttcttaataaaagaatttcagaaaaagtagagtaggtaatttagtagaacaagtgggctttctccttttctttatgttaagctatggctcacatcttaccttaaatgtcaactaatttgtttttaagtatttatgtacctggtacataacctggtaccaggtacaaactatgtacttggtaaaaagtttattagcacaaaaaggtatatgatgcaaagtatacttccctcttaccctacaacccctgcctccctgttccctccccagacaaccacaatgatcaatttcttatgtatcctttgaggaatttttaaattccagagttcttaacttggggtttatgaatagtctttatgaatttcctagaattatatttaaattgtattcaaaactatggccatgtacatttttctgggaagatagtccataattttcatctgagtgagctaagatcatgccactgcattccagcctgggcgacaagagggagactcaaaaaaaaaaaaaaaagtcccagtatttactacagagagctaaagattaacctttaaagccctggggctttcaatttatctggatgagaatctttctggaatgaactgtatgttttcttgtcagcttgagtaacaaatgctgaacatactatactattattacagggactcaagggcccagtgtggtagctcctgcccataaccccagcactttgggaggccaaggcaggaagatcacttaaggccaggagttcgaagctgtagtgagctatgatcacaccactgcactccagcctagatgacagagtgagaccctgtctttttttttttttgagatggtgtttcactctattgcccaggctggagtgcagtggtgtgatctcggctcactgcaacctccacctcctgggttcaagcgattctcctgcctcagcctcttgagtagctgggattacaggcatctgccaccacacccagctaatttttgtatttttagtcgagacagggttttcaccatgttggccaggctgctctcaaactcctgacttcagctaccttggccttaaaaagtgttgggattacaggtgtaagccaccgcgcctggctgaccctgtctcttaacaaaaaaagagagattaagttatgaatatagttgctttgagaacttgtggaagaaggaaattataggcttataggcagagataataatacgagcaaatgtacaaataaaagaaaatagaggacgggcgcggtggctcacgcctataataccagcactttgggaggtcgaggtgggcggatcacgaggtcaggaaattaagaccatcctggccaaaatggcgaaacactgtctctactaaaacacacaaaaaactagcctggcatggtggcacgtacctgtagtcccagctacttggtaggctgcggcaggggtatcacttgaacctgggaggcagaggttgccctgagccgagatcatgccaatgcactccagcctgacaacagagtgagactctgtctgaaaaaaaagaaaagaaaagaaaatacatccaggaaaaataagctaactttgcatatgtgtataggagttgtgttagaaaaggaagaagccctcaaagatgggaagccatttgcaagaaagagaaggtccaagaggaggcagaagggattggaaatagaaaaaggatgtaagaaagagttgattattactcataaacagtaatgaaggaaaaggagagtaattctacaggaagatgctgaggtgctttgagcccagtgaagttggaggtaaagacagctgttgaggccgggcacggtggctcacgcctctaatcctagcacttttggagcccaaggcaggtggatcacctgaggtcaggagctcaagaccagcctgaccaacatagagaaaccccatctctactaaaaatacaaaattagacgggcgtggaggcgcatgcctgtaatcccagttacttgggaggctgaggcaggagaatcacttgaacctgggaggcggaggttgcagtgagccgagattgcgccattgcactccagcctgggcgacaagagtgaaaactgtctcaaaaaaaaaaaacaacaaaaaacagctgttgagattgagaggattagagttggcaactggagaagagtgagaagcttggtttcaagcttgtgatagtcaggattgtgatagtcaggaaagaaccagtcataaagatatatgtgtgtgtatacatataaatatgttatatatatgtgtgtgtgtgacacatatatatttttgtttgtttctttgagacagtgtctccctctgacacccaggctggagttcagtggtgtgatcatagttcacttttaccttgcaatctgggttcaagcaatctctcatctcagcccctcaagtagctaggactacaggtacatggcatttgcccagctaatttttaagtttcttgtagagatgggccagccatattttaaattgtgttttgaatgttatattagaattaaaagtccaaagccgggtgtggtggctcacgcctgtaatcccagcactttgggaggctgaggtgggcggatcacgaggtcaggagttcgagaccagcctggccaatatggtaacaccatctctactaaaaatacaaaaattagctgggtatgggggcacatgcctgtagtcccagctactcaggaggctgaggcagaggaacctcttgaacccaggaggcagaggctgcagtgagttgagatcgtgccactgtactctagcctgggcgacagagcaagattccgtctcaaaaaaaaaaaaagtccagtataatgcccatgtgatagatcgactttttcatgaaatctcttctgtaatatcaatataatctgaataacactttgatctatatgatgagaaagctgggagcctgggagcgatacccccatgcttttgttgtattaattgtattttctacggataaactctaattgctaaaaataaaacaactttattgacccaagcaagcctaaagttctgaaatcttttttttatttttgtttgtttgtttgtttgtttttgtttgttttgttttgagacggagtctcgctctgtcgcccaggctggagtgcggtggtgcagtctcggctcactgcaagctccacctcccgggttcacaccattctcctgcctcagcctcccaagtagctgggactacagacgcctgccaccacgcccagctaatttttttgtatttttagtagagaaagggtttcaccgtgttagccaggatggtctcgatctcctgacctcgtgatctgcccgccttggcctccctaagttctgggattacaagtgtgagccaccacgcccggctgtttttttttgttttgttttgagacggagtctcactgtgttgcccagactggagtgcagtggcatgatctcagctcactgccacctccatctcctgggttcaagcaaatctcctgcctcagcctcccgagtagctgggactacaggcatgtgccaccacacctggctaatttttgtatttttagtagagacggggtttcactatgttggccaggctggtccaaaactcctgacctcaggtgatctgctcgccttggcctcccacagtgccaggattacaggcatgagccaccttgcccagccagttctgaaatcttttatgaagcctataaaaaaagataataataccaatctagaaaatatttcttaaggcagtcatgcattagtttgaactttccaaacaaaaaaatgcaatgtgtaatacttttttttttttttttgagatggagtcttgttctgttgcccaggctggagtgcagtggtacaatctcggctcactgcagcctctgcctctctggttcaagtgattctcctgcctcagcctcccaagtagctgggattacaggcgtgcaccaccatgcatggctaatttttgtatttttagtagagacagggtttcaccatgttgacaaggctgatctcgaactcctgacctcaggtgatccgcccacctcagcctcccaaagtgctgagattacaggcattagccaccacgcccagccttttattttagtagagaccatgtttcaccatgttgaccaagctggtcttgagctgacctcaagtgatccgcccacctccacctcccaaaatggtgggattataggcatgagccaccgcacccagcctgtaatacttttttgaagatctagaaccacattgttcaaagagatagaatgtgagcaataaatgtaacttaaatttttcaacagctactttttttttttttttttgagacagggtcttactctgttgtcccagctggagtacagtggtgcgatcatgaggcttactgttgccttgacctcctaggctcaagcgatcctatcacctcagtctcccaagtagctgggactgtaagtgcacaccaccatatccagctaaattttgtgttttctgtagagacggggtttcgccatgtttcccaggctggtcttgaactttgggcttaacccgtctgcccacctaggcatcccaaagtgctaggattacaggtgtgagtcatcatgcctggccagtattttagttagctctgtcttttcaagtcatatacaagttcattttcttttaagtttagttaacaacctttatacatgtattctttttctagcataaagaaagattcgaggccgggtgcggtggctcacgcctgtaatcccagcactttgggaggctgagatgggcacatcacgaggtcaggagatcgagaccatcctggctaacatggtgaaaccccgcctctactaaaattacaaaaagttagccaggcgtggtagcgggcacctgtagtcccagctactcaggaggctgaggcaggagaatggcgtgaacccaggaggcagagcttgcagtgagcagagattgtgccactgcactccagcctgagagacagagcgagactccgtctaaaaaaaaaaaaaaagattcgaatccttatcttggttgatttttgcgtatctagttccactgaattatttatataattgtatagactacagcacgagacagcttagcttgtcactctactgtactatattctgcagtactatcataagggaatttcctccctacccctgctctgaattgttcaattgtactatttgctggagtaatgcttgatgccttcttgatccattatactagagtatatgtagtatttgtagattctgaaggagtgggagcctctattctgagttttaaaggtacttatgtacagtggaggtagctttttgacagcctcatcttccaaactatagagtcattgttttgttgagtgcaatatggtacttgaagcatctatatcggcgaagaaggacccaagtctccttgaccttacctacctacattcactttctctggtaggaagattgtgggtgcctctctccagacttagtttccatgtcaaaaaagaaaaaaggaagattgtgggctttgctacaatccaattctggatccaatataaccttcattgcttaattactgtgtgatctgggacaagcctctactctataaaaatgaagataaggccaggcttgatggctcatgcctgtaatcccagcacgttgggatgccaaggcaggaggatcacttgaggtcaggagttcgagaccagactgggcaatatagtgaaaccacatctgtacaaaaataaagatagaaagtagcccagcgcaatggctcacacctgtaatcccagcactttgggaggctgaagcaggcgatcacttgaggtcgggagttcaagactgtagacagatagataggtaggtagatagatagagatatagatatagttggggtttttttgttttgttttgttttgtttttgagatggagtttcgctcttgttgcccaggctggagtgcaatggcgcgatctcagtttactgcaacctccgcctcccgggttcaagagattctcctgcctcagcctcctgagtagccaggattacaggcatatgccaccatgcccggctaatttttgtatttttagtagagacagggtttctccgtgttggtcaggctggtcttgaactcctgacctctcccaaagtgttgggattacaggcgtgagccaccgctcctggccttttttttttttttttttttttttttgagacagagtcttcctctgttgcccagggtggagtgcagtggcactcttctcagctcattgcaacctctgccatcctgggttccagtgattctcatgcctcagcctcccaagtagctgggactcaggcgtgtgcccaccacgcctggctaattttgttgtatttttagtagagacagggtttcaccatgttagccaggctggtctcaaactccaggcctcaagtgatctgcctgcctcagcctcctgggattgcagacatgagccactgcacccggccaagagagggtaataaatgttaaattacctggctagtaaaaaatattctctaagtgtcttttctcacaattcccaatgccttttttttttttttggcacaatctcactctgttgcccaggctggaatgcaatggtgcaatattggctcactgtaacccccgcctcacaggttcaacttattctcatgcctcagcctcccgagtaactgggactacagtgcaccaccaccacacccagctaatttttgaatatttagtagagacagggtttcaccatgttggccaggctggtcttgaactcctggcctcaagtgattcacccaccccgcaagtgctgggattacaggtgtggaccaccgtgcacagccctagtgactttttttttagccccttaatcttttctttcctgggtctcttcattgtcagtgtctgctatttactccctacctagtcacccccttcaccagtatattatgtcctttatgttttattttgcaggatcttattttgcttttctattgaatcccctccatctagaatagtactagacatagtaaatattggttgtatgagtgaatcgctgcttttaattatcatcaccattgctctctctacttctggtctatgatccactttgagttaacttttgttatttggtgtgagataggagtataatttcattcttttacatgtggttatacttttgtctcaacactgtttgttaaaaacacaaaaagtattattttcccatttaatcatctttggcctgggcacggtggctcatgcctgtaatcccagcactctggaaggccaaggcagatggatcaatttgaggccaggagttcaagactagccaacatggtgaaactaaaaatacaaaaaattagctgggtatggtggtgcatgtctgtaatcccagctactcgggaggctgaggcacgagaattgcttgagcctaggaggtggaggttgtagtgagctgagattgtgtcactaccctccagcctgggtgatagagtgagtctgtctcaaaaaaaaaaaaaaaaaattaagaaaataaaaatcgtcggccaggcatggtggctcacacctgtaatcccagcactttgggaggcagaggcgggcagatcacgaggtcaggagatggagaccatcctggctaacatggtgaaaccccgtctctactaaaaataaaaaaattagccgggcatggtgctgggcgcctgtagtcccagctgctcgggaggctgaggcaggagaatggcgtgaacccaggaggtggagcttgcagtgagccgagatcgtgccactgcactccagcctgggagacagagcgagactccgtctcaaaaaaaaaaaaaaaaaaaattgtcttggtatttattattgttgaaaatcgcttgatcacagatgtatgtatgagtttatttctgtactgtcaattccattttattgatgtatgtgtctattcttatgctattaccacactttcttgattactatagctttgtggtgaggtgttgagattttaaactaattataagcatcttacatgaactacttaccgtttatatttgattatgcagcatgaaataattatgaatatatcattaaatatgccatattaacttttattaagttttatgtgatcataacagtaagccatatgcatgtaagttcagttttcatagatcattgcttatgtagtttaggtttttgcttatgcagcatccaaaaacaattaggaaactattgcttgtaattcacctgccattactttttaaatggctcttaagggcagttgtgagattatcttttcatggctatttgccttttgagtattctttctacaaaaggaagtaaattaaattgttctttctttctttataatttatagattttgcatgctgaaacttctcaaccagaagaaagggccttcacagtgtcctttatgtaagaatgatataaccaaaaggtatataatttggtaatgatgctaggttggaagcaaccacagtaggaaaaagtagaaattatttaataacatagcgttcctataaaaccattcatcagaaaaatttataaaagagtttttagcacacagtaaattatttccaaagttattttcctgaaagttttatgggacatctgccttatacaggtattagaaacttactgcctttctctaatgcttctagtgtaaaaacttgcagacttatgtaaagtagggctgtatcgccgtgcccccattgtctgttaatcttgtttttatatttttgattgtgtttccttttctttttttttttttttttaagacagggtcctgctctgtcactgaggctggagtgcagtggcgtgatctcggctcactgtagcctctgtctcccagcctcttcctgccttagcctcccaaatagctgggactacaggcacacgctaccatgcccggccaatttttgtattttttgtagagatgaggttttaccatgttgcccaggctggtaactcctgagctcaggtgatctgcccacctcggcctcccaaagtgctggggttcacaggtgtgtgtttatttctatctaattatttacacaaacacaatgtatttatatattgtgtatctcttctgctacaatgtaaattctatgagagtagtaattttgtctgtctcaacactgtttttcctaagtttggtacatagtaggcactcagatgcttaaaggaatgaatgaattgtgctttaattccactttactaaacccaaatctccctttggacattgttatctatgtgttttcaaagaagtataatcataatttgacagaaatccttgagaggcagaactaagtgagggattgggcagggttcagatgttaagaacagtaagctcagcagggtgtgattgctcatgcctataaccctagcactctaggaggctgaggtgggatgattgcttgaggccaggagtttgaaatcagcctgggcaacatagtgagaccccatcactaccaacaaaataaataaataaatgtacatggtggcatatgcccatagtcctagctacttgggaggctatagtgggaggatagcttgagtacagaagtctgaggctgcagtgagctatgattgtggcactgcatgctagcctgggcaatagagcaagaccctgtctctaaattaaacaaaaaaaaaagtactctagttttctatgcaatgcattatatctgctgtggatttagggcagtattatatcagataattttaggcatttggtaggcttaaatgaatgacaaaaagttactaaatcactgccatcacacggtttatacagatgtcaatgatgtattgattatagaggttttctactgttgctgcatcttatttttatttgtttacatgtcttttcttattttagtgtccttaaaaggttgataatcacttgctgagtgtgtttctcaaacaatttaatttcaggagcctacaagaaagtacgagatttagtcaacttgttgaagagctattgaaaatcatttgtgcttttcagcttgacacaggtttggagtgtaagtgttgaatatcccaagaatgacactcaagtgctgtccatgaaaactcaggaagtttgcacaattactttctatgacgtggtgataagaccttttagtctaggttaattttagttctgtatctgtaatctatttttaaaaaattactcccactggtctcacaccttattttatcaatcgtaaggtgcacatttttcacatcttaacatctctgaaattgggaacattttactattgagggtgtgtcatttgtttaatttgtgtgctttctttcttagtgatacagaaaataatagtgcaacttacattgttggtgtcttagctttagtgaaatacagtattgataggcaaatttcttagtgttaaggtagaaaacaaggactctaaataactttgatggtctgtgtatttgtttttgtttcctaggagtaaaatttccagttgattttttaaaatttgatttttaaaaaaaatcacaggtaaccttaatgcattgtcttaacacaacaaagagcatacatagggtttctcttggtttctttgattataattcatacatttttctctaactgcaaacataatgttttcccttgtattttacagatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttggtaaaaccatttgttttcttcttcttcttcttcttcttttcttttttttttcttttttttttttgagatggagtcttgctctgtggcccaggctagaagcagtcctcctgccttagcccccttagtagctgggattacaggcacgcgccaccatgccaggctaatttttgtatttttagtagagacggggtttcatcatgttggccaggctggtctcgaactcctaacctcaggtgatccacccacctcggctccccaaattgctgggattacaggtgtgagccactgtgcccggccggtaaaaccattttcatttattctggcaacatctctttattgagcattgtgaatatgttagtgaatgtgctagatgctcatagatttatataaaaagttagtgaagaaggaaagatggtatattaagtggttagacaagtgttctaatcagttagagttcagagaaggtcagggtacctgatataatcaagagagagaccttacagccaggtgaggtgaatgtacctataatcccagctacttaggaggctgaaatgggaggatcacttgagtccaggtttgagaccagcccaggcaacatagcaagatccccatcagatacaccaaaaagacagatttcttttttttttttttttttgagacagagtctcgctctgtcgcccaggctggagcgcagtgacacgatgtcagctcactgcaacctccgcctcccaggttcaagtgattctcctgcctcagcctcctgagtagttgggactacaggggtacgacaccagacctggctaatttttgtaattttagtagagtcggggtttcaccatattggtcaggctggtctcgaactcctgacctcaggtgatccaccctccttggcctcccagagtgctgggattacaggcgtgagccaccaagcccggccaaaaaagagagctcttataggcccttccttgctttggagctttatctgctctgtgatgcttatctaaaatagccataaggtcactgatatttttaagcatttggaaattacttcagctgggtgccatggctcatgcctataatcccaaccctttgggaggctgaggtaggaggtcctttgagcccagcttgggcaacacagtgagacactgtctctgcaattaaaaaaaaaaaaaagtagctgggtgccgtggctcacgcctgtaattccagcactaggaggcttgaggattgcctgagctcaggagttcaagaccagtttgggcaacatagcaagtccttgtctatattaaaagtttttttaaattatctgggcatggtggtgtgtgcctgtagtcccagctacttgggaagctgagacagaaggatcacttgagtccaggagatgtagactacagtgagctatgatcactccactgcacttcagcgtgggcggcaaagcaagatctagttgcaaaaaaaaaaagaactggctgggtgcggcggctaacacctgcaatcccagcaccttgggaggctgaggccagtggatcatgaggtcaggagattgagaccaccctggccaacatggtgaaacccggtctctactaaaaatacaaaaattagctgggtgtggtggcacgtgcctgtaatcccagctactccagaggctgaggatggagaatcacttgaacctgagagtcggaggttgcagtgagccgagattgcgccactgcactccagcctggcgacagagcgagactccgtctcaaaaaaaaaaaaaaaaaagcttcacgcctgtaatcccagcactttgggaggccgagtcaagtggatcacgaggtgtggagatcaagactatcctggctcacatggtgaaagcccgtctctactaaaaacacagaaaaattagctgagcgtgatggcggactcctgtagtcccagctactcgggaggctgaggcaggagaatagcatgaacccgggaggtggagcttgcagtgagccgagatcccgccactgcgatccagcctgggcgacagagtgagactctgtctcaaaaaaaaaacaaaaaaacttagctgggcgtggtggtatgcacctgtggtcctagctacttgggaggctgaggctggagcattgctttaacatagagagtcaaggctgcagttgagctatgactgtgccactggactccagcgcaggtgactgagaccctatcttttaaaaaaagggaaaattacttgaacttaaaaggtgtaattgttaaagaaaatgtagtgatttgctctgttgttacttatatgtgcatgaatgatggagatcttaaaaagtaatcattctggggctgggcgtagtagcttgcacctgtaatcccagcacttcgggaggctgaggcaggcagataatttgaggtcaggagtttgagaccagcctggccaacatggtgaaacccatctctactaaaaatacaaaaattagctgggtgtggtggcacgtacctgtaatcccagctactcgggaggcggaggcacaagaattgcttgaacctaggacgcggaggttgcagcgagccaagatcgcgccactgcactccagcctgggccgtagagtgagactctgtctcaaaaaagaaaaaaaagtaattgttctagctgggcgcagtggctcttgcctgtaatcccagcactttgggaggccaaggcgggtggatctcgagtcctagagttcaagaccagcctaggcaatgtggtgaaaccccatcgctacaaaaaatacaaaaattagccaggcatggtggcgtgcgcatgtagtcccagctccttgggaggctgaggtgggaggatcacttgaacccaggagacagaggttgcagtgaaccgagatcacgccaccacgctccagcctgggcaacagaacaagactctgtctaaaaaaatacaaataaaataaaagtagttctcacagtaccagcattcatttttcaaaagatatagagctaaaaaggaaggaaaaaaaaagtaatgttgggcttttaaatactcgttcctatactaaatgttcttaggagtgctggggttttattgtcatcatttatcctttttaaaaatgttattggccaggcacggtggctcatggctgtaatcccagcactttgggaggccgaggcaggcagatcacctgaggtcaggagtgtgagaccagcctggccaacatggcgaaacctgtctctactaaaaatacaaaaattaactaggcgtggtggtgtacgcctgtagtcccagctactcgggaggctgaggcaggagaatcaactgaaccagggaggtggaggttgcagtgtgccgagatcacgccactgcactctagcctggcaacagagcaagattctgtctcaaaaaaaaaaaacatatatacacatatatcccaaagtgctgggattacatatatatatatatatatatatattatatatatatatatatatatgttatatatatgttatatatatataacatatatatatgttatatatatgttatatatatataatatatatatgttatatatatgttatatatatatatacacacacacacacatatatatgtatatatatatacacacacacacacaaattagccaggcatagttgcacacgcttgtagacccagctactcaggaggctgaggcaggagaatctcttgaacttaggaggcggaggttgcagtgagctgagattgcgccactgcactccagcctgggtgacagagcaggactctgtacaccccccaaaacaaaaaaaaaagttatcagatgtgattggaatgtatatcaagtatcagcttcaaaatatgctatattaatacttcaaaaattacacaaataatacataatcaggtttgaaaaatttaagacaacagaaaaaaaaattcaaatcacacatatcccacacattttattattactactactattattttgtagagactgggtctcactctgttgcttatgctggtcttgaactcctggcctcaagcagtcctgctccagcctcccaaagtgctgggattataggcatgagctaccgctcccagccccagacattttagtgtgtaaattcctgggcattttttccaggcatcatacatgttagctgactgatgatggtcaatttattttgtccatggtgtcaagtttctcttcaggaggaaaagcacagaactggccaacaattgcttgactgttctttaccatactgtttagcaggaaaccagtctcagtgtccaactctctaaccttggaactgtgagaactctgaggacaaagcagcggatacaacctcaaaagacgtctgtctacattgaattgggtaagggtctcaggttttttaagtatttaataataattgctggattccttatcttatagttttgccaaaaatcttggtcataatttgtatttgtggtaggcagctttgggaagtgaattttatgagccctatggtgagttataaaaaatgtaaaagacgcagttcccaccttgaagaatcttactttaaaaagggagcaaaagaggccaggcatggtggctcacacctgtaatcccagcactttgggaggccaaagtgggtggatcacctgaggtcgggagttcgagaccagcctagccaacatggagaaactctgtctgtaccaaaaaataaaaaattagccaggtgtggtggcacataactgtaatcccagctactcgggaggctgaggcaggagaatcacttgaacccgggaggtggaggttgcggtgaaccgagatcgcaccattgcactccagcctgggcaaaaatagcgaaactccatctaaaaaaaaaaaagagagcaaaagaaagaatatctggttttaaatatgtgtaaatatgttttggaaagatggagagtagcaataagaaaaaacatgatggattgctacagtatttagttccaagataaattgtactagatgaggaagccttttaagaagagctgaattgccaggcgcagtggctcacgcctgtaatcccagcactttgggaggccgaggtgggcggatcacctgaggtcgggagttcaagaccagcctgaccaacatggagaaaccccatctctactaaaaaaaaaaaaaaaaaaattagccggggtggtggcttatgcctgtaatcccagctactcaggaggctgaggcaggagaatcgcttgaacccaggaagcagaggttgcagtgagccaagatcgcaccattgcactccagcctaggcaacaagagtgaaactccatctcaaaaaaaaaaaaaaagagctgaatcttggctgggcaggatggctcgtgcctgtaatcctaacgctttggaagaccgaggcagaaggattggttgagtccacgagtttaagaccagcctggccaacataggggaaccctgtctctatttttaaaataataatacatttttggccggtgcggtggctcatgcctgtaatcccaatactttgggaggctgaggcaggtagatcacctgaggtcagagttcgagaccagcctggataacctggtgaaacccctctttactaaaaatacaaaaaaaaaaaaaaattagctgggtgtggtagcacatgcttgtaatcccagctacttgggaggctgaggcaggagaatcgcttgaaccagggaggcggaggttacaatgagccaacactacaccactgcactccagcctgggcaatagagtgagactgcatctcaaaaaaataataatttttaaaaataataaatttttttaagcttataaaaagaaaagttgaggccagcatagtagctcacatctgtaatctcagcagtggcagaggattgcttgaagccaggagtttgagaccagcctgggcaacatagcaagacctcatctctacaaaaaaatttcttttttaaattagctgggtgtggtggtgtgcatctgtagtcccagctactcaggaggcagaggtgagtggatacattgaacccaggagtttgaggctgtagtgagctatgatcatgccactgcactccaacctgggtgacagagcaagacctccaaaaaaaaaaaaaaaagagctgctgagctcagaattcaaactgggctctcaaattggattttcttttagaatatatttataattaaaaaggatagccatcttttgagctcccaggcaccaccatctatttatcataacacttactgttttccccccttatgatcataaattcctagacaacaggcattgtaaaaatagttatagtagttgatatttaggagcacttaactatattccaggcactattgtgcttttcttgtataactcattagatgcttgtcagacctctgagattgttcctattatacttattttacagatgagaaaattaaggcacagagaagttatgaaatttttccaaggtattaaacctagtaagtggctgagccatgattcaaacctaggaagttagatgtcagagcctgtgctttttttttgtttttgtttttgttttcagtagaaacgggggtctcactttgttggccaggctggtcttgaactcctaacctcaaataatccacccatctcggcctcctcaagtgctgggattacaggtgagagccactgtgcctggcgaagcccatgcctttaaccacttctctgtattacatactagcttaactagcattgtacctgccacagtagatgctcagtaaatatttctagttgaatatctgtttttcaacaagtacatttttttaacccttttaattaagaaaacttttattgatttattttttggggggaaattttttaggatctgattcttctgaagataccgttaataaggcaacttattgcaggtgagtcaaagagaacctttgtctatgaagctggtattttcctatttagttaatattaaggattgatgtttctctctttttaaaaatattttaacttttattttaggttcagggatgtatgtgcagtttgttatataggtaaacacacgacttgggatttggtgtatagatttttttcatcatccgggtactaagcataccccacagttttttgtttgctttctttctgaatttctccctcttcccaccttcctccctcaagtaggctggtgtttctccagactagaatcatggtattggaagaaaccttagagatcatctagtttagttctctcattttatagtggaggaaataccctttttgtttgttggatttagttattagcactgtccaaaggaatttaggataacagtagaactctgcacatgcttgcttctagcagattgttctctaagttcctcatatacagtaatattgacacagcagtaattgtgactgatgaaaatgttcaaggacttcattttcaactctttctttcctctgttccttatttccacatatctctcaagctttgtctgtatgttatataataaactacaagcaaccccaactatgttacctaccttccttaggaattattgcttgacccaggtttttttttttttttttttggagacggggtcttgccctgttgccaggatggagtgtagtggcgccatctcggctcactgcaatctccaactccctggttcaagcgattctcctgtctcaatctcacgagtagctgggactacaggtatacaccaccacgcccggttaattgaccattccatttctttctttctctcttttttttttttttttttgagacagagtcttgctctgttgcccaggctggagtacagaggtgtgatctcacctctccgcaacgtctgcctcccaggttgaagccatactcctgcctcagcctctctagtagctgggactacaggcgcgcgccaccacacccggctaatttttgtatttttagtagagatggggtttcaccatgttggccaggctggtcttgaactcatgacctcaagtggtccacccgcctcagcctcccaaagtgctggaattacaggcttgagccaccgtgcccagcaaccatttcatttcaactagaagtttctaaaggagagagcagctttcactaactaaataagattggtcagctttctgtaatcgaaagagctaaaatgtttgatcttggtcatttgacagttctgcatacatgtaactagtgtttcttattaggactctgtcttttccctatagtgtgggagatcaagaattgttacaaatcacccctcaaggaaccagggatgaaatcagtttggattctgcaaaaaagggtaatggcaaagtttgccaacttaacaggcactgaaaagagagtgggtagatacagtactgtaattagattattctgaagaccatttgggacctttacaacccacaaaatctcttggcagagttagagtatcattctctgtcaaatgtcgtggtatggtctgatagatttaaatggtactagactaatgtacctataataagaccttctgtaactgattgttgccctttcgtttttttttttgtttgtttgtttgtttttttttgagatggggtctcactctgttgcccaggctggagtgcagtgatgcaatcttggctcactgcaacctccacctccaaggctcaagctatcctcccacttcagcctcctgagtagctgggactacaggcgcatgccaccacacccggttaattttttgtggttttatagagatggggtttcaccatgttaccgaggctggtctcaaactcctggactcaagcagtctgcccacttcagcctcccaaagtgctgcagttacaggcttgagccactgtgcctggcctgccctttacttttaattggtgtatttgtgtttcatcttttacctactggtttttaaatatagggagtggtaagtctgtagatagaacagagtattaagtagacttaatggccagtaatctttagagtacatcagaaccagttttctgatggccaatctgcttttaattcactcttagacgttagagaaataggtgtggtttctgcatagggaaaattctgaaattaaaaatttaatggatcctaagtggaaataatctaggtaaataggaattaaatgaaagagtatgagctacatcttcagtatacttggtagtttatgaggttagtttctctaatatagccagttggttgatttccacctccaaggtgtatgaagtatgtatttttttaatgacaattcagtttttgagtaccttgttatttttgtatattttcagctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctccgttttcaaatccaggaaatgcagaagaggaatgtgcaacattctctgcccactctgggtccttaaagaaacaaagtccaaaagtcacttttgaatgtgaacaaaaggaagaaaatcaaggaaagaatgagtctaatatcaagcctgtacagacagttaatatcactgcaggctttcctgtggttggtcagaaagataagccagttgataatgccaaatgtagtatcaaaggaggctctaggttttgtctatcatctcagttcagaggcaacgaaactggactcattactccaaataaacatggacttttacaaaacccatatcgtataccaccactttttcccatcaagtcatttgttaaaactaaatgtaagaaaaatctgctagaggaaaactttgaggaacattcaatgtcacctgaaagagaaatgggaaatgagaacattccaagtacagtgagcacaattagccgtaataacattagagaaaatgtttttaaagaagccagctcaagcaatattaatgaagtaggttccagtactaatgaagtgggctccagtattaatgaaataggttccagtgatgaaaacattcaagcagaactaggtagaaacagagggccaaaattgaatgctatgcttagattaggggttttgcaacctgaggtctataaacaaagtcttcctggaagtaattgtaagcatcctgaaataaaaaagcaagaatatgaagaagtagttcagactgttaatacagatttctctccatatctgatttcagataacttagaacagcctatgggaagtagtcatgcatctcaggtttgttctgagacacctgatgacctgttagatgatggtgaaataaaggaagatactagttttgctgaaaatgacattaaggaaagttctgctgtttttagcaaaagcgtccagaaaggagagcttagcaggagtcctagccctttcacccatacacatttggctcagggttaccgaagaggggccaagaaattagagtcctcagaagagaacttatctagtgaggatgaagagcttccctgcttccaacacttgttatttggtaaagtaaacaatataccttctcagtctactaggcatagcaccgttgctaccgagtgtctgtctaagaacacagaggagaatttattatcattgaagaatagcttaaatgactgcagtaaccaggtaatattggcaaaggcatctcaggaacatcaccttagtgaggaaacaaaatgttctgctagcttgttttcttcacagtgcagtgaattggaagacttgactgcaaatacaaacacccaggatcctttcttgattggttcttccaaacaaatgaggcatcagtctgaaagccagggagttggtctgagtgacaaggaattggtttcagatgatgaagaaagaggaacgggcttggaagaaaataatcaagaagagcaaagcatggattcaaacttaggtattggaaccaggtttttgtgtttgccccagtctatttatagaagtgagctaaatgtttatgcttttggggagcacattttacaaatttccaagtatagttaaaggaactgcttcttaaacttgaaacatgttcctcctaaggtgcttttcatagaaaaaagtccttcacacagctaggacgtcatctttgactgaatgagctttaacatcctaattactggtggacttacttctggtttcattttataaaagcaaatccaggtgtcccaaagcaaggaatttaatcattttgtgtgacatgaaagtaaatccagtcctgccaatgagaagaaaaagacacagcaagttgcagcgtttatagtctgcttttacatctgaacctctgtttttgttatttaaggtgaagcagcatctgggtgtgagagtgaaacaagcgtctctgaagactgctcagggctatcctctcagagtgacattttaaccactcaggtaaaaagcgtgtgtgtgtgtgcacatgcgtgtgtgtggtgtcctttgcattcagtagtatgtatcccacattcttaggtttgctgacatcatctctttgaattaatggcacaattgtttgtggttcattgtctccttaaattagactgtaagcaccttgatggaactcatactaccttttatttcacacacacgcacacgcgcacacacagcctacacatacactgcctagctcattgtagcatactaaatactgattttaatgaataagctaaaccttcgaaacccatttgctaatcccagcactttgggaggccaaggtgggtggatcacctcaggtcagaagtttgagaccagcctggccaacatggtgaaaccccacatctactaaaaatacaaaaattagctgggcgtggtggccaatgccttgtaatcccagctattctggaggctgagacaggagaatcgcctgaacctgggaggcggaggttgcactgagctgggattgtaccactgcactccagcctgggtgacaaagtgagactccatctcaaaaacaaacaaacaaaaacacatcatttcccctatagcaaaaacatgacggcacttactgtatcaagagaggtgagaaaaaggagccacagcaggatgattcaagggactctgcatagctccattttaagaatatgcctactgcaggtcagagaaggtaagcaaactgcctaaggccacacagccaggtacagaactctcaccaatattattgccagcaatcgcaattttggtgtttattcttggtaccaagttggagactatagggttctcttcctaatagagaccatctagcctttcactgttttgtggatacttctttctcttcttctttttttttttcccttttaaaatctagttatttttttctttttggtttctttgacacagggtctcttactctgttacccaggctggaatggagtagtgcagtcatggttcactgtagctttgacttcctgggctcaagcgatcctcctacctcagcttcccgagtagctgggaccacaggcgcccaccaacacctccagctaatttttaagtttttactagagacaacatctcactatgttgcccaggctggtctcaaaatcctgggctcaagtgatcccacctcagcctcccaaaatgctgggattacaggtgtgtgcaaccacgcctggcctattttttttttaattgctcataaatcatcttttttctttaaaaaaaagaaagatgggaggctaaagcaggagaatcacttgaacccaggaggcggaggttgcagtgagctgagatcatgctgctgctctccagcctgggcaacaagagtgaaactccatctcaaaaaaaaaaaaaaagaaagtacacaattttactttctggacctaatggtcaaggccaataatttggtcacctatgaaataaataaaagctttaccatatatatgaccatttgataatgtaatatgaaatgtttatgtactaaaggcagaatagtctagaaaaaacattctgtatcacaacgtctaaaaatgaatatcatcttcatcatagaaccaggctctttctcctaatttttttttttgagatggagttttgctctgtcacccaggctggaatgcagtggcacaattttggctcactgcaaccttcagctcccaggttcaggatcaagtgattttcgtgcttcagccttctaagtagctgggattacaggtgactgccaccacacccagctcatttttttgtatttttttagtagagagagggtttcaccatgttggccaggctcgtctcgaactcctgacctcaaataatccacccgtctcagcctcccaaagtgctgagattacaggcgtgagccaccaggcctggcctcctaatttttatttgtagaagtggcaccaaaattttccaagttctcatgcaaaaattcaggctcatctcagtttatttttttcatttatttatctcccactaaattgacaacttctaataattaggttggttctttgtattcccagcacagggttctatgcagaatacacacacagcagttgctggcaataatattggtgagagttctgtactgggctatgtgatcttagacagtttgcttatgttctctgacctgccgtaggcacattcttaaaatgaagctgttcagaccccctcgattcatcctgctgtggcttctttttcccacctaaatcttaaatacccttttagctgctagtaagtgaatgatgtttttttatgaactttctgaagtcagattagatgaagttgagaaaagcctgatattcttataaagttatatatgtgcatcatagaaaacttagaaaatacagataaacaaaaatcatccatggacgaaccttgaagacattgtgttaactgaaataaaccggacaccaaaggacacatgttatatgcttccacttatatgagatacctagaatagttacatttggttactctgggtacattgcctatagataagccttgctccacaaggagcagttaaaaaaaaaaaaaagataaattcataggatggaaggtagaatagtggttactagggacttggggagggggaaatggggagttactgtttgatgagtgcagatttcagtttgggatgatgaaaaagttctggagatagatagtggcaatggtaacacaacagtgtgaaaataatgccactgaactgtacacttaaaatgattaaaatgataagttaattgtaatttgtgttatccagaaatggttagcaatttattggtgtatattcttttagtattcctgtgtgtgcacaggggtgcttgtatatactttatctttaaaatatatccaggaagctaggcacagtggcttacacctgtaatcccagcactttgggagggtgaggcaggaagattgcctgagccccggaggtcaaggctgcagtgagttgtgatcacgctactgcactctgttctgggcaacccctgtctgggaaaaaaaaaaaaattagtgaggcttagtggtgcacacctgtagtctcagctacttgagtggctggggtaggattgcttgatcccagcaagttgaggccgtggtgagccatgatggtgccactgcactccatcctgggtgatatggtgagaccctgtctcaaaaacaagaaatccagataattctgtgcattataatctagcttttactggatcattaaaattcttttttctttttttttttttttttctgagatggagtttcactcttgttgcccaggctggagtgcagtggtgtgaccttggctcaccgcatcctctgcctcccgggttcatgcgattctcctgcctcagcctcccgagtagctgggattacaggcatgtgccaccatgcccagctaactttgtatttttagtagagacagggtttctccatgttgaccaggctggtctcaaactcctggcctcaagtgatccacccacctcggcctcccaaagtgctggggttacaggcgtgagccaccgcactcagcctgggtcgttaaaattcttaagtgacttcatttttaattactatatgggattctatctttccagtgtatcatgatttatttgacctattgctgaatgttggaggtttcagggtaagaggcacagtttgctattatgtacatcactatagtggcatcctgatagctaaatatttgcctacatccctgattatttccttagtctaaattactgggactaggattttggtgtttgatacatgttactaaattgttttttagaaagattaaaccagtttatgctcttccagcccctgtggtatatgatagttcccattttcctgtaccttgccaacactgggtgatatccagttttaaaatctaaatcttgcattgctatgagaactacaattagagaaggcttatcttctactgcccattctctgtacagagcaaatccctctagacctgaagccccttggagttgtcaagaaacctttgagatgactccccactctgtatctgagctgtcaccagtattctccacttcttcaggattgccatggcaactaaattgatgaaaagatttaggaggccttttctctctttgcaattcctatgatcctttttgaatgtgggtttgggactctgtcaatatacccatcatctaattctgtccattgtgttttaaagtttaaggttgcaatttctgattacatctgccttagccatactgtattatatttgacattcaatatacaatgtccttgtttttctgtatttctaatcttattcccagagatgtgtctatttgttcaggattcattttgcaacgtgtttttactaagcatctacccaaaaccgttgaagtcagatttcaggctgtcttacgtctaaagtagcacaggcaggaaaaactattgaagtgggatttttttttccctttttgtactgaaccgagaaaaagtatatagatgatagagaattcctaatttggtatcattgatatctgggtttttgtttgtttttacagaagactgattaactatacttatttattaatttatcttctcattaataaacacttgctgagtgcttactgtctgctaggcattagggagacaaatatgattaagggaagcttcctcctatcaaggtcatgtgttccatttgggtatactaatgcattagcaatgtaaatcaagtagtgagagatcatctgttcccgataggagatggattattggtggggacttctgtgtgtgtgtgtgtgtgtgtgtgtgtgtgtgtgtgtgtatgtatgtgataaaataaatataggaaatgttaattatagattctaagtagtagatatataaacactcattgcaaagttgcttcaagttttctgtatatttgaaaatattcacaacatgtcgacaaaactagcatgataaagccactatttgtgctaagacttcagcttgtatctggattaggcttattatgtagtagtaggaacattagaaatagttttaactcattaaatacacatgttttatgggaaggttttatatatatatttatatgtaatgaatgtgaacaaacaagggtcagatatacactctgcttccctccagaccagttccggctgctctgctgcacatttcaggagtcttattagaattagccacattctgcccacttgcccttacttctcatatttcacaactcctcctggtggggacttaaggagacattcaaactaggccttgaaagatgagaatttttccaagtggaaaaagaggagtggcagcaagtaaggtaaaggtacagagtcatggaattcccaggaaacgtaaagttgtcatgtgttataggaaaacaacttgtgtgaggggtgttgggagaaatgagagataataccagggtataaagggccttttgaatgctatgttgaggaattttatcctaatggcagtaatgactaacaattatatagtgttcaaaaagtataaatcagcagtggtataccactaagggtttttttcttttctttttttttttgagacagagttttgctctgttgcccaggctggagtgccgtggcacgatctcagctcactgcacttccgccacctgggttcaagtgattcttctgcctcagccagtgtttcactgtgatggccaggatggagcactaagggtctttatggaagaaaaagacatgataaacaaggcttttagggaacttctacagtaatgtagctgtattaaaagtagagatcagagcagcatagtagaagtagaaggctagagctaattgaaggagcacttcagaattagaatcaagaagtcttagaaacctattggttttattctccctaatgtatttggccacttacctgctggggaatttgtctaagttataaaaaataattcctttgggaaacccaaaggaaagttatctattaataattaccccactactttttctgatttatgtaatggccacgtagaggttagatgtgatggttgtgacagtagtgactaatacagcctgtgaagcattttggtcagatatctatgtgctttcattccaggttgactgaggcaagactttggctagggtttgatcagtgatgtaactactcacgagtaccacgtggtggcaatggcattgctgcagaccttggcagcaaagcagtgttagagtagcagtagaaacctttgtgaagctaggaatacattttctggtcataaaaacctcctgaaaattgtgaactcagtgtagcaggagaaagaagatggcttgtttttagtaaagggcaaagtcatttttaaggatcagaagaagaaacggagagtgaaacaatgtgttcctgccctactcccccactggactttttggcaaccattgctgttccttctaaaagtgatttttaaacatgtatattttgaagccaggcacagtgactcacgtctgtaatcccagcactttgggaggccgaggcgggcagatcacctgaggtcaggagttcaagaccagcctggccaacatggtgaaaccccgtctctactaaaaatacaaaaattaggccaggtgtggtggctcacgcctgtaatcccagcactttgggaggccgaggcgggaggatcatgtggtcaggagatccagaccatcctggctaacacggtgaaacaccatttctactaaaaatacaaaaaattagctgggcatggtggcgggcgcctgtaatcccagctactcaggaggctgaagcagaagaatggcttgaacctgggaggcggagcttgcagtgaaccaagattgcgccactgcactccagcctgggcaacaaagtgagactccgtctcaaaaaaaaaaaaaaaaattagtcgggcatggtaacaggtgcctgtaatcccagctacttgagaggctgaggcagggagaattgcttgaaccaggtaggcggaggttgcagtgagccaagatcgcaccactgcactccagcctggggcaacagagcaagactgtctcaaaaaaaataaataaataaaataaattcttaagaaggatattttggaaaactccttacatacctaaattctttgtttatcaaatacttggacttagcacactcttctttgaaatggaccaataaacaacaggagcccataagcaaaaagaactcattattttaaaaacagtaactatccttacaggctttctcagggctctttctgttggatccttccctctcacaggtccttgctaatgatctctaggtggacacattctagatgagatgtccctgtctagaatggcagcaccatgagggctatatcctcagtactaggacagcgcctggtgcttaatagatagtaaatagttgtctaattaactgagcaaacagatagattcatgaattagctttttgctttttctgttagaaactaaaggttcaggtcaggcacaatggcgcatgtctctaatcccagcactttgggaggccgaggcgggctgatcacttgaggtcaggagttcaagaccagcctggccaacatagtaaaaccctgtttctacaaaaattaccaaaattagccgggcgtcttggcaagcacctgtaatgccagctacttgagaggctgaggtgggagaatcgcttgaacctgggaggaagaggttgcagtgagccgagatggtgccaacctgggtgacagagggagacttaaaaaaaaaaagaaagaaagaaagaaaagaaactaaaggttcaaagaatcccagaaaaggaagagtcctcacaagccagtaatctaggcaggattactgatagtatttttatatttgttgtatttttataaaatgccatagatagagggcttttttcaacattacatcagtctaaaaatcacacatttttatatgaactaacctaaatgtctgatgaatctcacaacaccaagtctttgaaatgtgcccatataaataaaatgttaacagattcatgctaattttaaatatcgatagtgtttaaatgccttaattattttttcactccctagctttaaaagaaaataaccaacttcaaaaggacatcacaataacatcaagtctatttgggggaatttgaggattttttccctcactaacatcatttggaaataatttcatgggcattaattgcatgaatgtggttagattaaaaggtgttcagctagaacttgtagttccatactaggtgatttcaattcctgtgctaaaattaatttgtatgatatattttcatttaatggaaagcttctcaaagtatttcattttcttggtgccatttatcgtttttgaagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaaggtgtgtattgttggccaaacactgatatcttaagcaaaattctttccttcccctttatctccttctgaagagtaaggacctagctccaacattttatgatccttgctcagcacatgggtaattatggagccttggttcttgtccctgctcacaactaatataccagtcagagggacccaaggcagtcattcatgttgtcatctgagtacctacaacaagtagatgctatggggagcccatggaagatacatggtatacaacatagctcttgctctattggaagctaagtggaatgggagaaattggtgacaggcaaccccataatttcagaaagctatgaaaaagtactcagacatattccttataacactggtgtcacatcacaaagacctatttaatgtgcttctgatttatagggagagacatcctatacttcaggaactgcactttgatccacagaaagcctagtgatgtagagctcctgttagttcaaaaggaaaagaaaagaacaacacagaaagcctaattatgcaatagagtcaagtgctttatagcaatgttacagttatcaaaaaaaatccagatggacctctgagaggatgccattggagtaaccaggcagatgcagttgatcagagctgacttcctataagaagtgagcactgagctgaggaataatggcataaatgaaggaaagtgagatggaaatttgagtttttaattggaaagacaatacatcaggcagatttttaaataggggcaaacaaacagacacataggagatgctaggcatggggtccccactaggatgctgcttagaaacatgcaggggtggtgagtactcccaaagtacacttcattcctagctcagtgattcttatctgagtgttaaagttccttcttcagcaccccgttccacagtccaactgggaactttaagacctttcttggagtctttctaggaactcaagtctgctacttatacagaacagtggctttggtccccagttgtgccttgcagtatttttgtgttcaggaagaaacagtagctcttggataaagaagctagctagaaactctgttgctatggcagtgcttcaaaatgtatttccttaaatgctttctttgtaactatcttcatttagttcatctctcagataatgagagatcagagtcccatccccagtataatactcttctttagggtactttcaccatcttcagtctaaacacagactagactttcaattataatgtgtaagatttaaaatgttattattgtgtgactttgaatatctgtgtaaatctactatctcctctttggtatatacgtgtgtttatttttttctggagatctgtaactgaaatgcttaatttctgaattgttttggatatcacaacttaataccaacataagttttgagcctttttctccctaaatctggtgtgagtctaactgaaactcaaatgaactttttaaaaataattttttcttttctttaattttttttttaagtagagacagggacgcactgttaactaggctggtcttgaactcctgatcttgagccatcctccccgacctgagcctcaccttatagagagggtcttgctctgttgcccaagctggagggcagtggcataatcacagctcactgcagcctctcgacctcctcaagcgatcctcctgccttagcctcccaagtagctgggactataggcgtccaccaccatacccagctaatttttttttttattttttgtagagacaaggtctccctatgttgcccaagttggtctcaaactcctggactcaagcagtcctctcacctcagcctcccaaagtgctggggttacaggtgtgagccatggcacctggccagaacttctagtaaaaagaatattgttgccgggtacggtggctcacgcctgtaaccccagcactttgggaggccaaggcaggcgaatcacctgaggtcgggagctcgagaccagcctgaccaacatggagaaaccacatctctactaaaactacaaaaaattagccgggcgtggtggcacatgcctgtaatcccacctacttgggagctacggtgcctggcctagtttattatttcttaatatctgttgtcttccagtgtcttccttaattcttcacaataccctgtacaatgcttagcacacagtgggcagtctgtaagtttattaaatgtttggtgtggcccatacttcctatccacaaagaatgtaacatgttaagacatctagatgagggaatgatttaagaggaactacaataatattctgaaacttggactctggatctctgcatttagactttcctaaaccagccagcaagtagatcatcatgtcacaaggcttaggttgggcttgctgttcagagaatgaattaaggattaaggagaaaaaaaagcagaaaggttttgctctgtttttcaggttctattgagttgttaacttctaacaagttatcttatttgcttcattgcatgaggcccattgtagtaagaagaggaatttatatgctaaatgttctggtgatagaatgacttttctttttttttacagtccaaaggtcttttttttttttttttaacacctattatgccatgaattcatagggaataggttccagctgctcaggctccttcccattggttctcacaaagtgtgcttctctgggtggagcaggctggtgcttcagttgaacccacgtacctttctctttggcttctttctttttctgatcattttccttcacgcgtttcaggaagctgtcttggctcttagagtgtttaatgtgctcaatacgcacattaattctcttggcaagaatcttgcccttaacttgtttacagcgatgccaacagcatgctgggtcacgttgtagacttttccagttttgccatggtaacacttgtggggcattcctttttgaacagtacccgttcccttgatgtctacaatttcacctttcttacagattcgcatatacatggccaaaggaacaactccatgttttctaaaaggcctagagaacatatatcaggtgcctctcctctttccctttgtgttcgtcattttggcaaattactgaaagatggtggttctggccaaaaggaggaatgactttttaatagctgtgtttgtatctgagccttccctctgcctttcattttttttgttttgttttgttttgtttttgtttgagatgaagtttcacttttgttgcccaggctggagtgcaatggtgtgatttcggctcattacaatgtccgcctcagcctcctgggtagctgggattacaggcacccgccaccacgcccagctaatttttgtatttttagtagagacagggtttcaccatgttggccgggctggtctcaaactcctgacctcaggtgatctgtccacctcggcctctcaaagtgctgggattgtaggcgtgagccacatcacctggccacttttttaactctttccaatggttaattccgtttgatatggttccttggaacttgcacattaccctttatcaattatcaccctgtattgggggtggggaggatgatacctctcttcatagttagatcctacttactttcaacagagttcttaacaatcctagaaactcacaggtccagaaaagacaagcataaaggaaactataaataatgcatttgaagactaactcaggaaatcaatgattatttccccccaggctacccagtgtcttaaaaaaacagtttaattaatacaatcttttgtttcaattttctacctatatttatggcttttagcttttctaataaaagctcaaaatgaattacagtcatcagtgactttttaatgaatagaagacttttgcaatttttaactatttgtttttacttattaaatatttccgccttggccaggcatggtggctcacgcctataatcccagcactgtgagatgccaaggcaggaggatcacttgagtttaagagttctagaccaggctgggtatggtggctcatgcctataatcccagcactttgtgaggccaaggttggcggatcacctgaggtcaggagtttaagaccagcctggccaacatggtaaaaccccatctctacaaaaaatacaaaaattagccaaggggtggtggtgggcacctataatcccatcttcttgggaggctaaggcaggagaatcgcttgaacctggaggcagaggttgcagtgagccgagatcatgccactgtattccagcctgggtaacagagcaagactctgtctcaaaaaaaaaaaaaagtttgaaaccagcctggtcaacacagcaagacacccatctcgttgaaaaataacggtcgggcgcagtggctcacgcctgtaatcccatcactttgggaggccgaggcaggcagatcacctgaggtcgggagttcgagaccagcgtgaccaacatggagaaaccccatctctactaaaaatacaaaattagttgggcgaggtggtgcatacctgtaatcccaactacttgggaggctgaggcaggagaacagcttgaacctgggaggcagagaggttgtggtgagccaagatcatgccattgcactgcagcctgggcaacaagagcaaactccatctcaaaaaaaataaataaataaaaataaataaataagtacttctgcctttaagccacttcctagaaggcagtggcacaaagtgatacatttggaggagtaaatatattacaaaatgaattaggctgggcgcagtggctcatgtctgtaatccccgcactttgggaggccaaggcgggtggatcacttgaggtcaggagttcgagactagcctgatcaacagggtaaaatcccatctctactaaaaataccaaaaaaactagctgggcgtggtggcaggcacctgtaatgtcagctactaggaaggctgaggcaggagaatcgcttgaacccaggaggtggaggttgcagtgagccaagattgcaccattgcacttcagcttgggcaacagagtgagactccgtctcaaaaaaaaaaaaagaactaacatgccagaactttgccttcagtatgttttgtgatttttcccttcttgtgccatttcatcattagttccatgtattatttaagatttcttatcaaccagcaccttgggatttttttgtgtatgtgttggtttagggggtttatttgtttttttcttttttttcggtaattgaaaatgtgaagcaaaatgtcacctgttttttctttcatgtctgacactcatgtcttgtttacccccgacatgcagaagctgaaatccccatttcatacagtcttcaatgtggaggcagtagggatggagaaaataatgtactttgtgctctccggtactctttctttcctattgtctgaggggatttgggcataatttattttgctgcagagataaaaatttgttatatatattttttatcattcagggccaaggaatatagattttttttttcagccttgtctcagctgggtgtctttatttactctgtcttaaagtgttccttttattatcattattattttttaatcattgaattccatttggtgctagcatctgtctgttgcattgcttgtgtttataaaattctgcctgatatacttgtttaaaaaccaatttgtgtatcatagattgatgcttttgaaaaaaatcagtattctaacctgaattatcactatcagaacaaagcagtaaagtagatttgttttctcattccatttaaagcagtattaacttcacagaaaagtagtgaataccctataagccagaatccagaaggcctttctgctgacaagtttgaggtgtctgcagatagttctaccagtaaaaataaagaaccaggagtggaaaggtaagaaacatcaatgtaaagatgctgtggtatctgacatctttatttatattgaactctgattgttaatttttttcaccatactttctccagttttttgcatacaggcatttatacacttttattgctctaggatacttcttttgtttaatcctatataggttttttgaacctataacataagctacaacatgagaaatgtgcggttagatagatatgtcccttctgaaggtcagaaaaaaatataatggaggtaaaacctgaacaagcttggaaactgatggtagacttcttcaaggcagcccttgccctaattaaaattcttgtctttctagaaaaagtctagctgttgatttaccacagaaaataataataataattactattattattattttttgagacagggtcgccctgtgtcacctagattgcagtggtgcagtcatggctcactgcatcctccgtttttcaggctcaagcaatcctcccaccttagcctcctgagtagctgggtccacaagcatgcgccacccacacccactaagtttttgtatttttggtagagatggagttttaccttgttgcccaggctggtctcaaattcctggactcaagtagtccgcccgccttgccctcccaaagccagaaaacatttagaatatctttcagagatgtgtatttacaccactattaacacagggctgtatagcagtccagtactggactatgtagtccagtactattcttttccttactggagggccaggcgtggtggcaggtgcctgtaatcccagctactcaggaggctgaggcaggagaattgcttgaacctgggaggcagaggttgcagtgagctgggaccgtgccattgcactccagcctgggcgacagagcaagactccgtctcaaaacaaaaaaaaaaagagagagagagcagtaattcaggtctcacccatcttcaatccagggggcctagccttagtatttgacccatagtaagcacccaataattgtttaaattaattaacctctgaggccctttaaatctgttgataagtatcttattttgcaaagtcctaagcacttggaagagcagaggaactatttactgggtgtgtatgcttttctaacaatattttatagctggcttttgtttttagaatgaatttgaacattgaaaaggcaggcaatagggatgattctgtgaattctgctaaaactgagtagaaagaatgagtgtagagatgtcgacattgatcaactttctatcttcataagagatctgattctaacatatccatttagactcaagtagaatattgtgtatagagtgagtggcagtgagtaatttggtaaaaatttgctgacctgcttttattctttcctcctttctttcttcctttccttccttccttccttccgtcctttcctttcctttccctcccttccttccttctttccttctttctttcctttctttcctttcttcctttctttccttcctcccttccttttcttttctttctttcctttccttttctttcctttctttcctttcctttctttcttgacagagtcttgctctgtcactcaggctggagtgcagtggcgtgatctcggctcactgcaacctctgtctcccaggttcaagcaattttcctgcctcagcctcccgagtagctgagattacaggcgccagccaccacacccagctactgacctgcttttaaacagctgggagatatggtgcctcagaccaacccaaccccatgttatatgtcaaccctgacatattggcaggcaacatgaatccagacttctaggctgtcttgcgggctcttttttgccagtcatttctgatctctctgacatgagctgtttcatttatgctttggctgcccagcaagtatgatttgtcctttcacaattggtggcgatggttttctccttccatttatctttctaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctaggtaatatttcatctgctgtattggaacaaacactttgattttactctgaatcctacataaagatattctggttaaccaacttttagatgtactagtctatcatggacacttttgttatacttaattaagcccactttagaaaaatagctcaagtgttaatcaaggtttacttgaaaattattgaaactgttaatccatctatattttaattaatggtttaactaatgattttgaggatgagggagtcttggtgtactctaaatgtattatttcaggccaggcatagtggctcacgcctgtaatcccagtactccaggaggccgaggcaggtggatcagctgaggtcaggagttcaagacctgtctggccaacatggtgaaaccctgtctctactaaaaatacaaaaaaattaactgggtgtgctagtgcatgcccgtaatcctagctactctggaggctgaggcagcagaatcacttgaacccgggaggcggaggttgcggtgagccaagatcacaccactgcactccagtctgggtgacagagcaagactccatctcaaaaaatatatatatatatatatacacacatatattttatttcaactgttagacaagagtccaaaggccaaagaataaagttttaggccagtcctttattagaaaatgagtcaaatcccaaagcaagttttttttatgagttaatgaatataaatgactacatattttatgccttaaaaatcacttttaatgaatggtgttttatggcttgtaaatcagagttttaatcagtaaagaaagtttttaatcctcaaaaacacgttatcataaaagacactgtttggcatcaaatgtggtatttggccatgttcattagggtcattttaggaatctcatacattctacttagctatgcttaattcctgataccatggcattttctgaaatgtttcaaggatgacatctctgctgtttttaatttggtaatgatatctgctgatttattaagtgaaaaaagtaatggtgtcattaccttggatgaagaaacaaaaataaagcatttgccacatttttcaacttttttttcctttcttacaaaattgctataagctcattgcccccaaattggacaatatagggaataaaaaagataatttggggtggggttagacacgggtcttgttatgttgccgaggctggtctctaactcctggcctcatgcaatcttcctaccttggcctcccaaagtgctgggattataggtgtgagccacttcaccaagctgagatgccacctcttaaaagataaaataaggacagattacagccactgctcatgcctgtaatctcagtactttgggaggccaaggtgggagaattgctcgaggccaagagttcaagaccagcctgggcaatgtagcgagacctgatctctataaaaagtaaaaaaaaaaaaaaactagctggggccaggcgtggtgggtggcttacgcctgtaatcccagcactttgggaggccgaggcgggcagatcacctgagggcaggagttcaggaccaacctgaccaatatggagaaaccctgtctctactaaaaatacaaaattagccaggcttggtggcttatgcctgtagtcccagctactcgggaggctgaggcaggagaatcgcttgaacctgggaggcagaggtttcagtgagctgagatcgcgccattgcactctagcctgggcaacaagaatgaaactccatctcaaaaaaaaaaaaaatcagctggaaggtggcaaacacctgtggtcccagctactcaggaggctgagacaggaagatcacttgagtccaggaggtcaaggctgcaggtgagccatgtttgtgccactgcactgcagcctggatgacagaccgagacccttctcaaaaaaaaaaatattacccgtactcttttttgagacggagtttcactcttgttgcccaggctggagtgcaatggcgcaatctcggctcagcgcaacctccgcctcctgggttcgagcgattctcctgcttcagcctccccagtagctgggattacaggcatgcaccaccacgcccggctaattttttgtatttttagtagagacagggtttctccatgttggtcagactggtctcgacctcttgacctcaggtgatccgcccaccttggcctcccaaagtgctgggattacaggcctgagccaccgcacccggcctgtactcttattctttaataataaaatatttctgtgtttctttagtcattttacataaacttttatttatttatttatttttatttatttatttttttgagacggagtctcgctctgttgcccaggctggaatgcaatggctcaatctcagctcactgcaagctctgcctcccgggtacacgccattcccctgcctcagcctccctagtagccgggactacaggcgcccgccaccacgcccagctaatttttttttttgtattttcagtagagacagggtttcactgtgttagccaggatggtcttgatctcctgacctcgtgatccacccgtctcggcctcccaaagtgctgggattacaggtgtgagccaccgtgctcggcccataaacttttatttttaaaataatgtcatgataaataatattgcttaggtgtctttaatatattagtaacatttctgttttattgtacatcaacatttatattcaaattaatgggtgaagagtactccattggactaggtatatcgtaatttaatctcctattattggacaactacattgtttctaaaattatactattcctatgactaaacctttgcatatatcttttatctccctaggatatatttctaaaactagcattgttgactgaaagtgtaaatacgtgttaaggtgtttgctacataatgccatatttcctttttaggaaactaagctactttggatttccaccaacactgtattcatgtacccatttttctcttaacctaactttattggtctttttaattcttaacagagaccagaactttgtaattcaacattcatcgttgtgtaaattaaacttctcccattcctttcagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttgtgagtgtatccatatgtatctccctaatgactaagacttaacaacattctggaaagagttttatgtaggtattgtcaattaataacctagaggaagaaatctagaaaacaatcacagttctgtgtaatttaatttcgattactaatttctgaaaatttagatctagataaagctatagtgtggattattttatgtatatttacttgagaaaataattattaaatattagtggaaaagctatactttgggtatgatataggactttcgaattggaattttcctttctatctgtaaaagcaagtaggtatagttttattccccagaaggcatctttttctcccccttgtctcacatgggtgaatttaccagcatatttaactaaattcagactggttccaaatgtactgccagatagtagcatttctctagtgtttgttttcatcctggcttgtaagaatgccctgccacttctgccctgcaatatcccttgctattaggattttggcatcaccttgggtccttaatgccagaaatgggaattgcttcatactgtggaaaaatacccattaaaatattaagaccagtaaaacctcgtttctgcttgggctatttgtggatttcagacatcctgagaagtttaccacccctgtaattaattgtcattgtcatcacttcataataaaaataattgcatggccgggcatggtggctcaagcctgtaatcccagcactttgggaggctgaggtggtcagatcacctaaggtcaggagatcaagaccagcctgaccaacatgaagaaaccccatctttactaaaaatacacaattagccgggcgtggtggcgcatgcctataatcccagctactcaggaggctgaggcaggagaattgcttgaacccgggaggcggaggttgcggtgagccgagattgcaccattgcactccagcctgggcaacaagagcgaaactctgtctcaataataagaagaagaattgcgtgaatatttctttaaaactatgatgagataacataccagattatcaaatggattcagtagtgggtgtgccatttattgcacactgagagatgaccaagtcattctgaaatatctttattaatatatccttcctaggatttttcatcctaacttctccataggtagttacttagcataacatctctgtggccagatgtatcccactactaaaagggcaaagtaagctgtggctgccctggtagatacaatgagtaagtgcacagtgatggctataaatgttttcatctcataatcccatgtccagaccagcaatttgctctgaaagctcttacctgtgtctgtttcaatggctcttgatcacttgcctgcacgtccagaattccttatttattcattgaaaattagcgttctttatccctttgttttgcaagttcagctttttagagatggctaaaatggtctaatctttcttggcaaaggcaattctgagctgcagattagactacaagtggcttgggtacatgttgtctttaaacaagcgaagaggaaaactttgagctctattcagacttggtgaagtgtggtaaatttatgatgaaagctactgactgtattacacatgattaattctgaagcccatattaagatgatcttttcagcagttcagcattgctcttctaactgaacagtttcaaggctgggatttcagcaattaatcagttcagaattgctaatgatcctggcggagggtggtagcaaaagggggaggatgtcattagcttctctagcctgccttttttcagtgccctgtggcagtatggagtgaggcaacatgaaagaaagatggcctgaccttcatggcagtattgtgcaacacgtaaatactggtgtgagtggctgtggctatggctagtaaatgatggcccttggtaaacaaagttatttatcagacaatacctaccagctaggtcaactgtgcccataattgatctggttaatttcttttgctgcctattgatttttatttggttgatagataatagctagaggactctaaatttctttggggaagaacatgaaccccttctaagccttcttacgagagaattgatcgcttttgcactgacctttagtaacatcctgatttcagtgttttgtaactatcagagggttgagtcttggttttaagccatgtatatctgtagcataactttctgtgtaggctagttacctctcagcttataaagtgtaggctgataaatttatagtacagtagagtgtcactatgcaaagaaacgatcttagggaatcgaatgatatctgctattaaagcaaaattaatatatattttttctttttacttttttttttttttaaagacatgaaatctcactgtattgcccaggctggtcttggtctcagactcttgagctcaagcagtcctcccacctcagcttcccaaagtgctgggattataggcatgagctgccgtgtctggcccagtatatattttttaagttttaagttttgtggtacgtagtaggtttataatattattttgaatccttagttgtaattttatgtctgctgatgtgtacataatttttattaaactatttatttgagacttcaggtatcttttttttttttttgagacggagtctcgcactctcgcccaggctagagtgcagtggcgccatctcggcttactgcaagctctgcttcctgggttcacgccattctcctgcctcagcctcctgagtagctgagactacaggtgcccgccaccacgcctggctaattttttgtatttttagtagagacagggtttcaccgtgttagccaggatggtctcgatctcctgaccttgtgatctgcccgcctcagcctcccaaagtgctgagattacaggcgtgagccaccgcgcccagccgagacttcaggtgtcttagaattttttaaatgtaccctttctgagaaaaacagagacttaaagctaggataactggtattctattttttttttttttttttttttacctccagcctgggtgacagagcaagactctgtctaaaaaaaaaaaaaaaaaaattcactttaaatagttccaggacacgtgtagaacgtgcaggattgctacataggtaaacatatgccatggtggaataactagtattctgagctgtgtgctagaggtaactcatgataatggaatatttgatttaatttcagatgctcgtgtacaagtttgccagaaaacaccacatcactttaactaatctaattactgaagagactactcatgttgttatgaaaacaggtataccaagaacctttacagaataccttgcatctgctgcataaaaccacatgaggcgaggcacggtggcgcatgcctgtaatcgcagcactttgggaggccgaggcgggcagatcacgagattaggagatcgagaccatcctggccagcatggtgaaaccccgtctctactaaaaaataaaaaaattagctgggtgtggtcgcgtgcgcctgtagtcccagctactcgtgaggctgaggcaggagaatcacttgaaccggggagatggaggttgcagtgagccgagatcatgccactgcattccagcctggcgacagagcaaggctccgtctcaaaaaaaaaaaaaaaaaacgtgaaaaaataagaatatttgttgagcatagcatggatgatagtcttctaatagtcaatcaattactttatgaaagacaaataatagttttgctgcttccttacctccttttgttttgggttaagatttggagtgtgggccaggcacggtggctcacacctgtaatctcagcactttgggaggccgaggcgggtggatcacctgaggtcaggagttcgagaccagcctggccaacgtgttgaaaccccgtctctactaaaaatataaaaattaggtgggcgtggtggcaggcacctgtaatcccagctactcaggaggctgaggcagcagaatcgcttgaacccaggaggtggaggttgcagtgacccaagatcgcaccattgcactccagcctggggacaagagcgagattcttgtctcaaaaaaaaaaaaaaaaaaaaaaggtttggagggtggtgagctgagatagtcaactattaactcctatctacctgctgggactacactggtgaggtggagcctaagtcctaaaacaacaagtgaggcagctggacgcggtggctcgcatcagtaatcccagcactttgggagcctgaggcgggcagatcacaaggtcaggagttcgagaccagcctggccaatatggtaaaacccagtctctactaaaaatacataaattggctgggcgtggtggtgtgcacctgtaatcccagctacttgggaggctgacacagaagaattgcttgaactctggaggctgaggttgcagtcagctgagatcctgccactgcactccagcctggcgacagagtgagactctgtctcaacaacaacaaaagaaagaacaagtgaggcaaaacctggagaccccagcttcatgtaacacctagtttgagtattgttgagagtttttcaggaaaaaagtctgataacagctccgagatagtcttaacatatgaaaaagcaaaaaagggaggagacagatcatttgtcctatacctttctcttttaaggttttaattataacttgtgtaatacaggagacctctgggtgtttttagttgactataaactaaatctgagtacacatttcagggctgctaaaaatgcttatttgaaactgggccgtattaacacaagcagaggctctggagcaagtgaagtacagatccagagccccactgtattctccaatggagtgattgcctgaaagatgatgtcagttttaagcaccgtgcttggtttttaacatggtcactgacaaattggagagtgtttatccagaggtagatggtaaagatacataaaagtaacttgaaatactgtcttttgaagaagaaatgagaagatttaaggaaataagacactgtcttcaagtatctgaagaaccgttacccggaagagaactgttatctggaacaggattaagactcactcatggggctccagaaagcagacgagtgcatggaggacgcagaagatgcagattgtgtggctcaactctaaaatctttctaacaaaattagttctctggatgtgttccagttcacttgatgatgattcttttgtttttgtttttgtttttgaggtgtagtttttcactcttgttgcccaggctgctggagtgcaatggcacgatcttggcttgctgcaacctccccctcccgggttcaagcgattctcctgcctcagcctcccgagtagctgggattacaggaatgcaccaccatacctaattttgtatttttagtagagacagggtttttccatgtcagtcaggctggtcttggactcccgacctcaggtgatccacctacctcggcctcccaaagtgctgggattacaggtgtgagccatcgcgcctagcctatgatgattcttttcacagagatacaggcacttaaggagaggatctaaaccccttggacacattgccgttgaacttctaagatcttaggtttccacttactcatgaaaattataccacagggtcagagggtagtgttcattggagccaggtgccagaacaagttattacaaactactattttagagaaaaatgtcattaaagtttaagataccttaagctataggtttgcatcaaagttaatgaaaggtaaaaagatgccaagcgtggtggctcaggcctgtaatcccagcgctttggggggccaaggcgggcagatcacgaggtcaggagatcgagaccatcctggctaacacggtgaaaccccatctctagtaaaaatacaaaaaattagccgggcatggtggcgggcatctgtagtcccagctactcaggaggctgaggcaggagaatggcatgaacccaggaggcagagcttgccgtgagctgagatccagccactgcactccagcctggctgacagagcaagactgcatctcaaaaaaaaaaaaaaaaaaaaatgcaaatcaaatctaaagtagttcagtctttaaactcaaagccaatacatttgctttgaactacaaatgaactgaagtttttaagtgtaataaatgttactaaatcggcttttgtagcagttaaacaaaaaacttcaaaaattgtaaggattctgtgagggagcatggctgctgctgctgctgctgcttgcagatagcctgctgtgtttaggatttagttaaatacatttctcctgtttaaaactaaatggtctttccttagtttgcttagttcttcagaagggcctttgaaacactgggaaataaacaagtgattctttagctactgctttctgaaatacttatataaaagctctgcactgtattctcccatccctctcaggggaatattagagggttaggactccccaggtagacattctaggggtgaaaatttgtcattacattgacatttcagatttaggttttcaacaatactgttttcttctttcacatattgccatctagtaatatagatgttctccgtccacattaatcaaaactattgacatggataattcctaattccttgaacactataatggagatctatagctagccttggcgtctagaagatgggtgttgagaagagggagtggacagatatttcctctggtcttaacttcatatcagcctcccctagacttccaaatatccatacctgctggttataattagtggtgttttcagcctctgattctgtcaccaggggttttagaatcataaatccagattgatcttgggagtgtaaaaaactgaggctctttagcttcttaggacagcacttcctgattttgttttcaacttctaatcctttgagtgtttttcattctgcagatgctgagtttgtgtgtgaacggacactgaaatattttctaggaattgcgggaggaaaatgggtagttagctatttctgtaagtataatactatttctcccctcctccctttaacacctcagaattgcatttttacacctaacgtttaacacctaaggtttttgctgatgctgagtctgagttaccaaaaggtctttaattgtaatactaaactacttttatctttaatatcactttgttcagataagctggtgatgctgggaaaatgggtctcttttataactaataggacctaatctgctcctagcaatgttagcatatgagctagggatttatttaatagtcggcaggaatccatgtgcagcaggcaaacttataatgtttaaattaaacatcaactctgtctccagaaggaaactgctgctacaagccttattaaagggctgtggctttagagggaaggacctctcctctgtcattcttcctgtgctcttttgtgaatcgctgacctctctatctccgtgaaaagagcacgttcttctgctgtatgtaacctgtcttttctatgatctctttaggggtgacccagtctattaaagaaagaaaaatgctgaatgaggtaagtacttgatgttacaaactaaccagagatattcattcagtcatatagttaaaaatgtatttgcttccttccatcaatgcaccactttccttaacaatgcacaaattttccatgataatgaggatcatcaagaattatgcaggcctgcactgtggctcatacctataatcccagcgctttgggaggctgaggcgcttggatcacctgatgtcgggagttcaagaccagcctgaccaacatggagaaaccccgtttctactaaaaatacaaaattagccgggcttggtggcacttgcctgtaattccagctactcgggaggctgaggcaggagaatcacttgaacctgggaggcgggggttgcagtgagctgagatcgcatcattgcactctaacctgggcaacaagagcaaaactccatcaaaagaaaaaaaaaatcgggtgcagtggctcatgcctgtaatcctaacactgtgggaggccaagacaggcagattgcctgagctcaggagttcgagatcagcctgggcaacatggtgaaaccctgtctctactaaaatacaaaaaattactcagcgtggtggcatgcgcctttagttccagctactcaggaggctgaggcaggagaatctcttgaacccgggaggtggaggttgcaatgagccaagatcgtgccactgcactccaacctggcaacagagcgagactccgtcttaaaaaaaaaaaaaattttgcagcgcaaaccaggatatcctctgttctcatttgttctagatttcaaaagaaacagtcctttctttggggaaaagagaaaggaaaaggagttttataaaaggaaagaaaagattcataagaacaagaagtgggcccacttgcatatacctttgtagaaaactgttcactgttgttgaagaaaagctcttcatattaatatgcagtccagatgcagtggctcacacttataatctcagccctttgggaggctgagacaggaagattacttgaggccaggagtttgaaaccagcctgggcaacatagtgagactctgtctccacaaaatttttttttaattagccgggcatggcagtgtgcttctgtagtcttagctactgaggaagctaagccagaagaatcacttgagcccaggagttcaaggctgcagtgagctatgatcataccattgcactcttgcacttgcacagagcaagaccctgtctcttaaaaaaaaaaaagtgtgtgtgtgcatatgcatatatacatatatatacatgcaaatgtatctgtttataattcagattgcttcaaaaagatgttgcactttatgatactgagaacagtgagaagtaaataagatagagtgtaggaggaggaataatttcagaacagccatctgagaacttctgtgacaacagatcaggcaaaatgaaatgtgaaagtaattttataggccaggcgtggtggctcatgcctataatcccagcactttgagtggccaaggcaggtggatcacttgaggtcaggagttcgagaccagcctggtcaacatggtgaaaccttgtctctactaaaaacacaaaaaaattagtcgagcgtggtggcatgtgcctgtaatcctagctgctggggaggctgaggcaggagaatcacttgaacccgggaggcggaggttgcagtgagcctagattgcaccactgcactccagcctgtgagacagaatgagaccctgtcttaaaaaaaaaaaaaaagtaattttataaactattgtgcacaattcgatgtattcataattaattaaatgattatttttgttggttttaacttttattcagtggctatttattgggagcctactgtgttctgggcactaggaatgcaacagtaaataagactaactaagtccctggtaggattcaggttctgtcgaggggagatacacaataaagatgaatttaagataacaataaatgctatggagaaatatacagaacagtggaatagtattagctgtcaaaggttgttgattactttcgtttaaggaggccagggaaagcctttctgaaaaaattgagctgagacctaaataacaagaaataattgtccttgaaaaatgaagggaatgcatcttataggcagaggaatagcaaacataaaggtcttgaggtaataatgagtgtggttttttgatttctgtattttggtttttttgagatggtgtctccctctatcccccaggctggagtgcagtggcacaatcttggctcactgcaaactctgtctcctgggttcaagcaattctcctgccttggcctcctgagtagctggtattacaggcacgcgtgctaccacacccgactagtttttatttttagtagagatggggttttaccacgttggtcaggctggtctcaaactcctgaactcaagtgatccaaccacctcaacctcccaaagtgctgggatcacaggtgtgagccactgtgcccggccagagcttggtttattttttaaaagataggccaatgttggtcgtgtgtggtggctcgtgcctataatcccagcactttgggaagccaaggcaggcaaatcacttgaggtcaggagttcgagaccagcctggccaacatggtgaaaccccatctctactaaaaatacaaaaaactagcatggtgtggtggtgtgtgcctgtaatcccagtgcctgtaatcccagctactccagaggctgaggcaggagaatcacttgaaccgaaaggtaggagttacagtgagccaagatcgcatcactgcactccagcctgaacgacagagcaagactcctgtctcaagaaataataatgataaaaggttcgggcacagtggctcacacctgtaattccagcactctaggaggccgaggcaggcagatcccctgaggtcaggagtttgagaccagcctggccaacgtggcaaaaccccatctctactaaaaaatgcaaaaattagctgggcacggctgggtgtggtggctcattcctgtaatcccagcactttgggaggtcaaggcggacagatcactgaggtagaaaccctgtctctactaaaaatacaaaaatttgcccagcgtggtggcgcgtgcctctaatcccagctacacgggaggctgagacaagagaatcacttcatcaacccgggaggtggaggttgtggtgagctgagatcgcaccattgcactccagcctgggcaacaagagtgaaactccatctcaaaaacaaaaaaaaattagctgggaatggtggcatgtgcctgtaatcacagctacttgggaggctggggcaggagaatcgcttgaacccaggaggcggagattgcagtgagctgagattgcgccactgcactccaggctgggcgaaagagcaagactccgtctcaaaaataataataataataataataggccagtgtagctggagtaatttgcaaattatgtgtggaggcagagattacacaaggaatgggagaaggtcatagatgagggccagatcacatagtatttggtggtaaggaattcagattttatccttgtggtaattggtggtgtggagatggttaaaaacaaggttggtttgggatgggtttgaagagaggacttgctaatggattaaatttggaggataaggtaaagagaaattgaaggagtgacacttgggttttggcttgaacaatagatcttgttagtaatattaaattagatgaagaaggcatggtagggaatatgggggagtgggaaaggcaggaagcaggaatggaaccaggaactctgttttagatgtgagaatttgttgttgttgttgttgttgttgttgttgttgttgttgttgttgtgacagcatctcgttctgttgcccaggctagagtgcatggagtgcggtagcacgatctcagctcactccaacctccgcctcccggttcaagtgattttcctgcctcagcctcccgagtagctgggattacaggcacctgccacaatgcctggctaatacttgtatttttagtagagatggggttttaccatgttggccaggctggtcttaaactcctgacctcaggtaatccacccacctcggcctcccaaagtgctgggattgcaggtgtgagccactgtgcccggccagatgcatgaattttgagatgtatactagacttctggatagagaagttaagtaggcagttggacacattgtatgaagctcaggggtacaaggaggactatgaacatgggagtcttctgacaaatttatcactagactcctcattcaagtaactaggaaatgtcagatattcttcccctagtaatagccagtggttatactcttgcctttagttttcttcacaatactcttggcaacacataaggccttccctacaatctgagtttcagtcagaattgtttctgagcgttcttcctcaaatttctccccagtctcattattctttattctcatgtccatgaccagtcataatagtaattatgaaaaacctctaactttctttagtgcattgaatgtatattttatcattttggttgtgttaactgtaaatctctcagtggaaatctgaaaagcctttatttccttagatgataatatacaattgatttaggagatagggaatttttcagttacctttataacagcacagtattagcagtctaatctaaatgctaagtgaatgttttgagaggagatagatgttgaaaattaaaatacattaagtcccagtgaggtgaaaagccgattgttaagttctgcacacaaaagatttgcttcagtgaattgatttcaacagctgagatcctagtcatttcacctggtctaccaaaaagaatgattttacttgcttttggtcaaatctctgcccagcaattctttttctttctttcttttttttgttttatgtgtgtgtgtgtgtgtgtttttttttagcagagtctcactttgtcacccaggcgggagtgtggtggtatgatcacagttcactgcagcctccaactcctgggctcaagtgatcctccagcttcagcttttcaagaaattgggactgcaggcacatgcaactatgcctggctgaggttttatgtatcttttttctagagaaggggtctcactgtgttgcccagctgggtctccagctcctggtctcaagctgtcctcctgcctcagcctcccaaagtgccaaagtgctagggttataggtgtgagccattggtgcccagctactgcctgcctggcaattctgaatgccttaaattttttttttttttttttttttttttgagacagagtttcactctgtcacccaggctggagtgcagtggcatgatcgtggctcacagcaacctctgcctcctggattccagcaattctcatgcctcagcttcccgagtagctgggactacaggtgcatgccaccacgcccagctaatttttggtttttttgtttgtttgtttgtttgttttgagacggagtctcgctcagttgcccaggctggagtgcagtggcgtgatctccgctcactgcaagctccgcctcccgggttcacgccattctcctgcctcagcctcccgagtagctgggactacaggcgcctgccactacacccggctaatttttttgtattttaagtagagacggggtttcaccgtgttagccaggatggtctcgatctcctgacctcgtgatccgcctgtctcggcctcccaaagtcctgggattacaggcgtgagccaccacacccggcctaatttttttttttttaattttatttttaattttttgagatgcgagatggagtctcgctctgttacccaggctggagtgcagtggcaccatctcagctcactgcaacctccacctcctgcattcaaaagattctcctgcctcagcctcccaagtagctgggattacaggtgcctgccaccacgcccaactaattttttgtatttttagtagagatgaggtttcaccatgttggtcagactggtgtcgaactcctgacctcaagtgatctgcctgcctcagtctcccaaagtgctaggattacaggggtgagccactgcgcctggcctgaatgccttaaatatgacgtgtctgctccacttccattgaaggaagcttctctttctcttatcctgatgggttgtgtttggtttctttcagcatgattttgaagtcagaggagatgtggtcaatggaagaaaccaccaaggtccaaagcgagcaagagaatcccaggacagaaaggtaaagctccctccctcaagttgacaaaaatctcaccccaccactctgtattccactcccctttgcagagatgggccgcttcattttgtaagacttattacatacatacacagtgctagatactttcacacaggttcttttttcactcttccatcccaaccacataaataagtattgtctctactttatgaatgataaaactaagagatttagagaggctgtgtaatttggattcccgtctcgggttcagatcttagctgataagtggaagagctgggactttaagcagatgagaatctaaagactttgctcttttcacttcactggggtgtctttctctctctctctcttgctctctctctctctttttttttttcccaagacggagtctcactccattgcccaggccagagtgcagtggtgcgatctcagctcactgaaaactcatcttgcccaggctggtcttgaacccctgaccttgtgatcctcccgccttggcctccccaagtgctgggataggcgtgagccaccgtgcccagccaataatagctaaaatttatataatgttcactgggccaggcacagcggctcgttcctgttatcccagcactttgggaagctgaggcaggcagatcgcttgagccaaggagttcgataccagcctgggcaacatggcaaaaccccatctctaccaaaaaaaatatacaaaaattagccaggcgtggtggcatgtacttgtagttccagctactcggaaggctgagttgagagtatctcttgagcccaagaagaggggactacagtgaacggagattgcgccactgcactccagcctagacgacagacagaagatctcaaaagaaaaaaaaaaaaaaaagatcactttatgctgggactgctctaaaggcccaaccatgttttaactaattaacaattttatgacaactctatgagctatgtactgtaattatgcctatattacagatgtgaaaattgaggctcagagaggttgaataagttgctcaaagtcacacaggtaataagtgatggaactagaagttgaactcaggaagtctagctccaagtctaaattctttgttaatttatttttcgggccagagtcttactctgtcacccaggctggagtgcagtgccactatctctgctcactgcaaccttcacctcccaagttcaaaccttgttcaattcttgtgccttggcctcccaagtggctaggattacaggcatgtgccacaacaactagctaattttttgtctgattctgttggccagtctggagtgcagtggcgcaatctcagctcactgcagtctccagctcccaggttcaagtgattctcgtgccttagcctcccaaatagctgggattacaggcacgtgccaccacaccgagatagttttttgtatttttaatagaaacaaggtttcaacatgttggccaggctggtctcaaattccagacctcagatcatctgcccgcctcaggctcccaaagtgctgggattacaggcatgagccactgcacccggccttaatttttatatttttattagagatggggttttgccatgttggccaggctggccttgatctcctggcctccagtgatccacccgccttggcttcccaaagtgctgggattacaagcatgagccactgcacccggcctccaattctaaactcttaacaacaatactatagtttcttgaaaagttgttgaaggcttcacggagggaaaaaaaatggagcattctaacaactttgcagatgagacccaagaagactcaatgactttctcctgatcatattgtagcagatgacttagccagaactctgacttcctcacagggagaaagtctgcaagatttcacacttacctgtcaggcctgagctggctgctttctcagctccctaagtgctatgttcccagtctgcttttcttcctttttcaagtgtgcactaccaggcatttcagaacatcccaggctggtcgcggtggctcacacctgtgatcccagcactttgggagcccaaggcgggtggatcacctgaggtcaggagttcgagaccagcctggccaacatggtgaaaccccatctctactaaaaatacaaaagttaactgggcgtggtggtaggcacctgtaatcctagctcaggattactcgggaggctgaggctagagaatcggttgaacccaggaggcggaggttgcagtgagccaagattgcgccactgcactctagcctggggacaagagggagacttcatctcaaaaaaaaaaaaaaaatcccagctgggcacagcggctcacttctgtaatcccagcactttaggaggccaaggcaggaggatcacttgagcccaggagttcaagactagcctgggcaacatagtaagaccctgtctctacaaaaaaatttaaaaattaattgggtgtcgtagcacactcttgtattcccagctactcaggaggctgaggtgagaagaatgcttgagtctgggaggtcgaggctgcagtgagccatgatggtgctactgcactccagcctggccaacattgtgagaccttgtctcaaaacaaaacaaaacatccttctactgagcactttctgtccctttatagaaacttaagagggaaccagtagaggtaatttcctaaggaaaactgctttgggacatgatcacaaatgaagcctggagttttgaactgctgaggtcagcctgtttttaccttctgagcctatcaagtaattgttccagatgccaagaaaagctgctggccttatttctgcttctgcctttaccacaggggagcgccatgtgagccagtcctctgtttttcctccactgtatgctaggcagtattagcaccagattcttcccctctttaaaaagaaattctagtgctttggattttttcctccatgcagaatagcaatgatggaaagtatgtggtcaaagtaatgacattctgaaaatactaaatgtcaccatagtatttttctctggaagagaaatgtatatgtagaggtgaaacttcaaatttctttttttttttttttaagacgaagctttgctcttcttgcccaggctgaagtacaatggcgtgatcttggctcaccgcaatctctgcctccagggttcaagtgattctcctgcctcagcctcctaagtagctaggattacaggcatgtgccaccacgcccagctgattttgtatttttagtagagatggggtttctccatgttggtcacgctggtcttgaactcccgaccccaagtgatccacccacctcggcctcccaaagtgctaggattacaggccaccgcgcccggcctgaaacttcaaatttctttttttttttgagacagagtctcgctatgtcacccaggctggagtgcagtggcgccgtctcggctcactaccagctccactccacctcctgggttcacaccattctcctgcctcagcctcccaagtagctgggactacaggtgcccgccaccatgcccagctaattttttgtatttttagtagagacgggttttcactgtgttagacgggatggtctccatctcttgacctcgtgatccgcctgcctcagcctcccaaagtgctgggattacaggcgtgagccactacgccaagcccgaaacttcaaatttcttatctcataactaggcatcctcatcactgagtgttagcctggatataaacattcctaatcttttgtacttttcatgtcagcatttggctccacttggctgcctggggagaacttctagcattatgagcatgcaggtcctatcaacaggttgggggtgcggtttattcatacaggtagtgagagtggcacagatggatgctgtcccttaaaacaaacagacttgtctttgggagcctgaggcgggtggatcatgaggtcaggagttcaagaccagcctggccaacatagtgaaaccccgtttctactaaaaatacaaaaaattagccgggtgtggtggtgtgcacctgtaatcccagctactagggaggctgaggcaggagaatcacttgaacccaggaggtggaggttgcagtgagccgagatggcaccattgcactccagcccaggcgacagtgcaagactgcgtctcaaaaaaaaaaaaaaaacacacagacttgtcctactgccatttcttttcactctggcggtaaagtaagagagtgtgtgtgtgtgtgtgtgtgtgtgtgtgtgtgtgtgtgtgtgtttctgtccgtctgtctgtcaagggggagggtgaccactttctaaaaggccatccgtgtatttttagcttcctgatttttttctctatcgcagtctctttgaagccaggtgaattttaggccttggcaattttctttttattgcaatgggaaggtcaagacactgagagtcacccaaaacatatccatccaaaatgatacaattttagggtttatttttaagtgatacccaagttatttgctaagaacctatgccagtgtgtttatgagaatttgcactgtcccacactgttgccaccagccacatgggactgtttaaatttaaattttacaaattagccagtcatggtggtgtgcacttgtagtcccagctacttaggaggctgaggcaagaggattgcttgagcccagaagttcaatactgcagcaagctatgatcgtgccactgtactccagcctgagtgacagaatgagacctcatctcttcaaaaaaaaagaaaaaaattaaaatatgaagtttagttcttcattcaccctaaccacatctccagtgctcaataactatatgtgactcatggctaccttattagcatagatatagaacattgtgactatcacagaaagttgttttgaacagtgttgccaagccctgtaagtggaagaggcagtgcagtgtgatctgtgtcttcaggaaaccaggtagtcagactagttcaatgaggagaggcagaacctggcttcacttctagattaaaaactgcttaggtggcctaaagatacaatggccattctcagagtagtgagaaggaaggaacagatgtttagggggctagaagaaagtcagagagggccgggcgcagtggcttatgcctgtaatcccagcactttggaaggccaagacaggcagatcacgaggtcaggagttcgagaccagcctgaccaacatggtgaaaccctgtctctactaaaaatacaaaaattagccgggcgtggtggtgcgcgcctgtaatcccagctactcaggaggctaaggcaggagaatcgcttgaaccctggaggcagaggttgcagtgagcccagatcgcaccactacgctccagcctaggtgacagagagagactccgtctcaaaaaaaaaaaaaaaagtcagaggagacaaggagcatgtacacctaaaatcaacatagacccctctgttgatggggtcatagtgagtacttgaggtaccaagtctggataaacatcaaacttcagccaataactttgagtttctagccatccaagcctcttattaaacatacagaaggaccttttttcccttgcatctaacaagttaaagcacctgcagagatcattagggaggagccttggcctgattggtgacaaaagtgagatgctcagtccttgaatgacaaagaatgcctgtagagtgcaggtcaactacatatgcacttcaagaagatcttctgaaatccagtagtgttctggacattggactgcttgtccctgggaagtagcagcagaaatcatcaggtggtgaacagaagaaaaagaaaagctcttcctttttgaaagtctgttttttgaataaaagccaatattcttttataactagattttccttctctccattcccctgtccctctctcttcctctcttcttccagatcttcagggggctagaaatctgttgctatgggcccttcaccaacatgcccacaggtaagagcctgggagaaccccagagttccagcaccagcctttgtcttacatagtggagtattataagcaagatcccacgatgggggttcctcagattgctgaaatgttctagaggctattctatttctctaccactctccaaacaaaacagcacctaaatgttatcctatggcaaaaaaaaactataccttgtcccccttctcaagagcatgaaggtggttaatagttaggattcagtatgttatgtgttcagatggcgttgagctgctgttagtgccaacatgttagtgagaaaatatctttggataggtaaaaatcaaggaggagttctcctcttcctaaaccatcttaatttacttacatagaagaaagcacagcagctggcccaccacggacgggcccagagcaggggaagattctcggtgaacatttctttttttttttctttttttttgaggtcgagtctctgttgcccaggccagagtgcaatggcgcgatctcggctcactgcaacctccacctcccgggttcaagtgattctcctgcctcagcctcccaaatagctgagactacaggcgtgtgccaccacgcccgactaattttttgtattttttttttagtagagacggggtttcaccgtgttagccaatatggtcccgatctcctgacctcgtgatccacccgcctcagcctcccaaagtgctaggattacaggcatgagccactgtgcccagccctctccatgaacattttctaattaaacttgacacttaatacaatgttatgcttaggactgctataaagcttacctctggagttgcgcagcacaaaggccttggtgtgtgtataaatttggtttgttcttttcacagcaaaagctacccacctttgcctcctgtgcctgcttctgcccagggacttaggtcctcttacaccttagagaaaggccttagcatctggtcacaggcagatgagtgacagcaagaaaacctggctgcaatgtaattttgtttccatcctctttattagttatcaattggatttttatgaaatttccaagttccactcaaggatttctcagtgtttttttactttggtatagtggaaaccagggttgccagaaagtattattttgggggtgagttagtcaaccttcgttcagtcagacagacaggagcacctcagcaattcccagaaacgggctgatgggaaagagcaacatacatgaatgtcttgaagaacacagccaacagagcccattgggcagttctgattttccaggtacacagcatctccacagtctcttctgatttttattcccctgagtatatggattccagctcagcatgtagcctttccctgctgagtctctaaccaggataacatgtatttttttgactggatgaattatcttcccatctcttgacatttacagtaattaccaccaagtatggtattttcagtggccgtgattatcagttaccaacacagaattaggatgaagggaggaagggagggaaggaaggtgggtgttttttcacacagtgtcttagccagcaatttagcaaattaatggaaattagatctttgatttttttttctttcaagcattttatttgagagactatcaaaccttataccaagtggccttatggagactgataaccagagtacatggcatatcagtggcaaattgacttaaaatccatacccctactattttaagaccattgtcctttggagcagagagacagactctcccattgagaggtcttgctataagccttcatccggagagtgtagggtagagggcctgggttaagtatgcagattactgcagtgattttacatctaaatgtccattttagatcaactggaatggatggtacagctgtgtggtgcttctgtggtgaaggagctttcatcattcacccttggcacagtaagtattgggtgccctgtcagagagggaggacacaatattctctcctgtgagcaagactggcacctgtcagtccctatggatgcccctactgtagcctcagaagtcttctctgcccacatacctgtgccaaaagactccatctgtaagggatgggtaaggatttgagaactgcacatattaaatatactgagggaagactttttccctctaactctttttcccatatgtccctccccctcctctctgtgactgccccagcatactgtgtttcaacaaatcatcaagaaatgatgggctggaggctgggcatggtggctcatgtctgtaatcccagcactttgggaggccgaggcaggtggatcacttgtcaggagtttgagaccagcctggccaacatggtgaaaccccatctgtactaaaaaaaaaaaaacaaaaagtagccaggcctggtggagcatgcctgtaatgccagctatttgggaagttgaggtgtgagcatcgcttgaacgtgggaggcagaggttgcagtgagccaagattgcaccactgcactccagactgggtgacagagtgagactttgtctaaaaaaaaaaaaaaagagagagagagaaaagctaggtgcggtggctcacgcctgtaatcccagcactttgggaggctgaggtgggcagatcacgaggtcaagagatcgagaccatcctggccaaccaacatggcgaaaccccgtctctactaaaaatacaaaaattagctgggcgtaggggcgcacgcctgtagtcccagctacttgaggggctggggcaggagaatcgcttgaaccccggaggcggaggttgcagtgagccaagatcgcgccactgcactccagcccgggcgacagagcgagactccgtctcaaaaaaaaagagagagagagaaatgatgggctgggccagtgccccacccctgtaatcacaacactgggaggccaaggtgggagaatcgcttgagcctgggagctgaagaccagcctgggcaatacagtaggacctcatgtctacaaaaaaattattaaaaattagccaaggctgggtgcggtggctcatgcctataatcccgggggtgaagttgagcccaggagtttgagaccagcctgggcaacatggcaaaaccctgtctctaccaaaaatacaaaaaaattagccaggggtggtggtacgtgtctgtagttccagctacttaggaggctgagatggaaggattgcttgagcccaggaggcagaggtggcagtgagctgagatcacaccactgcactccagcctgggtgacagagcaagaccctgtctcaaaaacaaacaaaaaaaatgatgaagtgacagttccagtagtcctactttgacactttgaatgctctttccttcctggggatccagggtgtccacccaattgtggttgtgcagccagatgcctggacagaggacaatggcttccatggtaaggtgcctgcatgtacctgtgctatatggggtccttttgcatgggtttggtttatcactcattacctggtgcttgagtagcacagttcttggcacattttaaatatttgttgaatgaatggctaaaatgtctttttgatgtttttattgttatttgttttatattgtaaaagtaatacatgaactgtttccatggggtgggagtaagatatgaatgttcatcacaaaaacataaatcaaggccgggcatggtggctcatgcctataattccagcactttgggaggtcaagatggaggtcaaggtgggagcctagaagttcgagaccagcctgggcaacataaggagacttcatctgtacaacaaatttaaaaagtagctgggtgtggtggcagatgcctgtagtcgcagctacttgggaagctgaggtgggaggatcacttgagctcaggaggttgatgcttcagtgagccacgatcacaccactgtactccagcctgggcgacagagcgagaccgtgtctcaaaaagaaaaaagaaagtataaatttacacaaaaacaataaaataatcccagtaattccaccacttggagatgatcaccataaaactccaccaggcatatgtgcgtatatatacacgtgtattttataaaatgtgatcataattacactgttttgcttttttccttaagatattacatacatttttccacatcgttaaattacagtgctgttttcctggtggctttcctttaacagattgaagttcatgttaatacagttgccagaggctgtgggctttcactgtcaccaggagtcactcctagggcctcttcagagcaaggccttatgtcctgaagcattgccttttttttttttttttgaggtggagtctcactctgtcacttagcaggctggagtgcagtggcccagtcttggctcactgcaacctccgcctcctgggtttaaatgattctcctgcctcagcctcagggcggatcacctgacatcaggagtttgagaccagcctggccaatatggcgaaaccccatctctactaaaaatactaaaaaaaattagccaggcatggtggcacgcacttgtagtcccagctacttgggagactgaggcaggagaatcgcttgaacccaggatgttgaggttgcagtgagctgagatcacaccatcacaatccagcctgagtgacagagtgagactccatctgaaaaaaaagaaaaaacaattagcctggcatggtggcaggcacctgtaatccctgctacttgggaggctgaggcaggagaattgcttgaacccgggaggtggaggttgcagtgagctgagatcgtgccattgcattccaggctgagcaacaagagcaagactccgtctcaaaaaaaaaaaaaaaaaaaaaaaaaggccaggtgcagtggctcacgcctgtaatcccagcactttgggaggccaaggtgggtggatcacctgaggtcaggagttccagagcagcctggccaacattgtgaaacccccgtctctactaaaaatacaaaaattagctgggtgtgatggcatgtgcctgtaattccagctactcaggaggcagagacaggagaattgcttgaacccaggaggcggaggttgaatgagccgagattgcgccatcacactctagcctcggcgacagagcaagactccgtctcaaaaaaaaaaaaaaaaaattagcttctacctcattaatcctaagaactcatacaaccaggaccctggagtcgattgattagagcctagtccaggagaatgaattgacactaatctctgcttgtgttctctgtctccagcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaaaggaaaatgaaactagaagagatttctaaaagtctgagatatatttgctagatttctaaagaatgtgttctaaaacagcagaagattttcaagaaccggtttccaaagacagtcttctaattcctcattagtaataagtaaaatgtttattgttgtagctctggtatataatccattcctcttaaaatataagacctctggcatgaatatttcatatctataaaatgacagatcccaccaggaaggaagctgttgctttctttgaggtgatttttttcctttgctccctgttgctgaaaccatacagcttcataaataattttgcttgctgaaggaagaaaaagtgtttttcataaacccattatccaggactgtttatagctgttggaaggactaggtcttccctagcccccccagtgtgcaagggcagtgaagacttgattgtacaaaatacgttttgtaaatgttgtgctgttaacactgcaaataaacttggtagcaaacacttc

SEQ ID NO: 2 - DNA, 11386 bp, Homo sapiens
gtggcgcgagcttctgaaactaggcggcagaggcggagccgctgtggcactgctgcgcctctgctgcgcctcgggtgtcttttgcggcggtgggtcgccgccgggagaagcgtgaggggacagatttgtgaccggcgcggtttttgtcagcttactccggccaaaaaagaactgcacctctggagcggacttatttaccaagcattggaggaatatcgtaggtaaaaatgcctattggatccaaagagaggccaacattttttgaaatttttaagacacgctgcaacaaagcagatttaggaccaataagtcttaattggtttgaagaactttcttcagaagctccaccctataattctgaacctgcagaagaatctgaacataaaaacaacaattacgaaccaaacctatttaaaactccacaaaggaaaccatcttataatcagctggcttcaactccaataatattcaaagagcaagggctgactctgccgctgtaccaatctcctgtaaaagaattagataaattcaaattagacttaggaaggaatgttcccaatagtagacataaaagtcttcgcacagtgaaaactaaaatggatcaagcagatgatgtttcctgtccacttctaaattcttgtcttagtgaaagtcctgttgttctacaatgtacacatgtaacaccacaaagagataagtcagtggtatgtgggagtttgtttcatacaccaaagtttgtgaagggtcgtcagacaccaaaacatatttctgaaagtctaggagctgaggtggatcctgatatgtcttggtcaagttctttagctacaccacccacccttagttctactgtgctcatagtcagaaatgaagaagcatctgaaactgtatttcctcatgatactactgctaatgtgaaaagctatttttccaatcatgatgaaagtctgaagaaaaatgatagatttatcgcttctgtgacagacagtgaaaacacaaatcaaagagaagctgcaagtcatggatttggaaaaacatcagggaattcatttaaagtaaatagctgcaaagaccacattggaaagtcaatgccaaatgtcctagaagatgaagtatatgaaacagttgtagatacctctgaagaagatagtttttcattatgtttttctaaatgtagaacaaaaaatctacaaaaagtaagaactagcaagactaggaaaaaaattttccatgaagcaaacgctgatgaatgtgaaaaatctaaaaaccaagtgaaagaaaaatactcatttgtatctgaagtggaaccaaatgatactgatccattagattcaaatgtagcaaatcagaagccctttgagagtggaagtgacaaaatctccaaggaagttgtaccgtctttggcctgtgaatggtctcaactaaccctttcaggtctaaatggagcccagatggagaaaatacccctattgcatatttcttcatgtgaccaaaatatttcagaaaaagacctattagacacagagaacaaaagaaagaaagattttcttacttcagagaattctttgccacgtatttctagcctaccaaaatcagagaagccattaaatgaggaaacagtggtaaataagagagatgaagagcagcatcttgaatctcatacagactgcattcttgcagtaaagcaggcaatatctggaacttctccagtggcttcttcatttcagggtatcaaaaagtctatattcagaataagagaatcacctaaagagactttcaatgcaagtttttcaggtcatatgactgatccaaactttaaaaaagaaactgaagcctctgaaagtggactggaaatacatactgtttgctcacagaaggaggactccttatgtccaaatttaattgataatggaagctggccagccaccaccacacagaattctgtagctttgaagaatgcaggtttaatatccactttgaaaaagaaaacaaataagtttatttatgctatacatgatgaaacatcttataaaggaaaaaaaataccgaaagaccaaaaatcagaactaattaactgttcagcccagtttgaagcaaatgcttttgaagcaccacttacatttgcaaatgctgattcaggtttattgcattcttctgtgaaaagaagctgttcacagaatgattctgaagaaccaactttgtccttaactagctcttttgggacaattctgaggaaatgttctagaaatgaaacatgttctaataatacagtaatctctcaggatcttgattataaagaagcaaaatgtaataaggaaaaactacagttatttattaccccagaagctgattctctgtcatgcctgcaggaaggacagtgtgaaaatgatccaaaaagcaaaaaagtttcagatataaaagaagaggtcttggctgcagcatgtcacccagtacaacattcaaaagtggaatacagtgatactgactttcaatcccagaaaagtcttttatatgatcatgaaaatgccagcactcttattttaactcctacttccaaggatgttctgtcaaacctagtcatgatttctagaggcaaagaatcatacaaaatgtcagacaagctcaaaggtaacaattatgaatctgatgttgaattaaccaaaaatattcccatggaaaagaatcaagatgtatgtgctttaaatgaaaattataaaaacgttgagctgttgccacctgaaaaatacatgagagtagcatcaccttcaagaaaggtacaattcaaccaaaacacaaatctaagagtaatccaaaaaaatcaagaagaaactacttcaatttcaaaaataactgtcaatccagactctgaagaacttttctcagacaatgagaataattttgtcttccaagtagctaatgaaaggaataatcttgctttaggaaatactaaggaacttcatgaaacagacttgacttgtgtaaacgaacccattttcaagaactctaccatggttttatatggagacacaggtgataaacaagcaacccaagtgtcaattaaaaaagatttggtttatgttcttgcagaggagaacaaaaatagtgtaaagcagcatataaaaatgactctaggtcaagatttaaaatcggacatctccttgaatatagataaaataccagaaaaaaataatgattacatgaacaaatgggcaggactcttaggtccaatttcaaatcacagttttggaggtagcttcagaacagcttcaaataaggaaatcaagctctctgaacataacattaagaagagcaaaatgttcttcaaagatattgaagaacaatatcctactagtttagcttgtgttgaaattgtaaataccttggcattagataatcaaaagaaactgagcaagcctcagtcaattaatactgtatctgcacatttacagagtagtgtagttgtttctgattgtaaaaatagtcatataacccctcagatgttattttccaagcaggattttaattcaaaccataatttaacacctagccaaaaggcagaaattacagaactttctactatattagaagaatcaggaagtcagtttgaatttactcagtttagaaaaccaagctacatattgcagaagagtacatttgaagtgcctgaaaaccagatgactatcttaaagaccacttctgaggaatgcagagatgctgatcttcatgtcataatgaatgccccatcgattggtcaggtagacagcagcaagcaatttgaaggtacagttgaaattaaacggaagtttgctggcctgttgaaaaatgactgtaacaaaagtgcttctggttatttaacagatgaaaatgaagtggggtttaggggcttttattctgctcatggcacaaaactgaatgtttctactgaagctctgcaaaaagctgtgaaactgtttagtgatattgagaatattagtgaggaaacttctgcagaggtacatccaataagtttatcttcaagtaaatgtcatgattctgttgtttcaatgtttaagatagaaaatcataatgataaaactgtaagtgaaaaaaataataaatgccaactgatattacaaaataatattgaaatgactactggcacttttgttgaagaaattactgaaaattacaagagaaatactgaaaatgaagataacaaatatactgctgccagtagaaattctcataacttagaatttgatggcagtgattcaagtaaaaatgatactgtttgtattcataaagatgaaacggacttgctatttactgatcagcacaacatatgtcttaaattatctggccagtttatgaaggagggaaacactcagattaaagaagatttgtcagatttaacttttttggaagttgcgaaagctcaagaagcatgtcatggtaatacttcaaataaagaacagttaactgctactaaaacggagcaaaatataaaagattttgagacttctgatacattttttcagactgcaagtgggaaaaatattagtgtcgccaaagagtcatttaataaaattgtaaatttctttgatcagaaaccagaagaattgcataacttttccttaaattctgaattacattctgacataagaaagaacaaaatggacattctaagttatgaggaaacagacatagttaaacacaaaatactgaaagaaagtgtcccagttggtactggaaatcaactagtgaccttccagggacaacccgaacgtgatgaaaagatcaaagaacctactctattgggttttcatacagctagcgggaaaaaagttaaaattgcaaaggaatctttggacaaagtgaaaaacctttttgatgaaaaagagcaaggtactagtgaaatcaccagttttagccatcaatgggcaaagaccctaaagtacagagaggcctgtaaagaccttgaattagcatgtgagaccattgagatcacagctgccccaaagtgtaaagaaatgcagaattctctcaataatgataaaaaccttgtttctattgagactgtggtgccacctaagctcttaagtgataatttatgtagacaaactgaaaatctcaaaacatcaaaaagtatctttttgaaagttaaagtacatgaaaatgtagaaaaagaaacagcaaaaagtcctgcaacttgttacacaaatcagtccccttattcagtcattgaaaattcagccttagctttttacacaagttgtagtagaaaaacttctgtgagtcagacttcattacttgaagcaaaaaaatggcttagagaaggaatatttgatggtcaaccagaaagaataaatactgcagattatgtaggaaattatttgtatgaaaataattcaaacagtactatagctgaaaatgacaaaaatcatctctccgaaaaacaagatacttatttaagtaacagtagcatgtctaacagctattcctaccattctgatgaggtatataatgattcaggatatctctcaaaaaataaacttgattctggtattgagccagtattgaagaatgttgaagatcaaaaaaacactagtttttccaaagtaatatccaatgtaaaagatgcaaatgcatacccacaaactgtaaatgaagatatttgcgttgaggaacttgtgactagctcttcaccctgcaaaaataaaaatgcagccattaaattgtccatatctaatagtaataattttgaggtagggccacctgcatttaggatagccagtggtaaaatcgtttgtgtttcacatgaaacaattaaaaaagtgaaagacatatttacagacagtttcagtaaagtaattaaggaaaacaacgagaataaatcaaaaatttgccaaacgaaaattatggcaggttgttacgaggcattggatgattcagaggatattcttcataactctctagataatgatgaatgtagcacgcattcacataaggtttttgctgacattcagagtgaagaaattttacaacataaccaaaatatgtctggattggagaaagtttctaaaatatcaccttgtgatgttagtttggaaacttcagatatatgtaaatgtagtatagggaagcttcataagtcagtctcatctgcaaatacttgtgggatttttagcacagcaagtggaaaatctgtccaggtatcagatgcttcattacaaaacgcaagacaagtgttttctgaaatagaagatagtaccaagcaagtcttttccaaagtattgtttaaaagtaacgaacattcagaccagctcacaagagaagaaaatactgctatacgtactccagaacatttaatatcccaaaaaggcttttcatataatgtggtaaattcatctgctttctctggatttagtacagcaagtggaaagcaagtttccattttagaaagttccttacacaaagttaagggagtgttagaggaatttgatttaatcagaactgagcatagtcttcactattcacctacgtctagacaaaatgtatcaaaaatacttcctcgtgttgataagagaaacccagagcactgtgtaaactcagaaatggaaaaaacctgcagtaaagaatttaaattatcaaataacttaaatgttgaaggtggttcttcagaaaataatcactctattaaagtttctccatatctctctcaatttcaacaagacaaacaacagttggtattaggaaccaaagtgtcacttgttgagaacattcatgttttgggaaaagaacaggcttcacctaaaaacgtaaaaatggaaattggtaaaactgaaactttttctgatgttcctgtgaaaacaaatatagaagtttgttctacttactccaaagattcagaaaactactttgaaacagaagcagtagaaattgctaaagcttttatggaagatgatgaactgacagattctaaactgccaagtcatgccacacattctctttttacatgtcccgaaaatgaggaaatggttttgtcaaattcaagaattggaaaaagaagaggagagccccttatcttagtgggagaaccctcaatcaaaagaaacttattaaatgaatttgacaggataatagaaaatcaagaaaaatccttaaaggcttcaaaaagcactccagatggcacaataaaagatcgaagattgtttatgcatcatgtttctttagagccgattacctgtgtaccctttcgcacaactaaggaacgtcaagagatacagaatccaaattttaccgcacctggtcaagaatttctgtctaaatctcatttgtatgaacatctgactttggaaaaatcttcaagcaatttagcagtttcaggacatccattttatcaagtttctgctacaagaaatgaaaaaatgagacacttgattactacaggcagaccaaccaaagtctttgttccaccttttaaaactaaatcacattttcacagagttgaacagtgtgttaggaatattaacttggaggaaaacagacaaaagcaaaacattgatggacatggctctgatgatagtaaaaataagattaatgacaatgagattcatcagtttaacaaaaacaactccaatcaagcagcagctgtaactttcacaaagtgtgaagaagaacctttagatttaattacaagtcttcagaatgccagagatatacaggatatgcgaattaagaagaaacaaaggcaacgcgtctttccacagccaggcagtctgtatcttgcaaaaacatccactctgcctcgaatctctctgaaagcagcagtaggaggccaagttccctctgcgtgttctcataaacagctgtatacgtatggcgtttctaaacattgcataaaaattaacagcaaaaatgcagagtcttttcagtttcacactgaagattattttggtaaggaaagtttatggactggaaaaggaatacagttggctgatggtggatggctcataccctccaatgatggaaaggctggaaaagaagaattttatagggctctgtgtgacactccaggtgtggatccaaagcttatttctagaatttgggtttataatcactatagatggatcatatggaaactggcagctatggaatgtgcctttcctaaggaatttgctaatagatgcctaagcccagaaagggtgcttcttcaactaaaatacagatatgatacggaaattgatagaagcagaagatcggctataaaaaagataatggaaagggatgacacagctgcaaaaacacttgttctctgtgtttctgacataatttcattgagcgcaaatatatctgaaacttctagcaataaaactagtagtgcagatacccaaaaagtggccattattgaacttacagatgggtggtatgctgttaaggcccagttagatcctcccctcttagctgtcttaaagaatggcagactgacagttggtcagaagattattcttcatggagcagaactggtgggctctcctgatgcctgtacacctcttgaagccccagaatctcttatgttaaagatttctgctaacagtactcggcctgctcgctggtataccaaacttggattctttcctgaccctagaccttttcctctgcccttatcatcgcttttcagtgatggaggaaatgttggttgtgttgatgtaattattcaaagagcataccctatacagtggatggagaagacatcatctggattatacatatttcgcaatgaaagagaggaagaaaaggaagcagcaaaatatgtggaggcccaacaaaagagactagaagccttattcactaaaattcaggaggaatttgaagaacatgaagaaaacacaacaaaaccatatttaccatcacgtgcactaacaagacagcaagttcgtgctttgcaagatggtgcagagctttatgaagcagtgaagaatgcagcagacccagcttaccttgagggttatttcagtgaagagcagttaagagccttgaataatcacaggcaaatgttgaatgataagaaacaagctcagatccagttggaaattaggaaggccatggaatctgctgaacaaaaggaacaaggtttatcaagggatgtcacaaccgtgtggaagttgcgtattgtaagctattcaaaaaaagaaaaagattcagttatactgagtatttggcgtccatcatcagatttatattctctgttaacagaaggaaagagatacagaatttatcatcttgcaacttcaaaatctaaaagtaaatctgaaagagctaacatacagttagcagcgacaaaaaaaactcagtatcaacaactaccggtttcagatgaaattttatttcagatttaccagccacgggagccccttcacttcagcaaatttttagatccagactttcagccatcttgttctgaggtggacctaataggatttgtcgtttctgttgtgaaaaaaacaggacttgcccctttcgtctatttgtcagacgaatgttacaatttactggcaataaagttttggatagaccttaatgaggacattattaagcctcatatgttaattgctgcaagcaacctccagtggcgaccagaatccaaatcaggccttcttactttatttgctggagatttttctgtgttttctgctagtccaaaagagggccactttcaagagacattcaacaaaatgaaaaatactgttgagaatattgacatactttgcaatgaagcagaaaacaagcttatgcatatactgcatgcaaatgatcccaagtggtccaccccaactaaagactgtacttcagggccgtacactgctcaaatcattcctggtacaggaaacaagcttctgatgtcttctcctaattgtgagatatattatcaaagtcctttatcactttgtatggccaaaaggaagtctgtttccacacctgtctcagcccagatgacttcaaagtcttgtaaaggggagaaagagattgatgaccaaaagaactgcaaaaagagaagagccttggatttcttgagtagactgcctttacctccacctgttagtcccatttgtacatttgtttctccggctgcacagaaggcatttcagccaccaaggagttgtggcaccaaatacgaaacacccataaagaaaaaagaactgaattctcctcagatgactccatttaaaaaattcaatgaaatttctcttttggaaagtaattcaatagctgacgaagaacttgcattgataaatacccaagctcttttgtctggttcaacaggagaaaaacaatttatatctgtcagtgaatccactaggactgctcccaccagttcagaagattatctcagactgaaacgacgttgtactacatctctgatcaaagaacaggagagttcccaggccagtacggaagaatgtgagaaaaataagcaggacacaattacaactaaaaaatatatctaagcatttgcaaaggcgacaataaattattgacgcttaacctttccagtttataagactggaatataatttcaaaccacacattagtacttatgttgcacaatgagaaaagaaattagtttcaaatttacctcagcgtttgtgtatcgggcaaaaatcgttttgcccgattccgtattggtatacttttgcttcagttgcatatcttaaaactaaatgtaatttattaactaatcaagaaaaacatctttggctgagctcggtggctcatgcctgtaatcccaacactttgagaagctgaggtgggaggagtgcttgaggccaggagttcaagaccagcctgggcaacatagggagacccccatctttacaaagaaaaaaaaaaggggaaaagaaaatcttttaaatctttggatttgatcactacaagtattattttacaagtgaaataaacataccattttcttttagattgtgtcattaaatggaatgaggtctcttagtacagttattttgatgcagataattccttttagtttagctactattttaggggattttttttagaggtaactcactatgaaatagttctccttaatgcaaatatgttggttctgctatagttccatcctgttcaaaagtcaggatgaatatgaagagtggtgtttccttttgagcaattcttcatccttaagtcagcatgattataagaaaaatagaaccctcagtgtaactctaattcctttttactattccagtgtgatctctgaaattaaattacttcaactaaaaattcaaatactttaaatcagaagatttcatagttaatttattttttttttcaacaaaatggtcatccaaactcaaacttgagaaaatatcttgctttcaaattggcactgatt

SEQ ID NO: 3 - DNA, 57359 bp, Homo sapiens
attggctgaaggcacttccgttgagcatctagacgtttccttggctcttctggcgccaaaatgtcgttcgtggcaggggttattcggcggctggacgagacagtggtgaaccgcatcgcggcgggggaagttatccagcggccagctaatgctatcaaagagatgattgagaactggtacggagggagtcgagccgggctcacttaagggctacgacttaacgggccgcgtcactcaatggcgcggacacgcctctttgcccgggcagaggcatgtacagcgcatgcccacaacggcggaggccgccgggttccctgacgtgccagtcaggccttctccttttccgcagaccgtgtgtttctttaccgctctcccccgagaccttttaagggttgtttggagtgtaagtggaggaatatacgtagtgttgtcttaatggtaccgttaactaagtaaggaagccacttaatttaaaattatgtatgcagaacatgcgaagttaaaagatgtataaaagcttaagatggggagaaaaaccttttttcagagggtactgtgttactgttttcttgcttttcattcattccagaaatcatctgttcacatccaaaggcacaattcattttgagtttctttcaaaacaaatcgtttgtagttttaggacaggctgatgcactttgggcttgacttctgattaccctattgttaaattagtgacccctcttagtgttttcctgtcctttatttcggaggacgcacttcgaagataccagattttatgggtcatccttggattttgaagcttataactgtgacaaaaaatgtgaagggaagagatttgaaacatgtggaaggaaaagtgagtgcagactataaacttccaaaaagacaagcccaaaatacacctaaacgttatgtcagattattttgttaaaatcagttgttagtgacgtccgtacgttaatagaaaaaagaatgcttcagtttggagtggtaggtttctagagggatttattgtgaaagtataaactattcagggcaatgggactgagagaacagtgggtagaaaggaccactgaaggaaaggaagagaattggaaggtagatgaaagaaggagcaagaacctggggatgttttttccttttcacttgtaatagtagtaacagaagcaatggcagactggcttttgtttctactgtgttagaatgaattgacaggacaactgggcctattattgtactgtgccagaatactgtaaaacaaaactaaacatactagcttggtggcttgtaattaattacttaagtggagatttttattttttttttattttttttttagacggagtctcactttgtcacccaggctggagtgcagtggcgcgatctcagctgactgcaacctcctcctcacaggttcaagggagattctcctgcctcagcctcccgagtagctaggactataggcatgtgccaccacacctggctaattttgtatttttagtagagatgggatttctccatgttggtcaggctggtgtcaaaactctcgatctcaggtgaaccgcctgcctcagccttccaaagtgctgggattacaggcgtgagccaccgcgccctgcagttttttgtatttttaatagagacagggtttcaccatgttagccaggatggtctcgatttcctgacctcaggtgatctgcccgctttggcctcccaaagtgctgggattacaagcatgagccaccgcgcccggctcaagtggagatttttatatggagtccagttatactctttttaatatataagttgagatgactaatacaacttcaatacaggggctcatgagaaatgtctgtaatatttaagtaacttattgtcttctttcttttttttttaagatgaagtcttactctgttgcccaggcggaagtgcagtggcgtgatcttggctcagggcaacctctgcctcctggtttcaagcgatcttcctgcctcagcctcccgagtagctgggagtacaggcgtgcatgaccacacccggctaatttttttatttttagtagagacggggtttctccatgttggccgggctggtcttgaactcctgacctcaggtgatccgcccacctcagcctccccaagtgttgggattacaggtgtgagcccccgtgcccagcctattatcttatttctgaataaagaattgtctgtgtggggaatagataactctttctcatgcagcccctgctagaaaatttgttttctctagcagttggtctgtgcttataggctactctttgaaagcacaaaaaatttattgacttcttttttttgggtttttttttttttttgagacagagttttgcccttgttgcccaggttggagtgcaatggcgcgatctcagctcaccgcaacctccacctcctgggttcaagtgattctcctgccttagcctcctgagtagctgggattacaggcatgcgtcaccatgcctggctaattttgtatttttagtacaaatggggtttctccatgttggtcaggctggtctcaaactcctgacctcaggtgatccacccgccttggcctcccaaagtgctgggattatgggtgtgagccattgcgcctggccagaaaattcattgacttcctaaagatttattaactttctgcattacttttttttttcccctccatcgtaaatataaaagggaatagtagagaaaatcattcagaattttattttttagtgacattatttagtgacattttattagagtcacttaggaacctgaggctgaataaagttcaggtaaaagtaaaattagttgagaagagacatctgccaaaagaaatctatttttaacttcacttgctgtctttcctagaggaacagaaatagtgctgaatgtcctattagaaatgatggttgctctgcccgtctcttccctctctctcacacaatatgtaaactcatacagtgtatgagcctgtaagacaaaggaaaaacacgttaatgaggcactattgtttgtatttggagtttgttatcattgcttggctcatattaaaatatgtacattagagtagttgcagactgataaattattttctgtttgatttgccagtttagatgcaaaatccacaagtattcaagtgattgttaaagagggaggcctgaagttgattcagatccaagacaatggcaccgggatcagggtaagtaaaacctcaaagtagcaggatgtttgtgcgcttcatggaagagtcaggacctttctctgttctggaaactaggcttttgcagatgggattttttcactgaaaaattcaacaccaacaataaatatttattgagtacctattatttgctgggcactgttcaggggatgtgtcagtgaataaaatagattaaaatctattctcttctgatgcttacattatagtggtgggagacaaaatgggtataataaatattatattagatagcattaagtgctgtggagaaaactaaagcagggaggaagataggagtgtgcaagccagaaaggttgcaattaaattgagtagttcaggaaggcttcaatatggatgtgatatttgagagaccggtggaagtcaaggagcaagttgtgaggctatttaaaggtattcttggcttacagaacaatatacgcaaagactattaaatggaagcatacctgacatgttaaaggactatcaaggaggccagtttgtctagaggctgaaaaggaaagagtaataggagatgaggtctgagtgaaaacacgtaaatccttgtgggccaaggtaaaatctttagctttttttctgaatatggtgggatactgttagagggttttaagcagaggttacgtggtgtggtgagttttttttttttaatcctttgtctttctgtgtggaaaatagcaggacagggcagaagcagtctgtcctgcagactgcttggtcgcagtagagatgtaagaagcagtgagattctgggttaattatggaggcaaagttctcagaatttgctgatatagggtatgagagaaagaggaatcaggaatgatttcaaggttttggtctgctaaatggaaggagttgccatttactaagatgggaaagactatgaaagaagcagattttcagagagatcagaagttcattttggggcatgttcaatttaagatgcctgttagttggatgtttatgtgagtttggaatgcagggtagagatttagggatgaatatttggtagttgtctgcattttaatggtattaaaagccacgagaaggatgggcatggtggctcacacctgtaatcccagcactttgggaggccaaggcgggcagatcacctgaggtcgggagttcgagaccagcctgaccaacatggagaaaccccatctctactaaaaatatataattagccgggcgtggtggcacatgcctgtaatcccagctactcgggaggctgaggcaggagaatcgcttgaacctgggaggtggaggttgcgatgagccgagatcgcaccgttgcactccagcttgggcaacaagagcaaaactccatcaaaaaaaaaaaaaaaaaaaaaaaaaagccttgagactcacctgaaaagatgctcaacattattggtcattaggaaaatgaatgaaaaccacaatgagataccacttcacacctattaggatggctattatcaaaaacaaaaacaagtgtttgcaaggatgtagagattggaattcttgtgtattgctagagggaatgtaaaatagtgcagggtgctgtggaaaatgctgtggtgattcctcaaaaaattaaacataattatataatccagtaattccacttctgagttattcccaaaagaagggatgcaagcagatatttgtacactcatattcatggcagcattatttacagtagccaaaaggtgaaagcaacctaagtgtccgtcagtggatgaatggataaacaaaatggaataatttcagccttaaatagaaataaaatgttgacacatgttgcaacatatacgaaccttgaagacatcatgttaagttaaataagttggtcactaaaggacaaatattgtatgattccccttatgaggttcctagagtagtcacattcatagagacagtagagtggtggttgcccagggccggggggagcgaggagaatggaaattattgtttattgggtacagagtttctgtttggggaagatgaaaaaattctggagatggatcatgatgatagttaacacagcagtgtgaatatagttaatggcacagaactgtacatttaaaaatggttaagatggaaaattttctgttacatatattttactgcaatttttttaaattttattattatactttaagttttagggtacatgtgcacaacatgcaggtttgttacatatgtatacatgtgccatgttggtgtgctgcacccattaagtcatcatttagcattaggtatatctcctaatgctatccctcccccctcccccaccccacaacagtccccagtgtgtgatgttcccctttctgtgtccatgtgttctcattgttcaattcccacctatgagtgagcacatgcagtgtttggttttttgtccttgtgatagtttgctgagaatgatggtttccagcttcatccatgtccctgcaaaggacatgaactcatcattttttgtggctgcatagtattccatggtgtatatgtgccaccttttcttaatccagtctatcattgttggacatttgggttggttccaagtctttgctgttgcgaatagtgctgcagtaaacatacgtgtgcatgtgtctttatagcagcatgatttataatcctttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaagatcgccattctaactggtgtgagatggtatctcattgtggttttgatttgcatttctctgatggccagtgatgatgagcatttcttcatgtgttttttggctgcataaatgtcttctttcgagaagtgtctgttcatatccttcactcactttttgatggggttgtttgtttttttcttgtaaatttgagttcattgaaaaattagaatttttttttttttcccttttttagaggcaaggtctcactctgtcgcccacactggagtgcagtagtgtaagcatagctcactgtaaccttgaactcctgggctcaagcaattctgtcatctcagccagctgaagtagtaactgtaggttcacaccaccatgcctatttttgtttttgtagaaatagggccttgctttgttgccaaggctggtcttgaactcctgacctcaagcagtcctcctgtctcagcctcccaaagtgctgggattataggtgtgagccactgcacccagccttggagatttttaataaagaagcttgtcaattaaacaaacaacaaaaagccctgagactgaatgagataatcaagagagtatgtgtagatagagaagaggtccaaggaaggagtcttgggtgactctgatgtcaagtgaggacatgaggcagaaacagcagtgactgagaaggagccacctagtaagaaaggaggaacaccaggacagtgtggtattctggattccaaacaaggaagttactgctaattttaaagctcttctcaggctgggcatggtggctcacacctgtagtcccagcacttcgggaggctgaggtaggtaaatcacttgagctcatgtgtttgagaccagcttgggcaacatggtgaaacctcatctctactaaaaatataagaaattaaggccaggtgtggtagttcatgcctgtaatcccagtgctttgggaggtcaaggcagccagatcatttgagatcaggagttcgagaccagcatggccagcatagtgaagccccatctctactaaaaatacaagaaaaaattaaccaagcatggtggcgcatacctgtaatcccagccactctggaggctgagacatgaaaattgcttgaacccgggaggcggaggttgcagtgagctgagatctcgccactgcacttcagcctgggtgacagagcaagactctgtctcaaaggaggttgcagtgagctgagatctcgccactgcacttcagcctgggtgacagagcaagactctgtctcaaaaaaaaaaaaaacaaaaaccaagaaaagaaaaaaaaactcttctaagaggatttttttttcctggattaaatcaagaaaatgggaattcaaagagatttggaaaaatgagtaacatgattatttactcatctttttggtatctaacagaaagaagatctggatattgtatgtgaaaggttcactactagtaaactgcagtcctttgaggatttagccagtatttctacctatggctttcgaggtgaggtaagctaaagattcaagaaatgtgtaaaatatcctcctgtgatgacattgtctgtcatttgttagtatgtatttctcaacatagataaataaggtttggtaccttttacttgttaaatgtatgcaaatctgagcaaacttaatgaactttaactttcaaagactgagaattgttcataaataaactattttacctgcagagacctctgatatatgtttcttgatggaagtacccagtaccacctatgaagttttcttgtcaaaaaatcaaatgtgaatctgatcattacttagatctaagtaccaatatatgaaaaatataggagacaaggaagcatggtaaatgatactgagattgggagactacatggaaaaagacttgttcccttcaacagatagacagcagggaaaaaagaatagagaaaggagtaaagaacctgtagattaaaagacatttaagggacatatgaaccaggtccagtgtatagatcttacctaaatcctgatggagcaaactataaaaaaatttttttgagacaaatgtttgaatacaggttgactatttgatggcattaaggagaaattatgaattatcttggtataagaatattgtcatgggtttttttttttgagtccttacctgttaagatacatactaaaatatttgtgggtaaaattatatgacgtataggagtatatgatttagaaaacggattaaaatataaaaggataaaataggatcttatattttgtgactcacttcctgttggatatctttctacccagtaaatatagtcctatctaggttttaatggctacatgtatgtactgtagtttgtttaaatggtttcctattgaacatttatgctctttgccattttttcctgtttaacgttctgtttttttttttgtttttttttttttttgagacagtcttgctctgttatccagactggagtgcagtgacatgatctcagctcactgcaacctctgccttctgggttcaagctattctcctgcctcagcctcctgaatagctgtgattacaggcgtgcaccactatgcccagctaatttttgtattttgggtagagacagggtttggccatgttggccaggctggtcttgaactcctgaccttgaatgatctgcccgccttggccttgcaaagtgctggggttacaggcatgagccaccacgtctggccttgtttaaggtcctgatgagtattcttataggtacactgtgtttcgtttaattatttccttaggataaatttatagaaataacattccttggtaaaagaatacatattttaaaaactgtattagtttcctgttgctgtcaaaaaatttccagaaacttagtggcattaaacaatacaaattaattattctacagttctggagatcagaagatacgggtcttactaggcctcactaggctaaaatcaaggttttggcagggctgtgttcctctatggaggttccaagggaccagagaaactactttacagtagttattttaagggaatgaaagtgaagatggggttgggcagtcaaagaggctgttacttttcatttttggcctttcagtagtttgaatttttttatcatatacatgtattactttaatttttaaaaagtaaaaagcagctgtgattcagtctctgtaatttagatcaatttacatcaaactagggtggtctcatgtgttgtcttgctcacagtgaccactagattattccaagaagggacaatttccaagacttggtttacactgagacggctcctgattttaaggataccttagatcaaactctaggaaggcagtttcattttggccttgcagttccctgggtcattttccaagcccatggcctcctggagtcttcgcctagctgtaggttatctttgtggctattatttcactgtaattatacaggaagatttattgagggatttctgtgtaccagccgtggttctcagcactttgtatactttgtattaactctgactcctgacagtaactctacagaggttctgctgttacccagttttacatagaaacatggccagcggacgcagttagaaaatggcaaagtggggattagaaactaggcagtttgactccagagtctgtgcccctgtccacttggctccactgctggggaagaggcctctgaagcagcaggaccatctgctgtgccgtgtgtagtggtactctatcttcctggtgtgatgttgtgttctactttgcattttcatgtctttccttatacaggtctcaaaatcatttacttttttttttttttttttgagacggagtctcactctgttgcccaggctagagtgtagtggcatagtctcactcactgcaacctccgcctccgaggttcaagtaattctcctgcctcagcctcccaagtagctcggattacaggcacatgccaccacagctagcaaatttttgtatttttagtagagattggtgtttcaccatgttggccaggctgttcttgaactcctgacctcaggtgatccacccacctaggcctcccaaagtgctgggattacaggcgtgagccaccccacccagccttatattttttaatgatgcacattagctcaattacataaaccagggaaatccagctaggacctggtgatttctgagcctgacccatgtgactttcaatgaactgaacttgccacagctgtatttactgtctactgagatgctgtcacacagaccccgtcatagcacagttcctgagttacatctttacatactgtagtatccttcttgtgaaaaaagatacagattccaaaggtctgagaaaccaatcttggttataaaggggaaaaatggtcatgggtttttaaaatttgttttgtcttaattgcatttcaaatttacatttctaaatgaataattgcttatataaagcagttttgattaacaatataaaacactatctatttggagtgattcctttacccatttctgaaggcaagttttaaaaattactagaagacacttcattgagaatattattaaacatgcctatagttctaccacctcaacacaattgcttattaacacattaatgttttggtgtgttttggactttttaatatgtatttttcacttgttctagtaattatgctacagattgatcatttctttttcaacatgtcatcaaagcaagtgagcaaagtgctcatcgttgccacatattaatacaaaatggaagcagcagttcagataacctttccctttggtgaggtgacagtgggtgacccagcagtgagtttttctttcagtctattttcttttcttccttaggctttggccagcataagccatgtggctcatgttactattacaacgaaaacagctgatggaaagtgtgcatacaggtatagtgctgacttcttttactcatatatattcattctgaaatgtattttttgcctaggtctcagagtaatcctgtctcaacaccagtgttatcttttttggcagagatcttgagtacgttttcttttctccttattgataaattgataatcctcaaggatgattattaggtgatactcttacttcatggattcttaaaagatatgatttaacatattacaagtgcctagcaaggtgtctgttacacgtaggtattttaagtaaatggtagctgctgatgtaatttctgcccctttgcccttcagttggggtattgctttggaccgattagagggctgtggctgggatgctaaaggttcatgtttccttagctggctcctgagccaccagctcccaccacctgtgtatacctgtgctagtttgccttcccacaagtagctgctggctatctgttatgctggtacagttttcagaaactgatgaatggcctttgaacagaacaaaaatgagattcagaataacaaaattgcacctttgtttttataagcactggccattcactagttgaagactggtaggaatacctaattcatgccaaaagaaagataatttttaaaaatcacacaggttgtttgtagattaaaagggaaaataggctaggtatagtggctttgcctgtgagtttgggaggctgaagtgggaggattgcttgaagtcaggagtttgagaccagcctgggaaacagagcaagaccccgtctctacagaaaatttttaaaaaattagctgggcatggtgatgcatatctgtagtcttagctactccggaggtgggaagattgcttgagcccagcagtttgaggctgcagtgagctgtgattacaccactgtactccaaccttaaaataaataaataaataagggaaaatatcttcaacaaaggatagttctgtctgtttctcagtcttcctcaacagataaatgtgtgaagtaatggaaggtggagatttcagattacacaacattaatgctaagggcgtttgactctgtgtgaattctaattgccctagatctagacgggctgatactattagaatcccctgtcactaactgaagacagagttgtaagttaatgccttcctagatagcctagattgtggtatgctgctgcatgctaaaatggctccccttccatagcaggatgaaatagagtcattatcttggcaaccagcccctgccaatgtgctctcagtctgcctttccagccccttctctctacctattcccagctgccatgtattctaaagcctctatgctttcatttttgtttttgccttcctggatggtctttcctgctgtctccacctgaaactattcctctctaaagaacagatgaattgccatctctctgggatgcttttacccaccctcactcccacctcaggctgaatggacccttctctagatcgcttagcatattgttctacagttaggtaaaaagtctacctatcactagatcaagagctttgtttttttttattaatttaattttcttttttttttttcttttttttttgagacagagtctcgctctgtcgcccaggctggagtgcagtgcacaatcttggctcactgcaagctccgcctcccaggttcacaccattctcctgcctcagcctcccgagtagccgggactacaggcgcccaccaccacgcccagctaattttttgtatttttagtagagacggggtttcaccatgttagttagccaggatggtctcgatctcctgacctcgtgatccacccacctcggcctcccaaagcactgggattacaggcatgagccaccgcgccgagccccaagacctttctttattaccagggcttccacagacctgacacatggtagttcctcaataaataattgcagaattactgaaaaattttactgttaacttaggcagtggtaaaaccattgtttggtagctcagaactcagcaagtaaatagcaacatttgctggaagaacagatagtttttcaaatccaattcaaggactgggtatggtggctcatgcctgtaatcccagcactttgggaggccgaggcaggcgtatccaggagttcgagactagcctgaccaacatggtgaaactccgtctctactaaaaatacaaaattagccaggtgtggtggtgggcacctgtaatctcagctacttgggaggctgaggcaggagaatcgcttgaacctggtaggcggaggttgtagtgagctgagattgtgccattgctctccagcctgggaaacaagagcaaaactccgtctcaaaaaaaaaaaaaatccaattcaaatgattatggaagtagtggagaaataaacaggaaaatgataaataattaagataatatataatatggctatattttaatctattgttgatatgattttctcttttccccttgggattagtatctatctctctactggatattaatttgttatattttctcattagagcaagttactcagatggaaaactgaaagcccctcctaaaccatgtgctggcaatcaagggacccagatcacggtaagaatggtacatgggagagtaaattgttgaagctttgtttgtataaatattggaataaaaaataaaattgcttctaagttttcagggtaataataaaatgaatttgcactagttaatggaggtcccaagatatcctctaagcaagataaatgactattggcttttgtggcatggcagcctgccacgtccttgtcttttttaagggctaggagattctttattgggatggcaaaagtcaatggcagggtagttgtcattgaaagaagattaagcttgaccccagaaggcatgggttagagcccagccttgtcactcaatggttgtatgtccagaggcaagtcacttaacatcccttaaccccagttttctcatctgtcaaatgaagcaaagaatacttgccctcttgacttaaagggtgtctgatgagacatatgactgtatcattagctgggagaaagtccatcgtgctgcctatgtatagtgcctcaagttggtctctttcccttctatgattacacaaagcactccgctgtcatgttatccatcccgcccctccattccaagtcccatctagagcacatcttcttgaagtccactgtaacctgcctaatcctggatgtgacgagccaggcaggaggcagaaaagaatgtgtgttttgcaatacatgttaagagacatcttgggctgggcacggtggctcacacctgtaatctcagcactttgggaggctgaggagggcggatcatctgaggttgggagttcgagaccagcctgaccaacatggagaaaccccatctctactaaaaatacaaaattagccaggcgtgatggcgcatgcctgtaatcccagctactcaggaaggctgaggcaggagaattgcttgaacccgggaggcagaggttgtggtgagttgagatcatgccactgcactccagcctgggcaacaagagtgaaacagggtctcaaaaacaaaaacaaacaaacaaaaaaaatcttttaccacggtgaccaccatgtgatttccaagaacttcaaatgatctaagaaattttgtgattattactagtttgaaaaatactttttttttttttgagacaaagtctcactctgttgcccaggctgaagtgcagtggtgtgatctcagctcactgcaatcactacctcttgagttcaagcagttgtcctgcctcagcctcttgagtacctgggattacaggcatgcgtcaccatgcccggctaatttttgtatttttagtagagacagggtttcaccatgttggccaggctggtctcgaactcctgacctcaggtgacccacccaccttggcctcccaaagttctgggattacagacgtgagccactgcacccagcctgaaaaatatctttgaatgccatgtgatactatacttgtcagtttacatgtgtgtcccactaaatcatgtactctcctgagcaggatcatgctttgtcttcatattttctgtacaaagcaaagactctgacacaaagctagcccccagtgcatagttgagaaatcagtgaatgaatgtgggaggcaggaaaaatgtcctttaattcttctgttaatgctgtcttatccctggccccagtcagtgcttagaactgtgctgttggtaaatataattggattcactatcttaagacctcgcttttgccaggacatcttgggttttattttcaagtacttctatgaatttacaagaaaaatcaatcttctgttcaggtggaggaccttttttacaacatagccacgaggagaaaagctttaaaaaatccaagtgaagaatatgggaaaattttggaagttgttggcaggtacagtccaaaatctgggagtgggtctctgagatttgtcatcaaagtaatgtgttctagtgctcatacattgaacagttgctgagctagatggtgaaaagtaaaactagcttacagatagtttctggtcaaggtttagccaccaattttgcagtttctctcatctccccaggaaagagcagttggtctttagatcaatgagagctcttttatggcagacaaaacaaagtgactctagccaacttgagctaaaaagaaatttagtggaaggctaggagttaccacatgaagtgtgtgcagctgccccttggagagaataagaaccagggtgcctctgggacttaacatcattactgtactccagttgttttcattcttttcctgactttgctctagagtcagtttcctaacagagtacattcgatgatcatgtgcccatatctgtggggagaagatttcttgattggcagtcttactaagggtgcatatcaagtagaatggaatagaggtagtttcctaaaggaagatgagaggctgttaccaggaggaggagaagggattcaggacagatgaaaacaacgttatatccatgatagacttacgctgctggtacagatggtacaggtggcttcagtataggctctccgaacccacatatcattgattatgatagggatatgttaactatttttcagtgtatatatgtatatgtgtgtgtgtatatatatgtatatgtatatatatatgtatgtgtatatatgtatatgtatatatttatatatgtatatgtatatatttatatatgtatatgtatatatttatatatgtatatgtatatatatttatatatgtatatgtgtgtatatatatatttatatatatgtatatgtgtgtatatatatatatttttttttgaaacggaatttcgctcttgttgcccaggctggagtgcaatggtgcgatctcagctcactgcaacctctgcctcctgggttcaagcgattctcctgtctcagcctcccgagtagctgggattacaggcacttgccaccatgcccggcaattttttttttgtttttttttagtagagagggggtttaatcattttggccaggctggtcttgaactcctgacctcaggtgatctgcctgccttggcctcctaaagtgctgggattacaggcgtgagccaccatgcctggccatttttcagtatttcttttttttttttttttttttttttttttgagacagagtttcactcttgttgcacaggctggagtacaatggtgtgatctcggctcaccgcaacctctacttcccaggttcaagcaattcgcctgcctcagccttctcaagtagctgggattacaggcatatgccaccatgcccggctaattttgtgtttttagtagagatggggtttctccatgttggtcaggctagtctcaaactcccgacctcagatgatcctcccgccttggcctcccagagtgctgggattactggcatgagccagcgctcctggcccatttttcagtatttctaaaaaaaatctaaagtgggtcaaacatttcaccttaatagaatgacaggtttgtacatcaagtttctttgctttttcttggaattttatactttttttttttttttggagacagagtcttgctgtgttacccaggctggagtgcagtggtgcgatctcagctcaccacaacctccacctccaggttgaagcaattctcctacctcagcctcctgagtagctgggattacaggcacatgccaccacacccggctaattttttttttttttttgtatttttagtagagacagggtttcaccatgttgtccaggctggtctcgaactcctgacctcaggtgatccgcccatctcggcccaccaaagtgctgggattacaggcgtgagccactgcacccggcctttttcttggaattttatcaatcagtgtcagaatattcattacctcctaaaaataaaggagttctagttggctgttttgattctaggtgtggtaaagtgaaatattgttacttaataaatgcattttgctagacacaatccttcggttcacgagctctgtagagaaaagagaaataaccgccaaccaagaaaagattgggagatactagaataagacccaggggcaggaagaagccagtgagaaggagggcatgttgagagctctgagagagaataaaagcaggggttgttggagctagcttctcaagatgtccttgaggcaaaccagacctttgggacactctgaaaataaaactgaaagtgaagagattgtgggccgaatgtggtggctcacgcctgtaatcccagcactttgggaggtcgaggcgggtggatcacctgagatcaggagttcgataccagcctggccaacatggcgaaacgccatctctactaaaaatacaaaaaaaattagctgggcctggtggcaggcgcctataatcccagctactcgggaggctgaggcgggagaatcgcttgagtccaggaggcggaggttgcagtgagctgagatcgtgccattgcactccagcctgggcaacaagagcaaaactctgtctcaaaaataaataaaaataaataaaaaagagatagtggcgtgatatccttgattctatcagcaacctataaaagtagagaggagtctgtgttttgattcagtcacctttagcatttttatttccatgaagtttctgctggtttatttttctgtgggtaaaatattaataggctgtatggagatatttttctttatatgtacctttgtttagattactcaactccactaatttatttaactaaaagggggctctgacatctagtgtgtgtttttggcaactcttttcttactcttttgtttttcttttccaggtattcagtacacaatgcaggcattagtttctcagttaaaaaagtaagttcttggtttatgggggatggttttgttttatgaaaagaaaaaaggggatttttaatagtttgctggtggagataaggttatgatgtttcagtctcagccatgagacaataaatccttgtgtcttctgctgtttgtttatcagcaaggagagacagtagctgatgttaggacactacccaatgcctcaaccgtggacaatattcgctccatctttggaaatgctgttagtcggtatgtcgataacctatataaaaaaatcttttacatttattatcttggtttatcattccatcacattattttggaacctttcaagatattatgtgtgttaagagtttgctttagtcaaatacacaggcttgttttatgcttcagatttgttaatggagttcttatttcacgtaatcaacactttctaggtgtatgtaatctcctagattctgtggcgtgaatcatgtgttctttcaaggtcttagtcttgaaaatatttatagtgtagtagaactattttatcctccaatgctccttcttttccttgtatttccattatcatcactttaggatttcacttatttatcattcaacatttattaattgcctctcatattccaggctttgtgctagaagttagggatataaagacaaataagatatttcctgcccttaaagactagattcgtgttgctaagtcttcattatcaagaaaagcataagtggggaaaagtgcttgcattatggattcctcatagttgctcccctctgcatgtaaaaatcaccatttccatcatagattcctagcggtctcaggactttataaagcccaaagtgcctatgtcataatatgaggaaaaatactgagacccttccatatatgggaggtatatggatgagacagctcctgacttcacttttcccagaaatctgaaaagcagcagcagtcattccagagcccagtttctactttgaagggcagattatttattctttgagctaacctgactgaggaacaattagtttgcttttaatttactattttctttttcttttcttttcttttttgagacagagtctcactctgttgcctaggctggagtgcagtggctcaaacttggctcactgcaagctccgcctcccgggttcacgccattctcctgcctcagcctcccgagtagctgggactacaggcgcctgtcaccacacccagctaattttttgtattttttagtagagacggggtttcatcgtgttagccaggatgatctcgatctccagacctcgtgatccacccacctcggcctcccaaagtgctgggattacaggcgtgagccaccgtgcccagccactattttctttctaattgttaatgaattaattttttaaaactgtgctcctagagcgaagggagagctctgtttacagtgtaacttttcagagcttctttaactagattttaagatcagaattagttgttgtgaaatcttagggactgtacaagattagaaatcctctatagcagcatttcccaaagcaggcttccagaacactagcctcatgaggcattttgggaaaaaagagtttgctggttcagtgtgtatgggcagtgccacaagccgtaccctccgttgaagacactcattccacacattactgcataaaaagcttccaccagccattcggcaaacttattgagtgtctgctatttcctgggtattgtgctatatggtagggttatagtagtgaacaaagaagaaatgatgcctgctctcagctgactttgcagttggaaagacacatgaaataattacgccattcattagcagattgtgctagatgcctcactggaaaaataaaggacatgatggaaaactctgtagggtcagagaaagggatcattagagaaggttctttgaagaaatattttttgaaatatgaaggataaataggaattaactaggtaccaataggttaggagtagagctttccagacagagggactagttcttgggaaggtctccagacagaaataagtgtggcttgtctgaggacctcttattcgcctattaaccttccctccccagtaaacactcctgggaacaacacacattgtagaaccacgttgtggtgctgttcagtatagcaagtaattcagcagagataagttcttggaatctcatctttgggatttagttactaagatacattcaagtttgagcaaaataaggtctcagagcttggattcattgttctgttccagcaattagagcagtacctggcacatagcacaagtgcttgaaaacactgactgagtagggtaggtgggtgagtgggtgggtgggtgggtgggtggatggatggatgggaggatgggtgggtgaatgggtgaacagacaaatggatggatgaatggacaggcacaggaggacctcaaatggaccaagtcttcggggccctcatttcacaaagttagtttatgggaaggaaccttgtgtttttaaattctgattcttttgtaatgtttgagttttgagtattttcaaaagcttcagaatctcttttctaatagagaactgatagaaattggatgtgaggataaaaccctagccttcaaaatgaatggttacatatccaatgcaaactactcagtgaagaagtgcatcttcttactcttcatcaaccgtaagttaaaaagaaccacatgggaaatccactcacaggaaacacccacagggaattttatgggaccatggaaaaatttctgatccataggtttgattaaacatggagaaacctcatggcaaagtttggttttattgggaagcatgtataatttttgtcctaagtctgtgctcagccctcccacatgtgctcattgctggttgactgttggagtctggttcttacctctaagaggaagcccaggagagggcataaagccagcacactgtcctcacctgatggtgtcagagtccttacgagtaagccctagccagaacattgctggaagagatcaagggccactgtttgaaattgcacagcaggatacggaaaaggggtaccttaggtataggcattgtcattaaagaaattgctaagatacttgagattttcctgtttaaggaatgagctttatgatacaaagagcagttctaaaaattagggagggaattaactaaattaattaggatatttctcaaattcctttacagtttttgtctctctgctgatatagtgtttacatgattgttatttactaaacaaatgctattttgtattgtgctccttataacttaattgtttattacaaggttttgatggtgacctaccaacaacaagtaatcccaaacacagtctgaattttttgttttccatccagaaataagatgaatctttccatttccgtgttttcagttttcatcatttttatcctataggttacttatctttattttaaagcatttcataataattttatagtttttgttttgtttgcttgtttgctgttggaaatggaatattccctccttccatttagactgctaaccagctgtaaatgtttcaaaatatgcatgttttacagcagttgttcaaagcaatacaggaacagtaaggacagagccagtcattttacaaccacattctgttaaactgatgtctattagcagggtttttcctattttattaggaaggacttacacctgatatataacaaagcttgttttaatcaaggctcagaaaatgtttttcattagtttttttcctaaccatgaagaataactgctttgtaacacacatgctggctataaagcagacaaaaaattcactgtaggtgctgcctgactggcctctgtccgtgtttctgttggggctgcttaccacagcctctgcattatcattagctagtgtgttcacaataccaagttcccagtagcaaagaaaggtcaagctcttacgcatgccattcatttatctacactgtgcaggcgcactcaggtggcagggacaaagaccactcctttggcgcatctcaagttcagaattctcagtagaggggctccagctgtccttttgtcaggtgcccatgcctgctccaggcctgtgtggtcaggacacgtgttacagagtacagtgacattaatgatggggccatggatatggtcagcactcagaggatgttagtctcttcattgataaagtcacaaccacttttcctgttggaaataaaaagatttgacgtatccttgtctacagcaacacaggacaacagataatcagcaggtcatctaaatctgttcagagagaaaggagagctgtttcctgaaaatacatcttcccctgattttagtcttatttttttctgcctttattgctttctaccctcttcaaaccagcctcatttcctaaattaccttgaatatgcattgacacttgtactgcctgaaattctggaaaactcagtatggctactccaccgtcagaacttcctgagcaaagttagttgctctctcggctcactgttttgttttgttttgttttcctgcctcaggtttatttgtacaaatagcacaggaggaccagccccatgcagatggtagcccaggggcgggggtagggggtcacaccagtccttctgtcctcatgttggcagagatatctactctgaagcctttgtaggggcctgggcacctttgggagcctgagctggaactgaaggtggagctgcagcctgggccttggtttgatccttggccttggcctttggccggcacagcctgagccccttggcaatacgggcacgagcacgcttcccaagcttgggatgggcaatgtaggcaagtcgatcgagcttgcggctgacaccctttgggatcttgggcttaacctccttgggctttacgagggccttgatagcctcggcacgtgcactcatggccttggcattgttggcctgcatcttctttaggcccttcttgttgtgcttcttggcaaagtgcatgttcctcaggaacttggggtccacccccttaagagattcgtatctttgtgatcggggtttcttgataccatttctgtgccattttcgggactggttgtgtgtggtgtggttcttggacttcgccatgtctacaccttaagccgcggctcccgaagcacctagaaccggaagagttggctcactatttagcacacacacacgtctataatagtgctggccacttggggttggaattagtttatttatcagcatgttgtctcccagcacttggtgtgtgtgatatgcagtatgtatttgcagaatgaaaagtctgagggctgacatcatatttcccactgtgcccagaaagagcacagttagtccacatgagctaatgggggcaaagggaagtgaggagggagaatgtactgccttatcatgttttctattacttggctgaagtaaaacagtcccaagccgatagtaagatagtgggctggaaagtggcgacaggtaaaggtgcacctttcttcctggggatgtgatgtgcatatcactacagaaatgtctttcctgaggtgatttcatgactttgtgtgaatgtacacctgtgacctcacccctcaggacagttttgaactggttgctttctttttattgtttagatcgtctggtagaatcaacttccttgagaaaagccatagaaacagtgtatgcagcctatttgcccaaaaacacacacccattcctgtacctcaggtaatgtagcaccaaactcctcaaccaagactcacaaggaacagatgttctatcaggctctcctctttgaaagagatgagcatgctaatagtacaatcagagtgaatcccatacaccactggcaaaaggatgttctgtcccttcttacaggtacaaggcacagttttccttcatttattcactaatttagcagaacctcactaagagcctcctatatgccaggctctgcgttagcaataaaaggaatgccatgcctcaccccatcaggaggtgctgatagcttgtaggcggagtggaaacagatgtgctctagaggctctaaatattacttctgctggggtcagttgggaagccacaacagctactgttcatcttccataaaagacaatcagccgggcacagtggctcacacctgtaaatcccagcactttgggaggctgaggtgggtggatcacaaggtcaggtgtttgagaccagcctggccaacgtggcgaaaccctgtctctactaaaaatacaaaaattagccaggcatggtggcgggcgcctgtagtcccagctactcgggaggctgaggcaggagaatcgcttgaacctaggaggtggaggttgcagtgagctgagactgtaccactgcactccagcctgggcgacagagcgagactccatctcaaaaaaaaaaaaaaaaagactgggttctgttctgtggaggttcttgtcttaacatatccactgttgattgcccagatgttgatgtaattaatttagcagtcgtaaatagtttagcacttgcattaaatagaccaaaccccatagtaggtatttgaaatacagaataaatgtgaggtacccctgctctaaaggagtttatagtccagagctgacttatggaggatttctttctattatttctgggtctgctactaatttgtctatttcatatcctaattatccttgttttcattttgattgaaagggggagagcatagaaattgtggtaaaaggtagttttattttttatttgagatggagtcttgctctgtcacccaggctggagtgcagtggcacaatctcatctcattgcaacctccacctcccgcgttcaagcaattctcctgcctcagcctcccgagtagctgggattacaggtgtgcaccaccacgcccagctaatttttgtatttttagtagagatggattttaccatgttggccagtctggtcttgaactcccgacctcaggtgatcctctcactttggcctcccaaagtgttaggattacaggcctcagccactgcacccagcctaaagttagttttagattaagtgttttcatgttttcccttgcaaagtaataaactggtcaagttatcaccttgttccatctccatattaatcagggtccaaacaggagatagaaaccatgcaacaatttgagtagttgaataaagaattataaacaggagattagagtaataggggattagatagtaagaggtgaagagataggaacagcagatataaagaacaaccatttcctcctatggctgagataccatcccctcaccacactcccccacctactcactgagatgcagaccttattgaagagaatgtaactggcttgctgcgaggtaaagtcaatgaggcgctccccagtaccactctgaggggatgctggggaaaactgcccatgagaagagggcacatgctgctggccacttgtgctaaagaacttgaagtctgataggagtgcaccctaacctggcatagaaaccctttcttcctgctgagtccctctagcaccttatactggcaaagctttacattgcaaacctccattatcacagagcaagcaatgaaagatggactcagagctgaggcgataaattgatagctagcatagcctctaaactgacttttatgactacattttatggatagaaagtgttcttatatatattgtttctttacataataggggacttattcatggctgcagatgagaaaacagatcctaagaagttaagtgacttgcccaaggtcacacaaagaattccactagttctaaaatgacagtaattacagttaacatacattgtatgtggcagatacatataaagcacatggcattaatttttttttttgagatggagtcttgctctgtcgccaagctggagtgcagtggcacgatctcggcttactgcaacctctgactccctggttgaagggattctcctccctcagcctcccgagtacctgggattacaggcatgcgccaccacgcccagctaatttttgtatttttagtagagacgtggtttcatcatgttggccaggatggtctcgatctcctgaccttgtgatccacccgcctcggcctccccaaatgctgggattacaggcgtgagccaccacgcccggccacttggcatgaatttaattcccgccataaacctgtgagataggtaattctgttatatccactttacaaatgaagagactgaggcaaagaaagatgatgtaacttacgcaaagctacacagctcttaagtagcagtgccaatatttgaacacactcagactcgatcctgaggttttgaccactgtgtcatctggcctcaaatcttctggccaccacatacaccatatgtgggctttttctccccctcccactatctaaggtaattgttctctcttattttcctgacagtttagaaatcagtccccagaatgtggatgttaatgtgcaccccacaaagcatgaagttcacttcctgcacgaggagagcatcctggagcgggtgcagcagcacatcgagagcaagctcctgggctccaattcctccaggatgtacttcacccaggtcagggcgcttctcatccagctacttctctggggcctttgaaatgtgcccggccagacgtgagagcccagatttttgcctgttatttaggaactttctttgcaagtattacctggatagttttaacattttcttctttgaacctagttataaaggtattgtgctgttgttcctaggcttagagtcataaggcctgagctcacttcctcactttgcctccatctggaaccttagaccaacttcctaggaaaacgagctgtctgaaaacagaatagggtgcctcttcaatgtgctcttcactggagatgttcaggaggaggctactcccacctacacagggtgcagtggagggtctgggccccagggaggcagcaggaagagtggaaagagcggaggctctactgttggacagacctgggttaccagccgtgtgactagccttccctggcctccatatccccctcagtaatgaaggaatgtgtcatccccaaatccagggacagttacaagcagtcagtgaacagaaagtgtctggtacaggttctaagtgcttattattctaagtcacttcacttacctgagttctcagttttcctatctataagataagcaggttggataaaatgttctccaatatactcctggtcctgagatgatgtgattgtgggcagccctttaatcatggtgaagatgttcatcataagcacactgaaactacaaaataggaatataaatattttctccattaaattatgctggatcctagaagcaaaaactggaactgtgaaaccctacttcacagaaaacttaaaattcccaagcagatgaatgcttctcggaaggacactgacagttacctacctggaaagaatctagatggaggtggcatgggcactaagcggtgagattaaacccagttagggcagccccaccagccttggaacccacacatctggagattgttgatgcagagagaaaggttcctactggtgagacctgaaagggatatgtggcaggtgggaggaagaagttctgtctggaaaccaacccttgttcctccgttattgattgactcctggtaccaacatgagccctaggtcttatagaggccataagtccctatgccttatagtgcccatggatgagatgaggccacacatgcccccagtgggttaacatgtctagcgtgggtaaggctcttggagcactatgatacacaggaaatgcccagtaactcttagttggtttgatatctgttcccattgctcacttaagctcagtgcccctttactgatccttttattctgcctccctctgcacatgtgcattgagactcctatctgagacacacactgtgttgggtgcccagggatgcagcatagatgttgctgccttccacagaagcgctcatggtctgctagagaatatatcccatgggagagaaaaacagactcgggagaatatagcaggggcccttgtcctggactttggcagttaggaaagggagggaagagacatggaggctgggacccaaaggctaaataggaatttgctgggccaaaggggagggggaatgaaaagagtgtttctggcagaggaaatggcaaggataaaggcctggaggcgcaagagaatatgtgtttgaggatctgaaagttgagtgcagtgggtccagtgttctctaccctggctgccattagaattacctgggaaacttttagaaaattccagtgtctgggccctccctaaaacaataaatcattcttgggtggtggggtctgggcatcaggattgtttaaaaccctccccaggtactgtcatgtgcagctggggttaagctgtgctggggtctgagtatggatctgttagggcaagtggcggtgatggagttgaggctgcagaattcaggccaaatagagaggttttcatcaggatattaaagagtttagatttcaatttggtgggaatggatgggatcttatttgcattttatgaagagctccctggttgcaatatcagaatggattggagaggagcaagatggaagcctacagtgatttgggagaagtggtgagggacttgagacacaggaagtagccccattcactaatagttgagtatgtagatttgctaggacctggaaatggtttggctggtggggagtgggaagaaaggcccaaagtgtgaaatgaagatggagagcacattgcctagcccagagtgattgccatttgctctgtcccagttgaggtccaaggggttggccagagatcatggagtctgtggctccatggggagaagaacctctcagcatgcctccttgtcttatcctgggttagtcagattcattttgttagattacattttttttccagtggaactctgcttaagtcctgaccagtatgttttcagaaggatcagagggcctgcccttgtccattggtgcatgacaccagcttggtgggttccttgctgctccctgttttcatagggttatcagaataccttctctccctgccaccagcaggtcacactggctcctgactttttggcccatggaaccaccatctttctgcttcttagattgtgccttgtactccactgatcatggccagtacatcagaagccctggtttgcagtgaatgcatttgatatggaaatcaggaaccctggggataccactcatcatatttggttgctgtgtttttcctccaatctttcaccataacaacaatcaactcaaaagatttctataaccacttgtgtgggggtttctccccacacactaaacaagcagtcagttccagagtggacagcagctggtctcctccaatttaattccaacactgtctacttggagatagcattagatcccacaggttgagggtgcagtcccctagactgcccccagtctcctgcttcagacaccagtcacaagtccaggactctagaagttctgaccagtttcaagttggggttcccacaaccccccactttatttttgattaatttgctggagtggctcatagaactcagggaaacacttagttttctggacttattacaaagatttaaaaagataccaataaatagccaaataaagagatatacagggctagatctggaagggtctggagcgcaggagcttctgtccccatctacttggctcccagcagatggatgagttcttattcattttcttgtcagcttcgacatgttcagctctctggaagcccgcaaactcttgtcttcttgggccttttatggagacgtcgttaggcaggcatgattgaaacatggacaactgtgtcgaaatatgattggacataaaggggtctaaactcagtgaggcctgtttgttcagattcttcttggcctctctgtggccattctttcctccaggatatggggcaggacccctatggaatgagggtcttatgacccacaatcaaattagagtcctgccttgggcaagtgaaaggaaagcaggagaaggtaagagaaattctgttgcctaagaccttctgaggcctaaagcaccccaacattataacagaagacgataacaggactatgggagttatgagctgggaaccttggacaaaaatatatacatattaaataaatattaagtgtatatatatacttacgtatattaagtgtatgtgtgtgtgtgtatatatatatttttttaatttactggttggttttgggaagcagaaattaccataactactcttaaaaatcttttaagtctctttgaagttagaaaagtcactgtacctttttgtttccattggccctgtacttcttattataccccagcaggaggagcataatgtgttgttatatcattctggtgataagattcataagtgggttcagctggtgacagcctgattccctcattgtaaacttatccatcaacatgtagcttaatcgtttcaccttttgtgatgaccattacctgaatcagttatttcattagattgcaagattatgcttttctgattttatcatttcttctgtattgactgtaattctttggtatagaagaactttcccttgttaatagctatttggttgtcctgaagtacagttcttactagaaagtaagaccaaatgctgaattatatccctctagctatcaattttcgaaggaatgaatggtgtcctagtaatttccagtggtgtttaattacgttttcccttctctttctccttctcttattccctccctctccatctcctccctcctcactttcagttttttgctctttcagtattttgtcatagctgttaacagagcaacatattttaatcaattgtagtcatttttctttttggtgctcaaattatcccgtcttagtcccatggaagcaagcccttggagctagggccctctaccttttgatggatttccatttgtcttgataatttccttgtttctgacaagacaagatgttgcaggcacattttatactttcccagcccaaaccctggaataggccttttctccgaggagctctagttcattttagtgggaaatggtatttagagactataatctgggatctgggagtcctcattgctactgagtagtcattacttttaggcttttccagtggtcagagctaggaaatatgtatatttaaaaatggacagttgaatggttgttgccaggagctgggaggaaggggaagtgagaaattgtttaatgggcacagagtttcagtttggggaagatgaaaaagttctagagatagctggtggtgatggttgcgcaacaatgtaaatgccactgagctctcatttaaaaatggttaaaatggtaaattttatatatattttaccacaataaaaaaaagtcttcttctgggagcacccccccaagacaaaaatatgaaaattttacactgatacttccatttcaagataattttaagattataaggattttgcttaattcttgaattttatacctgtaaaccttttatacttcaaatttcgggcagaattgcttctataacaatgataattatacctcatactagcttctttcttagtactgctccatttggggacctgtatatctatacttcttattctgagtctctccactatatatatatatatatatatatatttttttttttttttttttttaatacagactttgctaccaggacttgctggcccctctggggagatggttaaatccacaacaagtctgacctcgtcttctacttctggaagtagtgataaggtctatgcccaccagatggttcgtacagattcccgggaacagaagcttgatgcatttctgcagcctctgagcaaacccctgtccagtcagccccaggccattgtcacagaggataagacagatatttctagtggcagggctaggcagcaagatgaggagatgcttgaactcccagcccctgctgaagtggctgccaaaaatcagagcttggagggggatacaacaaaggggacttcagaaatgtcagagaagagaggacctacttccagcaaccccaggtatggccttttgggaaaagtacagcctacctcctttattctgtaataaaactgccttctaactttggcttttcatgaatcacttgcatcttctctctgcctgacttgccctctggaatggtgctggaatggtcctgtggccttgtccactgtctgcctttgaccataacttgaaagtcacccaccatagtgtcctttgaaataacttaaatgtccacagttccaagcatgagttaaaaacacttcagaatgtagagtagttgttcaattgaataaacacacacaccagaaaaaaaagcaagtttatcttttatttttagtaaagaattttgatagagcctcaacaccagaaatggctagagagagaagcctaacatatctggaggattatttttcatcctacttaaagctgctttcacttttttcaggaaaaaacacacgttctgaatctaatttataaaactccctggccgggtgctgtggctcacacctataatcccagcactttgggaggctgaggcaggtggatcacctgaaatcaagagttcaagaccagcctgaccaacatggtgaaaccccatctctactaaaaatacaaaattagccagacgtggtggcgcatgcctgtaatccccgctactcgggaggctgagacaggagaatgacttgaacccgggaggcggaggttgcagtgagccgagatcgcgccattgcactccagcctgggcaacaagagcgaaactccgtctcaaaacaaacgaacaaacaaaaaccccaaaaatccctgaagtacgtgagctagtggtgaaagaaagctggagaaaaggagcaggaataataataataataataataataataaagattgtcatttaattttgagtacttccagtgtacactttgcaggtactctaagacattacctcactgaaatctctaaggtagatattctttatttaaagtgtacttgtatgaaacctggagctcaaggtgaaggaatttgcccaaggctgcacttgcactatcgtggcactaattagccgtgtgaactgggacacgttacttcagtttgctcatttctgagtcagcctagcaagatgacttctaagaattttttccagccgggtacattggcctgtaatcccagcacttcgagaggccaaggtggaagggtcacttgagtctaggagttacacacaacacacacacacacacacacacacacactagccaggcatggtggcaaatgcctgtagtctcagctactccggaggctcaggtggaaggatcacttgagcccaggaggttggggctgcagtgagccatgatcacgccactgcactccagcctggctgacagagtgagatcctctgtctcaaaaaaagaaaaaaaaaaagatttttttccagggaataataaaggaagctaatatttatggagcatctacggtgtgccaaatactttgcatacgttatctcatttaatgctcttatccctgcagggaaagtattaacatttgtttatcacttgcagaactaagtgatatttaccacagagtagacaaatattttcaagcccaaaatcaagtggtatcacttttctgctgagaatgtttcagtggtttcctttgctcttgggataaaacttaaatccctcaccctacccttgctccaaccctccactttccttctcccatgtggtgatttggccatacagctcttgtggctgatctgaactgactgagctttttacccttttgctcttgctgttcttacagcctgggaaccccctggttacctcttggcttggtgtggtggcttacatctgtaatcccagcactctgggaggccaaggcggacggatcacctgaggttgggagtatgagaccagcaagtcacctcttgccagtggcctttgtccattgagtctgaagttctttctcctctcatttccccatcattctattatgctaccttgttttattttcttcattgtgtttattgatacttaaaatgatctcttttctgttgctgtttgactctcccactagaaagtaagcattgtagatcgggcactgtggctcacacctgtaatcccagcactttgtggggcagaggcgggtggatcacctgaggtcaggagttcgagaccagcctggccaacacggtgaaaccccatctctactaaaaatacaaaaaatagctgggtatggtggctcgtacctgtaatcccagctactcaggaggctgagacatgagactcacttgaacctgggaggcagaggctgcagtgagctgagatcacaccacagcactccagcctggaagacatagtgagactctctctcaaaaaaaaaaaaaaaaaaaaaggaagtaagcattgtgagggcaggtaccttctctgttttgttcattgctggatgtagttagtatacagcagtatctgatggatggatagatggaggaatgaatgaatgagacttcacaaattcagctcacttgctcaaggccctgcagctctacgggatgaagctatactccagagtcctgctacattggctgtgtggccagctgctgggatctgagggttgtcagataagcagtctaccagagaacagactgatcttgttggccttctgccagcacaggggttcattcacagctctgtagaaccagcacagagaagttgcttgctcctccaaaatgcaacccacaaaatttggctaagtttaaaaacaagaataataatgatctgcacttccttttcttcattgcagaaagagacatcgggaagattctgatgtggaaatggtggaagatgattcccgaaaggaaatgactgcagcttgtaccccccggagaaggatcattaacctcactagtgttttgagtctccaggaagaaattaatgagcagggacatgagggtacgtaaacgctgtggcctgcctgggatgcatagggcctcaactgccaaggttttggaaatggagaaagcagtcatgttgtcagagtggccactacagttttgctgggcaagctcctcttcctttactaacccacaatagcatcagcttaaagacaatttttgattgggagaaaagggagaaaaataatctctgtttattttaattagcattaattggtattcttgttaaaccataggagtcagagtaaatcagccatttcaccaattttcagtttgtttctgtcttagctaacagcagtgtaatggtcagcaaaattcttatcttgtgtactgaatggcatgtcctgttgctgaaagtgcacaggcttgggaggtagccatgagctcaaatcctggcactaccacctctcttgtgtgaccttagactcctgacctttctatgcctcagttctttcttacctataaaatgaaattaattttacccttaaagatcatcgtgctgattagagataaaatataaataataacacttgttacagagcaaggagttgacacttttatattctgaagacaaagtggtaaatcattatcatctatgtcagaaatagcttttgagaatacctgagtatagaactatcttgatccctgttacttcaaaactaaaataatggttttaggaattaaaaggtgaggctagtcacctccaagggatgaactgactcagggattgaggtatataacagtgaactggtccaaacaacagtcctgaccccactttatgagtgagactatgagtaatggtctaagtgtagacatcattgtccagggctccagtaggcagctctgtacttgagaatttagcagtgacccttctatttttcatctattatacctttttttttttttttttttgacacagggtctcactttgtcacccagctggagtgtggtggtgcaatcatggcccactgcagcctcaacctccctgggcttaggtgatcctcccacctcagcttcctgagtagctgtaattacaggcatgtgccatcatgcccagctaatttttcttttcttagaggtggggttttgccatgtttcccaggctggtcttgaactcctaggctctcacctctgtcttccaaagtgctgggattacaggtgtgagccaccacacctggcctattacacatttcttaattaaagtagtcaaatttgaaaactgttacaaagtgtatcttaaaatacgacgatctggtttaatttttaaaagatatgagtagccaaggagcaattctgtgcctttcccactagtccctaaccttttaaagcagctgcttcttggctgggctcagtggttcacccctgtaatcccagcactttgggaggccaaggcgggtggatcatgagtcgagatcatcctggctaacacagtgaaaccctgtctctactaaaaatagaaaaaaatagctgggcggggtggcggatgcctatagtcccagctactcgggaggctgaggcaggagaatggcatgaacacgggaggcagaggttgcagtgagtcgagattgtggcactgcactccagcctgggcgacagagcgagactccatctcaaaaggaaaaaaaaaaaaaaaacccatctgcttttgattcagtggcttctttaattttgtcggtctcagtcaccatttgtctaagcaaattcaggcaggcttcaccttgcctttctacatttgttcccttttcttagcattttgggcctttgtttacacgtgggaaaagacccacaggtcgtctctccctttgggcaggatacaggcttcctgtgactgaggttttgctagctgtagaagtggctgccaattggcttctggtttttatttccatgatttgctccagtggctcttcccttccatcattgttagctttcaagctaggaacttttaaaatgcttttaaataaaagtgagctgttacttgatgcatttagcagtcttcctcacagtggttttgatagacagactccctcagtttggaatttatgagttttctttaagggtttgtctccctcatgtatagcaggctgttgaaagttacaatgtcaataactttctgaatagtatcaaactgttttcagtgcagtgtattaacaaaactaacctgcctcaagtttggtcagctttggagtcttactgaggctaaaatgataaatctaaatgatttaaaattgtgtattcctacacagtatctcacttaattatgtaatagtcttgtgagtgaggcagagcagatgccgttttctctattttaaagatgaggaaaatggaatggaaaatggaaaggacagactaattgcaacatcctcgcaatcaaaaacaggcccaggttcatgccttgttggcagtgggttgctactggctgtggccttcatgcaggaaggctagatgcataaccaggtcaacagcccgtgcaggacaagcacgccatgtaattctgattccatcgactgaggctggtgttttcaaacgtgctggtgtagggtcttacagacagagtcatctgtgctatggggaatggaatgtgctcttgctttggagccagaactcctctgaagctcccaccacctacaccattcagaggccagacagaaatttgttcaccattttgggcatgattttcgtgcttttgtaaaatgtgcttcactgcagcccttactgggctgtggtgatgaacacttaagatactgtgtgtgtgctttataatctgtaaggcactgttcaaggggagggacctctgccatgagcccctacccactggtatctggttgacatccaaagccccagcctgggagaagctgattctctagttgaatgctgtatagggatttgactgaggctcagatttggtgaggaagaccactaaccttaacagaccaacaggctggctactccctgatgaagttccccaggccatgaaagaagtaagagatacattccttgtaacagctttcttagttgcacctgtatgattatttgatcagtgtgttgtctgtgcagggatcatgtctgtggagctcaccacctcgtcctcggtgctgagcagagtgcctggcatgtgtactcagtagatatttgctaagggagcgagtcagtgattgagaggagcagcctgggaggtaaagccctagaatctttattttaaagggatatcaaagttgaacattcagttagacagttctcttgagtccagggatttacccatccatggtggacacactttcagttaaaaagtaaggttaattttgacaggttgcagtatccaggcaagcattctatggaataaggctcatctcagggattagtaatgactgaattaacttactgctagtcccataattttgacgttaattaatggggttaagaaatgtcataagctatttggtaccatttaaagtgaaaatacccttaacgttttttgcctccagatatccacacttaatttcattttcttgctctttggtgaacagtcctgggtctgaatgtatatatccatggtttgtcactaggtgacaggtttttttggaacaagaaatcagttcagtgaacatttgtcaagtatcttctctgtaaaaagtgtaatgtgccaagctcagaagtaggaagtgaaatggataaactatgacccctgccttaaagaacaccatggtgttgtatgggaattgtttaggtagaatgaaagaaatcctctaatagagatatgaggccagttcagcagaaagccagggtgagatctcctgagagggatggaagggtgtcttgatcatctctggtagcagcaaaggcactggcatacagtggccactggaagacaaccagcaggggatgggggcgtttacccttgcaagtgagcattaggaactagaggactgattgccctttcttcagctttggtttcccttgctgcagaaaaagatgctgagactcatggcctcggttatgaactcagatatgtggtttggctttgaagcacagatggattttgtccgattttggcagggaaatgcctacagacagcactatgggcatatttaggttagggacgaaatgcaagttgattaagtcctgataagaggctgtgaagaggtccaagaagcctcacaatgcccaatgaagaaaagccctgtgcttggtgctgccgcctcccttccccgtcctgctggcagggctgcgcttcagtagctctggatgcgtcagagcagtccatgaacattctgtgtggaaaatctctgactgttttagtggattacactgctctccctttcctccagtgcctcgttattcagtattatttgatgttctccagcttttaaaataatcattttccgcctacgcagaacatcctgtagagacgttgaggttccagtgggaacagagaggaatacttattctaaaaatgaagaaaataaacctttttttatggagtgggtgatagtattgcagaacttctataatagtatgagaattcacttgtggtgccaaagcttaaaaaaaaagtatagtaaaaacataatgtataggcttattgctgtgctatgacccatgccccgttttctccaacctctcttgtcctcactcttcctttttgctggtgatatttttacttatttcatgaaaaaaaagataacatatacacacacatagatatatgcacaagtatatgtatatatgtgtgcataacacacataaacatatacattggtaaatttaaaaacatatttatgaaatatatgtagcatctacagaaaaacatgaacacttgtgagaatagcatctgcctaaaaaataggacatcaccatcacctttgaggctcttatgtgctgctcccctgtgccattcccttcccttcttccttagaggtgattactattctaaattttgggattattatttcctttttttattatagtgttttaattacagttttattacctgtatttgtattcctaaaaatttgtttacttttgcaagctttagattttataaaagtagaattacactgtaagtttaatttttctgtaatttatatatagctacacatatattcctaagattcatccatcttgttacatatagctctggtttaccttttctgtataatatagattctgcttcgtgaatttacagttcattcattcttctgttaaaggacagttggaggactcatatggcctcagtctctgtgtccccacatgccaccctgcttcccagcctcatatgagttgattggtggcctggcatactggatgagaagctctaggtcatatatttaagagagttattgctgggtcataaaatgacagattgttttccagaggggtcatattgatttaaattatcaccaacaattatattgtcagatttttaccagtttggtgattgtgaaacagtgtctgatggtagtttttatttgcattttcttggttgaaataaagttgtgtatttcagccaggtgcgttggctcatgcctataatcccagcactttaggaggccaaggtgggcagatcacttgaggccaggagttcaagaccagcccagccaacgtggcaaaaccccatctctactaaaaatacaaaaattagatgggtatggtgtcacatgcctgtaatcccagctactcaggaggctgaggcacaagacttacttgaacccgggagatagatgttgcagtgagccgagattgtaccactgcactccagcctgggcaacagagcaataactaaataaataagtaatcaattaataaataagtatatttcctcagctgttaagtacctgttcaagttttttacccaatatttgatgggctctttttttgtcttttctaattaatttttggagtttttgatatattctagatagtaatgagttacatgaaaatatccctagtttagggatcctctagtaactttttaaaatgaatacttgttttaggaacagaaattcttagatttaatgtaggcagattttatcaattgttctttacagattggctttgtagcttaagaaatccttcctaactttgcaataattaaagatatgctcttagattgtttcctaaaagactgatacttaagcctctagcccacctggaattgattttcacagatactacattttttactagttatagattggccccttcgtagagcaagtccgatagctgccatttttatggcagcatgtgctcacttagtgtctctgtcaaattttggtaattctcacaatatttccaactttttcattattactatatctgttatggtgatctgtgatcactgatctttggcattactattgtaattgtttggggcaccattaagctcactgtcttatgtgggcataaaccatgcccacataagacagtgagcttaattaataaatgtgtgtgctcagacccctccactgactgggtgttcacatgtcttccttactctcctcaggcctccttattccttgagacgcaataatatggaaactaggcaaattaataaccccacagcgtccacaagtgtttaagtgaaaggaagaggctgggcgcaatggctcacatttgagctcacaaatgagcccatgctcatttgccattccaaaaatcccagggcccttaagaattatgctaactctactctgcctctgctctataaatggaacaacaaagcctagatgacagcacatctttttagaacatgatttactgaatattttaagcccattgtggagacctactgctcagaaaaaaagattcctttcaaaagcctgtaatcccagcactttgggaggccaatgcaggtcgatcacctgaggtcaagagttcgagaccagcctggccaacatggtgaaacacgtctttattaaaaatacaaaaattagccaggcctggtggtagatgcctgtagtcctggctattcaggaggctgaggcatgagaatcacctgaacccaggaggtggaggttgcagtgagccgatatcatgccattgcactccagcctgggcaccagagtgagactacgtctcaaaaacaaaacaaaaaaaaaaaactgaaaggaagagcttaatgagaaaggcatattaaaagccagtataggttgaaagctaggcctcttgtgcaagttagccaagttatacatgaatggtaaagcaaaacagctttattgctgtaataaagaaagttttagtggtctggatagaagatcaaatcagtcacagcattcccttaagccaaagcctaatccagggtaaagccctaacttgcttcaattctttgaagactgagaggggtgaggaagctacagaagaaaacttggaagccagcagagattgatgaggtttaagggaagaagccacaagtgctgatgtagaagctgtagcaagttatccaaaagatctaattgatgaaggtggcttacactaaacaacagattttcaatgtagacaaaacaatcttctattagaaggtgtcatctatgacttacatagttaaagaggaaaagtcactgcctggcttcaaagcttcaaaagacaggttgactctaataggtactaatgcatctggtgactttaagttgaagccagtgctcatttgctattccaaaaatcccagggcccttaagaattatgctaactctactctgcctgtgctctataaatggaacaacaaagcctagatgacagcatctttttagaacatgatttactgaatattttaagcccattgttgagacctactgttcagaaaaaaagattcctttcaaaatattactgctcattaacaatgtacctggccaccctagatctgtaatggagatatataaggacatgaacactaacacagcatccattctgcaacccatggatcaaggagtgatactgactttcaagtcttatttaagaaatacatttcatagggctctagctgccatagatagtgattcttctgatggatctgagccaagtaaattgaaaacctctggaaagaattcatcattttagatgtcctgagaaacattcgagattcctgggaagaagtcaaaatatcaacattaacaggagtttggaagaaattgcatccagccctcatggataactttgaggggttcaagacttcagtggaggaagtagctgcagatgtggtggaaatcacaagaaaattagaattagaagtggagcctgaggatatgactgaattgctgcaatcccatgataaaatttgaacagatgaggagttgcttcttatggatgagcatagaaagtagtttcttgagaaagaacttaattctggtgaagatgctgttaatattgttgaaatggcaacaaaggatttagaatattatataaacttggtaaagcagcagcagggtttgagtggattgacactagttttggaagaatttctactgtgagtaaaatgctatcaaacaacatgacaagctacagagaaatctttcatgaaaggaaaaatcaattgatgcagcaaacttcactgttgtcttatttcaagaaattgcaacagcttcctcagccttcagcaatcaccaccctgatcagtcaacagccatcatcagggctagatcctccaccagcaaaaagataacaattcgccgacagctcagatgactgttaccattttttagcaaaaacctttttaattttatttatttatttattggagacagagattcactctgtcgcccaggctggagtgcagtggcacaatctcagctcactgcaaccaccacctcccaggttcaagtgactcttgtgcctcagcctcccaagtagctgggattataagcatgtgccaccacgcctggccaatttttgtatttttagtagaggcaggattttactatgttggccaggcttgtctcgaactcatgatctctggtgatctgcccacctcgggttcccaaagtgctggtattattggcatgagccactgcgcccggccagcaaaaaagtgtttttaaattaagctacctacgttgattttagacataatgctatttgcacacttaatagattacagtgtggtgtaaacataagttttatatgcactgaaaaacaaaaaatttcacatgacttgctttattgtgatattgactttattcctgtagtctggaactgaacctgcaatatctcagaggtatgcctgtatctacttgttctgtgatacttgttattgtcagtttgtttggatttaccacatattatttgatcataattctttcctgtagatgttttatggtctgcctaaacctttagtggggcctttgatggcttagtcctttcaggcttaagacaatagaagtttatttctcagagttctaaaagctgggaagtccaagatcaaggcaccgacagatttagtgtctagtgaaggcccgcttcctcatacatggcaccttctagctgtatccttacatagtggaagggaatagctagctctctggagtttctttcataagggctaatcccactaatcccaattatgagggaagacctaatcacctcccaaaggccccacctcctaatagtatcaccttgggggttaggatttaacatatgaattttgtggggacacagacattcaaacaatagccatggcaaacttttttgctttgtctaattcactcttattttgaaaagtatttgtgttgggtttaaaactccagattggtaattattttttcttagtgcattgaaggtaatagtgtatcattttctgatttctactcttgctcttgaaaattcagctatcaatcttaaaatttattacctgttgaaaatccagctaccagtcttatattttatttacttagtgggtaatctctcttctgagtacctttaagatctcctttcagaaataccatgtagtaaccctgtgtgtcacgtgtggattttgttgggcttgctagctgagacttgacagttttcatcacttctgggatattctcaggtattttgtcttcaaagtcttcagatattgtcctcttcctgccctctctccgactccttctggaacatgagttatgtatttattatctcccatgtgcataagttatctttacatattttcaatttctttatctttctgtgctacattctggataattttgttgatctaccttccagttaattagcttgttaactttgtcaaatctctttttaagtctatcttgatttttcttttcaattattgtatttttcatttttaaaaactttatgtgctcttttggaaatcttgatcccaggagatagtggatagtgtcctgctgcttactcatggttttaatagttcttgagcatgctgaacatacttattttatgttatttgctaatctttccaattcctgaaacctttacagatctcattctgtggattcttctggattctaattcatggggcattttttttgttttttgttaattcctcatactttatctgtggggaattacttgaagcctgggttgacaatgaaattctgcagagagaatttgcatttgattctactggaggaacagtcagccccgatatcagtttaaattaaaatctctgcttaaggttttcaggcaacctgcttagcatgaatcctggctggaaaagcatgtgaggaccagtttatgattacacattcacagggtgtcatgttttcttccaacaccaatgctagaggtggcagttttgcttactgcccttggagggacaggggagtgggcatgggcatagtagtatggttttccttttcactgggggtgcagcccttggagtctcagcttaatgtgttggggaagtggtctcctattagactctccatttcaaaccattccatgattttgtcctccttttgccaccttccgagcctgtaaaaactaatgtttgtgattcctgaggtttctctaatgtcttttaataaagttgacctcagagatctcgttacctctctgagttcctgctttgtcttagattttgatccttgagtgttctttaatcttttagcaattccttgttgcatgttaaaagattagttatattttattcctcatttgtgttcgttttcaccaggaggctcaattcaggcttctttgcttacttggtgtctctagttctggtgcctggtgctttggtcaatgaagtggggttggtaggattctattacttacctgttttttggttttattttttgttttgcagttctccgggagatgttgcataaccactccttcgtgggctgtgtgaatcctcagtgggccttggcacagcatcaaaccaagttataccttctcaacaccaccaagcttaggtaaatcagctgagtgtgtgaacaagcagagctactacaacaatggtccagggagcacaggcacaaaagctaaggagagcagcatgaggtagttgggagggcacaggctttggagtcagacacatgtggtttcaaatccaagttcgaccatttcccatttatttgactgtagacaagttacattcctaaactatgtctcagatttctcatctgtaagttgtggtattactagttaacatgcaggggttttgtttgtttgtttgtttgtttgtttgtgagggtaagaaataacccaagaagcctagtccttggtagttgctcagtgccctataaatgttgtgaaccaggtggtgagggtttggtgctgctagagaattctggtatctgctctgtgcaacagagtactgtaggtgatgcaagagaaagaagacctgatgccttctttcctcccagctttgagaatggagcaaaggcctaccccagccaccaagtgagccagtgggcttgatcagcacaggaaaggtgaccccggcagtttcatttgactattgcatggctggcaacatttctattgattgtttccagggaccttggcggatgagctcctgttgagtctagcatctctgttaaatctgttctcaaataggtaatgcatatgggaggatgctgccaccttgcatctactagacatcacctatctactgtgagactctccctctaagccctgctgtggcctcagagtgcttattggccctgtgagtggggcagccactatacattgcatggagttggtacatgagatagaaacctattcgccatcccttgaaactgccccagtccagaagcttcctgttagcacatgtacctccttgtatgtattcagaactcattccatttaggcttggaaacccgtttggtgcaactctgttcaagttccattgtctgctttgagaatgcttgggcttgtatagtgagctgtcactttttaatttgttaggaattctactcgccttgctttttcttttccagcatgtttaagggaatgacctccaaggccccaaatcacagttgtattcatgttctttcatttcacagatacaatccaggccagtcccagatttgcagctgttaataaatgtgaatggttttccagtaagggggtagaaaaacatagggagagaaccgggttcagagttcaatatctggattcaagtccttcctttagcactttactaactgatgtagaataagtcagctactcaataggtgcctcagtttccccaccaaaatgcagacatagaaggtgctttgtctgctttgatgagaagtctttaagcaagtctatggggttcaatgtgttttaagaactataaagtaccatataaatgtggcctttattcccattgtgttcttggaagtaattcaatatagtgtgtacttcatagctgcttttggactattgccagccagtgtatcatcctaaactacatgtcagcatagtataatcctgccttaggtctacttttgattatttaggaagactccctgcccttcctatacatttcacataatttttaataagttgtaaaaaagtgatttataggattctttgtaagtgggggaagttaagcagacaaaaagtttttaaatcttactgcagagtgtcaggaaccttttatagcaccagacaggtagggacagaacatgagtggcagcaagccagacttggtcttagtgctctaacctgtctgttagaggctggccagtcagacccctggttgaagacgttgggaatcccagctctttggaggggtaagagattttgttagactgttaaccagattccacagccaggcagaactatttctgtctcatccatgtttcagggattacttctcccattttgtcccaactggttgtatctcaagcatgaattcagcttttccttaaagtcacttcatttttattttcagtgaagaactgttctaccagatactcatttatgattttgccaattttggtgttctcaggttatcggtaagtttagatccttttcacttctgaaatttcaactgatcgtttctgaaaatagtagctctccactaatatcttatttgtagtatgttaaatttttctaaaacttctaaggatagttgctgtattgtatgatttgcatatggaggtatctataagaagttttatactttttagcaaaatagtcatttggtagccaacttaaacaaatgtttattaatatagaagttaataatatctactgatactcggccgggtgcggtggctcatgcctgtaatcccaccactttgggaggctgaggcgggcagatcatttgaggtcaggagttcaagaccagcctgaccaatatgatgaaaccctgtctctactaaattacaaatattagcagggtatggtggtgggcgcctgtaatcccagctactcaggaggctaaggcaggagaatcatttgaacccaggaggcagaggttgcaatgagctgagatcacgccactgcactccagcctgggcaacagagcaagattccctcaaaaaaataaatatctactgacacttaatacttggaaagggataaaaataaacattgtctaaagccgtggtccaaacacaacccctgccaacaattttagtccatttcttccaagacttttttttttctatgccttttgtgaaaactgtcaaaaactttttcaatgctgaattttagttctgagttaaaaatcatactacctgtttatatggtttcatatccacttttttcatgtgatatactctacaaaaagcctgctgagattttgattgggattatgttgaatctagatcaatttagggtgaaaaacttttgttagataaatcccttagtatttcacatttttaaatgctaaatggcatttttcaaaaattttcttttttcttttcttttttgagacagagtcttgctctgttgcccaggctggagtgcaatggcaaaatcttggttcactgcaacctccgcctcctgggttcaagcgattctcaaactgcctcagcctcccaagtagctgggattacaggcatgtgccaccatgcccggctaattttttaaactatttatagtagagagggggtttcaccatgttggccaggctggtcttgaactcctgacctcaggtgatctgcccaccttggcttcccaaagtgctgggattacaggtgtgagccactgcacctggcctcaaattttttttttttttttttttaagagacaggggtctcactcttgcctaggctggagtgcagtggcgtgatcataggtcactgaagctttgaactcctaggctcaagtagctaggaatacaagtgtgtaccactacacctggctaatttttttaaaaaaatttttttcgtagaaacgggagtcttgtgttaccaaggctaatctcaaactcatggcctcaagtgatactcttgcctcagcctcccagagtgctaggattgtaggcatgagttacttcacccagccaaaaaacttcaatttcctattgtttatttgctagtatatagaaatacatatagttttgtaccttgatgctgtatcttgcaaccttgttaaactcacttactagttctagtatattttttgtagattctatcagattttctatatatgtatcatgtcttctgagaataaagaaacttttacttcttgctgtgcaaactgaacaccttttctttctttctttctttttttaagacggagttttgctcttgtcacccaggctggagtgcagtggctggatctcggcttactgcaacctccacctcctgggttcaggcaattctcctgcctcagcctcctgagtagctgggattacaggcgctcgccaccacgcccggctaatttttttgtatttttagtagagatggggtttcaccatgtggccgagctggtcttgaactcctgacctcaggtaatctgcttgtctcggcctcccaaagtgctgggattacaggcgtgaattactgcgcccggctgccttttatttctttctcttgactgactgcactggctagagcctccaatacaatgttgaatagaagtggtaagaatgggccaggcatggtggctcatgcctctaatcctagcactttgggagagtatggtgggcaggttacttgaggccaggagtttgagatcagcctggcgaacatggtgaaactctgtctctattaaaaatacaaaatatagttgggtgtggcagttcacgtctgtaatcccagctacttgggtggctgaggcatgagaatcacttgaacccaggaggcggaggttgcagtgagccaagaatgcaccactgcactccagcctgggcaacacacacacacacgaaaaacgaagtggtaaggatggaaatccttctcttcttcctgatctaagggggaaaggggaaagttacaaaacattcagtatgctgttagccatataggtttttttgtagatgcccattatgaggttgaggaagttccctctgttccttatttgctacagattttatttaggattggatgttgaatttttttcaaatgctttttttgcatctactgagataatcatatgatttttcttttatagtttgttaatatagtgaattacattgattttcttatgttaaaccaatctttgcattcctgggatgaactctgcttggttataatatataatcctttttatttattatgggatttgatttgctaaaatttttattataattattttatctgtgctcatgattgttactagtttatagttttcttttagtctttggtttttgtatcagggtaatgctggcctcatagaatgagttggtaagtatcccctccttttccattttctgaaagagttttgtgtagaattgatgttaaaattattgcttaatgtttggcagaactcaacagtgaagccatctgggcttggagattttcttcatgggaaggtttttaactgcaaattctatttctttaatagtatagagctattcaggttatctgtttcttcttaggtaagctttggtattttgtttctttgaagaaatttgtcgcatttaatctaaatttttaaatttactgacataaagttatttataatatttcttattcttttattatctatggatctcttggtgacataacctctctcattcctaatattggtaatttcaggcttttctttttaacttggtcagtctggctagaggtttatcaattttattgatcttctcaaagaactaacttttggtttcatagatttttctattttctatttcattgatatctgctctgacttttaatctttcttatacctattttggtttaatttgtcttctgtttcacatttctttttttttttttttttttttttttgagacagagtcttgctctgtcgcccaggctggagtgcagtacagtggtgcgatcttggctcactgtaacctcagccttccaggttcaagcgattcctgtttctaagcctcccaagtagctgagattacaggcatgcaccaccagctaatttttgtatttttagtagagatggggtttcactgtgttggccaggctggtctcaaactcctgacctcaggtgatccacctgccttggcctcccagagtgctgggattacaggtgtgagccactgtggctggcctgtttcacatttcttaaggtagaagctgaggtcacggatttgagacctttcttcttttctaatacaggtgttaagtgctacaaatatcccttaagcactgcttcaacagcatcccacaaattttgatagtttgttttcattttcattcagttcaaaataccttctaatttcccttttgatttcgtctttgacctacaggttttttagaactgtgttatttagtttccaatctcttgaggatttttaaaacaatatgttattgatttctaatttatttccatctcagtcaaagaacatacttgcctttttttatacatttattgaaactttttttatggcccagaatatggtctgtgttggtaaatgttccatgtgtacttgaaaataatttgtattctgatctcattgagttgaatgttctaggtatatcaagttgatagtgatgcccaagtctcctgtatctttactgattttctgcctgttctgttattgagaaaggggtattgaaacttccaactataattatgatttgtctgttctctttgcagttctcttagtttttgccttcatatatatatacatatatatgtatatatatatatatttttttttttttgagatggagtcttgctctgttgcccaggctggagtgcagtggtgtgatcttggctcactgcaagctccgcctcccaggttcacgccattctcctgcctcagcctcccgaatagctgggactacaggcgcccaccaccacgcccagctaattttttgtatttttagtagagacagggtttcaccatgttagcaaggatggtctcgatctgacctcgtgatccgcccagcttagcctcccaaagtgctgggattacaggcatgagccactgcacccagcccatatattttaaagctctgttattgggtacataaacatttaggattgttatatccttttgataatggactcttctattatgaaaagataatatactgtgggtttataacatatgtaaaagtatgagtaacatattatcagaaggggagaaatggaagataacttaggcatcttatttttaagcatagttttccctttgtttctgcattagatgatttacctgaaatgtcattcaatttaacttactctccatcctcacccgcccagctttggttatgaggcagtagaaagaaatgatctgcctgtggttttctagaaatacgaaagttgagtccttaaggctacacagaaagaaagtacctccccagggcttcacccttcccatcctttcagcaggctttttgtctgtcgtatcttctctgttgaaatggccattgacaagaggaggaaaggggttttgttgtggattgttcaggcacttcctttggggtatatgggggatgagtgttacatttatggtttctcacctgccattctgatagtggattcttgggaattcaggcttcatttggatgctccgttaaagcttgctccttcatgttcttgcttcttcctaggagccagcaccgctctttgaccttgccatgcttgccttagatagtccagagagtggctggacagaggaagatggtcccaaagaaggacttgctgaatacattgttgagtttctgaagaagaaggctgagatgcttgcagactatttctctttggaaattgatgaggtgtgacagccattcttatacttctgttgtattcttcaaataaaatttccagccgggtgcggtggctcatggctgtaatcccagcactttgggaggctgaggtgggcagataacttggggtcaggagttcaaaaccagctggccaacatgatgaaaccccgtctctactaaaaaaatagaaaaattagccaggcgtggtggcgggtacctgtaatccaagctgctcaggaggctgaggcagaagaatcacttaaacccaagaggtagaagttgcagtgagccgagattgcaccactgcactctagcctaggcgacagcgagactgcgtctcaaaaaaaaaaaaaaagaacgttccaaggtcaggactaggcctcccctcagaagcagcaagtgacatatgtgacatcctctccactccctatttgcatttctaggttatataactgtactactatccatgcatgcctactcttgttcccagggtgaaggacccagacatggagagccgaatccctgcaggccattataaatgagattatgccatttgctcccatttcttcttattctttcatttttggggctctccatcttgatgtgttctttggatcgtgaacagatccaaagaaaaggttgttctgccgtgctgtttgtcaggatgaaaaactcttttttaagtgtttaggtctgcccccagtgcccagcccaatcaagtaacgtggtcacccagagtggcagataggagcacaaggcctgggaaagcactggagaaatgggatttgtttaaactatgacagcattatttcttgttcccttgtcctttttcctgcaagcaggaagggaacctgattggattaccccttctgattgacaactatgtgccccctttggagggactgcctatcttcattcttcgactagccactgaggtcagtgatcaagcagatactaagcatttcggtacatgcatgtgtgctggagggaaagggcaaatgaccaccctttgatctggaatgataaagatgataagggtgggatagctgaaggcctgctctcatccccactaatattcattcccagcaatattcagcagtcccatttacagttttaacgcctaaagtatcacatttcgttttttagctttaagtagtctgtgatctccgtttagaatgagaatgtttaaattcgtacctattttgaggtattgaatttctttggaccaggtgaattgggacgaagaaaaggaatgttttgaaagcctcagtaaagaatgcgctatgttctattccatccggaagcagtacatatctgaggagtcgaccctctcaggccagcaggtacagtggtgatgcacactggcaccccaggactaggacaggacctcatacaatctttaggagatgaaacttgcccatctctaaaatttcgggatttctttgtacccaacaaggttcaaacacaacagtcagcttttattcatgatttttacttccatctgctgatgtagaacatacctccagagtgacctcagaaattgtcaaatgtgaaaacacaagccatcacagtgagaaatgggaggttgagttagattgtctaaggctggagagtccatatactcccactgttagctctgaagtgtgtagccagtcttcagattctgggtcagttgcctcagtctctcttagcttttgccttactctttatccgaccactgccctgccaggaaaacaaggctctataactcctcttacaggtcagcttgacacaaaaagggtgcctggattcctaatgtttcattgtcacttttcccagtcagatgataatgcttttcaaatcaacatatattttgggggaggttggaagggagagttgaaatattctaagaatcaaagagtagcccactttaatcagagtatgacccctgattgctcacagtcatctcctgagcagtgtgagcgagtttcagatgaggaggctgaaggccagtcaggcatgctcgaggattccaagtctgtaggtgggagggcagagatttagtcctgttggccaaagcctctagggaatttctcactccagtggagaaggcaacacacttaccaaactgtgtggaaactatctcatttgattagaaattttacctcaagaagaggaaggacagttgagaaagaacattttcttacacatgagacagctaaggcttacaagaaggagaggaataatgaggcaaaataatcctcattaatattttcattcctcccctggggattagaactactttcagacccgattttaatggtaagttaggtacttcctacagttgccatccaaatatcagtcaggatcagacatgatgttagctcctgctacaataaaaccattttctccctgaatgaaaacaaaggttccacaggagacagtcccacagagcagtggcttcttttcctccctttaaaacctcatgttggctggacacagtggctcacacctgtaatcccagcattttaggaggctgaggtgggaagatggcttaagcccaggagtttgaggctgtagagctatgatcacaccactgcccttcagcctgggtgacagagcaagaccttgtctctaaataaacaaacaaacaaaaaatcctcttgtgttcaggcctgtgggatcccctgagaggctagcccacaagatccacttcaaaagccctagataacaccaagtctttccagacccagtgcacatcccatcagccaggacaccagtgtatgttgggatgcaaacagggaggcttatgacatctaatgtgttttccagagtgaagtgcctggctccattccaaactcctggaagtggactgtggaacacattgtctataaagccttgcgctcacacattctgcctcctaaacatttcacagaagatggaaatatcctgcagcttgctaacctgcctgatctatacaaagtctttgagaggtgttaaatatggttatttatgcactgtgggatgtgttcttctttctctgtattccgatacaaagtgttgtatcaaagtgtgatatacaaagtgtaccaacataagtgttggtagcacttaagacttatacttgccttctgatagtattcctttatacacagtggattgattataaataaatagatgtgtcttaacataa

SEQ ID NO: 4 - DNA, 80098 bp, Homo sapiens
ggcgggaaacagcttagtgggtgtggggtcgcgcattttcttcaaccaggaggtgaggaggtttcgacatggcggtgcagccgaaggagacgctgcagttggagagcgcggccgaggtcggcttcgtgcgcttctttcagggcatgccggagaagccgaccaccacagtgcgccttttcgaccggggcgacttctatacggcgcacggcgaggacgcgctgctggccgcccgggaggtgttcaagacccagggggtgatcaagtacatggggccggcaggtgagggccgggacggcgcgtgctggggagggacccggggccttgtggcgcggctcctttcccgcctcagagagtgggcggtgagcagcctctccagtgcggaggcacgggggcggaacgttggtgcttgtgcggattccgccgtccccaggttctgcttggctccggagggacgcccccctcagccctgaaacccgtgcctctccagccgccccggatctgaacttgtgatcacggagtgtttacgtcgtgccaggcattttaatgcattgttctagttcattttccagcagtcgcattcctcgccttggccctacatgtagcgctcattacaaacacggccagaatctcttattaacaaacagcagccaggagtgagatttaaaatagactgggggtttaggagacccttttatgacacgtaattctgctcccacgacgctcccatttataccgccggtccagctaagggtctggtaatggagcgccgttgaagagcagtatgatgaagtggtcaggaccaacggactctggagctgggctgcttgggatcaagtcgctgcccctctgcttattaacgtgtgaccttgggccagtcatggacgctatctgcttcagctcagcattcagtgctctccgtcacccgaccccatctatccaggattatctctccctggaaagctacaaacgtctcaccctatgtgggccaaatgttctggataggcctagttaacctcttctctccctgttttctttgcgctttcttgcagctatgtagttatgctaatgaaaagagcatcctagggggagcagagttgtggattctagtcctgactagaggactagtgcaaatgcgatactcctgatgaaaaatgtttcattcgttagatataaatgtgttaggcagggttatggacactagatgaaaaaagaaatacctctactttcatagagatcactattggacagcaaggcagaaataattacaattcaagttggaggcttatggaggtgagcttgtaagaggttacaagaggcgccaaggcaggatcgccaaagacggaagactttggaagagtctcatacaacggaagaggcgttatatgagacaccaaagtccacgttgagtcttggtggactagaagtttgctagggagagggcttgaaacgaggtagattggcgttgctggtgtagaaaaggaaggagactggcccaggtgggtggggttagatgaccaaaggcttttagtgtggtgttgagctgttgaaattttatgctgtagccaatgaaaagtctgaaatgttttttttttttttttttctgagacggagtcttactgtgtcgcccaggttggagttcagtggtgtaatcctggctcactgcaacctccacctcctgggttcaagcgattctcctgcctcagccaccggagtagctgggattacaggcacgtgccaccacgcctagctaatttttgtatttttagtagagatggggtttcaccatgttggccaggctggtctcaaactcctgacctcaagtgatccacccaccttggcctcccgatgtgctgggattacaggtattagccactgcacctgacctacatagattttacataagactttaaaacagggcgggcgcagtgactcacgcttgtaatcccagcactttgggaggctgaggtgggcggatcacaaggtcaggagatcaagaccatcctggctaacatggtgaaaccctgtctacactaaaaatacaaaaatcccagcactttgggaggctgaggtgggcggatcacgaggtcaggagatccagaccatcctggttaacactgtgaaaccctgtctctactaaaaatacaaaaaattagctgggtgcggtggcaggtgtctgtagtcccagctacttgggaggctgaggcaggagaatggtgtgaacccggaaggcagagcttgcagtgagccgagattgtgccactgcactccagcctgggcaacagagcgagactccatctcaaaaaaaaaaaaaaaaaaaaaaaagactttaaaaaaaattataagaaaggacagaccaagtgcagtggttcgttccagcacttagggatgccaaggtgggaggattgcttgatgctaggagttgaagactagcctgtgtaacatagcgagacccatctctacaaaaaaattaaaaagttacctttagaacttacgatttttatgtgtagactccatataagcagagggtctatgcttattcactatttattaccttccatagtccctgcacatataataggtgcttcataaacaatttaatgaatgaataaattactgagaaaacactggaagtttttgggttagcattgtgttaggtgcttgatatggtctggctgtgttcccacccttatctcatcttgaattcccatgttttgtgggaggtacctggtgggacataattgaatcatgtgggcaggtttttcctgtgctgttctcctggtagtgaataagcctcacaagatctgatggttttaaaaatgggagtttccctgcacaggctctctctctttgcctgccgccatccatgtaagatgtaacttgctcctccttgccttcctcaatgattgtgaggcctcctcagccatgtggaactggctgcagagtcattaaacttcgttcttttgtaaattgcccagtctcaggtatgtctttttttatttttttttgagacagagtctggctctgtggctaggctggagtgcagtggtgcgatctcgactcactgcagcctccgcctcccgggttcaagcgattctcctgcctcagcctcccaagtagctgggactataggtgcacgccaccatgcccagctaatttttgtatttttaatagagacggagtttcactgtgttggccaggatggtcttgatctcttgacctcgtgatcttcccgcctccgccttccaaagagctgggattacctacccagctgggtatgtctttattagcagcgtgaaaacagactaaaacagtaaactgataccaatagagtgggatgcagctgaaaagatacccgaaaatatggaagcaactttggagctgggtaacaggcagaggtcagagcagtttagagggctcagaagaagaccagaaaatgtgggaaagtttggaacttcctagagacttgttcaatggctttgaccaaaatcctgataatgatatggacaatgaaatccaggctcatgtggtctcagatggagatgaggaacttgttgggaactggagcaaaggtgacacttgttatgttttagtaaagagactggtggcattttgccctgccctagagatttgtggagctttgaacttgagagaaatgattttgggtatctggtgggagaaatttctaagcagcaaagcattcaagaggtgacttgggtgctgttaaaggcattcagttttaaaagggaaacagcatgaaagtttggaaaatttgcagcctgacaatgtgatagaaaagaaaatcccgttttctgaggagaaattcaagctagctacagaaatttgcataagtaatgaggatcccaatgttaatccccaagacaatgggaaaaatgtttccagggcatgtcagaggccttcatggcagcccctctcatcacaagcctagaggcctaggagaaaaaagtgatttcatgggccagcccggggtccccatgctgtgtgcagcctagtgacttggtgccctgcatcccagctgccccagctgtggctgaaaggggccaacctagagctcaggccatggcttcagagggtgcaagcctgaaaccttgacagcttccaggtggtgttgagcctgcaggtgcacagaaatcaataattgaggtttgagaatctctgcctaggtttcaaagatgtatggaaacgcctgcatgtccaggcagaagtttgctgcaggggtggggtgctcattgagttcctctgctagggcaatgtagaagggaaatgtagggtcagagcccccccacagagtccctactggggcaccacctagtggagctgtgaaaagagggctaccattctccagacctcagaatggtagatccacagacagcttgcaccatgtgcctggaaaagctgtagacacttaacgccatctcatgaaagcaaccaggcagtgtgctgtaccctgcaaagccacaggggcagagctgtccaaggctgtggttgcccagctcttgcatccgcatgacctggacatgagacatagagtcaaaggagatcattttggagctttaagatttgactgccatgctggattttggacttgcatggggcctgtagcccctttgttttggccaatttctcccatttggaatggctgtatttacccaattcctataccccattgtatctgggaagtaactaacttgcttttgatttgacaggctcatatgcggaaaggacttaccttgtcttgaatgagactttggactggaattttgaattaatgctgaaatgagttaaggctttgggggactgttgggaatgcatgattggttttgaaatgtgaggacatgagatttgggaggggtcatggcagaatgatatggtttggctatgtccccacctaaatcccatcttgaattcccatgtattgtgggagggacctggtgggagatagttgaatcatggggatggatctttcccatgctgttgtgatagtgaataagcctcatgagatctgatggttttaaaaacggaagtctacctgcacaagctctttctttgcctgctgccatccatgtaagacatgacttgttcctccttgccttctgccatgattgtgagacctccccagccatgtggaactataagtccagtaagcctctttttcttcccagtctcgggtatgtctttatcagcagcatgaagtccagctaatacagtgcttgaacatgtaatatctcaaatctgtaatgtactttttttttttttaaggagcaaagaatctgcagagtgttgtgcttagtaaaatgaattttgaatcttttgtaaaagatcttcttctggttcgtcagtatagagttgaagtttataagaatagagctggaaataaggcatccaaggagaatgattggtatttggcatataaggtaattatcttcctttttaatttacttatttttttaagagtagaaaaataaaaatgtgaagaatttaattgtgttttagtattttaagtagattgtgatagtagaatggtttgagacactttaatagcaattagcatgtggtttttaaaaagttgcagtttggctggtcgcagtggctcatgcttgtaatcccagtattttgggaggctgaggcaggtaggttgcctgagcccaggagttcaagaccagcctgcccaacgtggtaaagccccatctctactgaagataaaaaaatttaaaaaaattagctggggctattggcacacacctgtggtcccagctaatcaagaggatgaggttagaggatcacttgagcccaggaggttgaggttacagtttaactttcagaggccaaggcaggaggattgcttgagtccaggagtttgagaccaccctggggaatgtagggagatcccatctctatagagggatagattagatagataatttctgaggggaggggagggggagggccagggaaggggagggaaaggggaggggagggcagggccagcagtaaggtcataatagagacatgtatctgtaagatccttataataggtgaggatggccacaaattagcgccacagatttgtatttttagtagagacaaggttttaccatgttggccaggctggtcttgaactcctgacctcaagtgatccgcctgccttggcctcccaaagtgctgagattacagatgtgagccaccatgcccaaccacaagcatttatttatttatttatttatttatttatttatttatttagagacagtcttgctctgtcgccaggctggagtgcagtggcgccatctgggctcactgcaaactctgactccctggttcaagcttttctcccgcctcagcctcccgagtagctgggattacaggtgcatgctgcaacacccggctaatttttgtatttttagtagagatggggtttcaccatgttggccaggacggtctcgatctcctgacctcgtgatccgcctgccttggcctcccaaagtgttgggattacaggcgtgagccacagcactcagccagttatttttttataagaaaacattttactggccaggcctggtggctcacacctgtaatcccagcactttgggaggccgaggcaggcggatcacgaggtcaggagttcgagaccagcctggccaacatggtgaaaccccatctctactaaaaatacaaaaattagccaggcgtggtggtgtgcgcctgtattcccagctactggggaggctgaagcaggagaatcgattgaacccttgaggcagaggttgcagtgagttgagatcgcaccattgcactctagcctgggtgacagagcaagacttcatctcaaaaaaaagagaaaacattttattaataaggttcatagagtttggatttttcctttttgcttataaaattttaaagtatgttcaagagtttgttaaatttttaaaattttatttttacttaggcttctcctggcaatctctctcagtttgaagacattctctttggtaacaatgatatgtcagcttccattggtgttgtgggtgttaaaatgtccgcagttgatggccagagacaggttggagttgggtatgtggattccatacagaggaaactaggactgtgtgaattccctgataatgatcagttctccaatcttgaggctctcctcatccagattggaccaaaggaatgtgttttacccggaggagagactgctggagacatggggaaactgagacaggtaagcaaattgagtctagtgatagaggagattccaggcctaggaaaggctctttaattgacatgatactgtttcatttaaggaaaaataataaaaaaactcttttttttgtatctaattaaaataatgttctgatgtttacagaaactttgtatatttaattggacattagaacaagctgtttgttgtgtaagatttattttacctcagatcttttctcccccctttcctttctgtcttgtgttccaaaagagtaattattacggtaaatattactgtaattatggatttatcaaataagatgcagttctttagcattttttgataaatcgagtggaactttagcctgttattttactatttgttttattttaactaaattctgattgtgtcattttttttttttttttttgggaccgagtctcgctctgtcgcccaggctggagtgcagtggtgcgatctcggctcactgcaacctctgcctcccaggttcaagcaattcttctgcctcagcctcctgagtagctgggattacaggtgtgtaccaccacacccagctaatttttgtatttttagtagaggtgaggtttcaccatcttggccaggctggtcttgaactcctcacctcgtgatccacccacctgggcctcccaaagtgctgggattacagccatgagccaccatgctcggctttgattgtgtcatttgtataggcatgtggtttattatttagttatttttttttttttctttgaggtggagtatcactcttggtgcccaggctggagtgtaatggcgtgatctcagctcactgcaacctctacctcctgggttcaagcaattctcctgccccagcaggagtagcttgggattacaggcatgccccaccacacctggccaattttgtgtttttagtagagacagggttccaccatgttggtcaggctggtcttgaactcctgacctcaggtgatctgcccacctcagcctcccagagtgctgggattataggcatgagccacggtgcccagcatatttagatttttttttttttgagactgagtctgactctgtcacccaggctagagtgcagtggcacgatccacgatcttggctcactgcagcctccaccttatgggttcaagcgattcttctgcctcagcctcccaagtagctgggactgcaggcacatgccaacacgcccggcttatttttgtatttttatagagacggggtttcatcatattggtcaggctggtctctaactcctgaccttgtgatccacccgccttggcctcccatagttctgggattacaggcatgagccacagcgccaggcctagatgtttcttaaggtatgtatctcccaaagattctttttgtggtcctcaagtaccataagcaccgctggagataacacatgtgatgggcatttttagcatagattgtatctaagcaactttccacaagtaatagttctgttaagggttgttattgtggccgggcgcggtggctcacacctgtaatcctggcactttgggaagctgaggcggccggatcacctgaggtcagggattcgagaccagcctgtccaatgtgctgaaaccctgtctctactaaaaatgcaaagaaaaaaaaaatctagccaagcatggtggcttgctcctgtaatcctagctacttgggaggctgaggcaggagaattgcttgaacctgggaggcagaggtagcagtgagccaagatcgtgtcaccgcattccatcctgggcgacagtgagactctgtctcaaaacaaaaaaagagttgttaccgttgggactattttttgaaagctttatgtgaacgtaattttatattttgatgaaaatttagtttattgatgtaaaaagtgtatcagtacatcatatcagtgtcttgcacattgtataaacatttaatgtaggtgaatctgttatcactatagttatcaatgttataattttcatttttgcttttcttattccttttctcatagtagtttaaactatttctttcaaaatagataattcaaagaggaggaattctgatcacagaaagaaaaaaagctgacttttccacaaaagacatttatcaggacctcaaccggttgttgaaaggcaaaaagggagagcagatgaatagtgctgtattgccagaaatggagaatcaggtacatggattataaatgtgaattacaatatatataatgtaaatatgtaatatataataaataatatgtaaactatagtgactttttagaaggatatttctgtcatatttatctcaaaacctaaactgtgtatcaatgatattaagcttttttttttttttgagacagagtttcacttttgttgcccaggctggagtacaatggcgcgatcttggctcaccacatcctctgcctcccaggttcaagtgatcctcctgccttggcctcctgagtagctgggattacaggcatgtgccaccacgcctggctcatcttttttgtatttttagtagagatggggtttctctatgttggtcaggctggtctcaaactcctgaacctcaggtgatccgcccgcctcgggcttccaaagcgctgagattgcaggcatgagccactgtgtctggcctatttttatagtttatgtacttggaattatataatatattctgcctagcttctttcattcaatatttgtaagatttatccatattattgagtgtagttgtggatttttgcatttatatttcatagcacgagcatgtcagaatttatccattttacttcccttctgcccgccactgctactctccccattttacctttttttttgtttttttgagatggagtctcagaatttcgctctgtcgcccaggctggagtgctgtggcacggtctcagctcactgcaacttctgcctctgggttcagctgcacgccaccatgcctggctaatttttgtattttcagtagaggggattttgctatgttggccaggctggtcttgaactcctgacctcaggtgatccacccaccttggcctgccagagtgctgtgattacaggcgtgaaccaccgtgcccgacccccattctaattttgatggacatttgggtaattttcatttttggctgttataaatactgctgcaattacagttaattttcacagtttttttttttttttttttttttttttttttttgaggtgagtttcgctcttgttgctcaggctggagtgcagtggtgcgatctcagcccactgcaaccttcaccttctggattcaagcaattctcctttctcatctcctaagtagctggggtttacaggcatgtgccaccatgcccagctaatttttgtattttaatttcacagttctggaggctgggaagttcagaattaaggcactggctgatctgttgtctggtgagggcccacttgttcatagataaccattttctcactctaacctcacaaggttgaaagggcctaatttttgtgtttttagtagagacggggtttcactatgttggctaggctggtctcaaactcctagcctcgagtcatccacccgcctcgtcctcccggagtgcttggattacagcatgagccactgcgcccggcccccattttagttttgatggacatttgggtaattttcttttttggctattctaaataatgctgcaattactgttaattttcaccttgtaaaaaccattttcaaatctcaagagattaacctttagttttcttggtttggattgggaaggaacaccaaggaaaatgagggacttcagaatttattttcattttgcatttgttttttaaaatctttagaactggatccagtggtatagaaatcttcgatttttaaattcttaattttaggttgcagtttcatcactgtctgcggtaatcaagtttttagaactcttatcagatgattccaactttggacagtttgaactgactacttttgacttcagccagtatatgaaattggatattgcagcagtcagagcccttaacctttttcaggtaaaaaaaaaaaaaaaaaaaaaaaaaaagggttaaaaatgttgaatggttaaaaaatgttttcattgacatatactgaagaagcttataaaggagctaaaatattttgaaatattattatacttggattagataactagctttaaatggctgtatttttctctcccctcctccactccactttttaacttttttttttttaagtcagagtctcacttgttccctaggccagagtgcagtggcacaatctcagcccactctaacctccacctcccaagtagttgggattacagttgcctgccaccatgcctggttaatttttatatttttagtagggttgcggggacagggtttcaccatgttggccaggttggtctcaaacttctgaccttaggtgatcctcccacctcggcttcccaaagtgctgggattacaggcttgagccatcgtgcccagcctactttttacttttttagagactgggcttggtggagtgaagtggcaagatcatagctcactgcagtattgaactcctgggctcaagcgatcttcctgcttcaacctcatgagtagctgggtctacaggcacaagccaccatgcttgcctaattttaaaatttttgcagagttggagtttcacagtgttgcccaggatgttcgctcactcctgacttcaagtgattcttctgccttagcctctagagtggtagctgggattacaggcatgaaccaccatgctctgctattttttttcaaggtttttttttttttttttttttttgagagactggtatgactatgtatgctccctaggctggagtgcagtggctattcacaggaagtgccatcagagtgtactacagcttcaaactcctgggctcaagcacttctatcatagtctccaaagtagctgggactacgagtgtgtctcattgtgccttgctctcgaattgctttttttttttttttctggtttcaagctatctatgtggtattagtcctcactttatgaataattttgtatactactaatagcaattttttttttttttttttttttgagacggagtctcattcttgtcgcccaggctggagtgcagtggtgtgatcttagctcactgcaacctctgcctctccggtttgggcaattagctgggattagaggcgcctgccaccatgcccagctaatttttgtatttttagtagacatggggtttcatcttgttggctaggctggactctaactccaggtgatctgcctgcctcggcctcccaaattgatgggattacaggtgtaaaccactgggcctggcctagcaatttaaaatgacattctaagaagttttatgtctaaatctgcagtaagtggctgggtgacgtggctcatgcctgtaatcccaacgctttgggagtccagggtgggaggatgacttgaggccaggagttgagaccagcctgggcaacatagtgagactctgtctctacaaaagaaaaaattagcggggcttagtggcgtgcgcctgtagtctcagctactcgaaaggctgaagtgggaggattctttgagccccaagggttctggcttgccgtgagccaggatggcaccactgcactccagtctgggcaatagagtcagaccctgtctcaacaaataaaataaaactgtagtaattataaagtggttttggctgggggagaaatgtacagttgaacatacggattaagaggttgaaagttggtcttaggaagaggaactttttgtggaaatttcttaatatttgaagaatattatgttattgttcctctgtttttcatggcgtagtaaggttttcactaatgagcttgccattctttctattttattttttgtttactagggttctgttgaagataccactggctctcagtctctggctgccttgctgaataagtgtaaaacccctcaaggacaaagacttgttaaccagtggattaagcagcctctcatggataagaacagaatagaggagaggtatgttattagtttatactttcgttagttttatgtaacctgcagttacccacatgattataccacttattgtaatatgcagttttggaagtatatgttaccatttaactgtacagagtacatagtaatagagtggtaattatttagattgattaaagaactcatttttttaaataagttttttttttttcactataaaagtttattttatttgagatggtatggtatcgaacatgttcatattgtgtgtaatcgtgggtaaattactcaacctttatgtcatagtttcttcacctttaaaatgacattaataaaagagctacttaataggattataagcatgagatgatttaatatacataaaatacttacagtctgatatataggaagcacttaactctttatcctagaaaagatttaaggtgaccttaacatatatgtcagaaaatctttaaaattgtggaaataaaaggttgtataattctgctatcctaaaattactagtatttcaatatattttattttagtcttttcttttagatacaagttttaaaacttttaagtgaagtgtaatatacgtaagtactgcttgatgaatttaaggtgatttctaaagccaggtttgttggggaagaggagtgggatttagtgatttagaaccagaaattggggctgggtgcgatgtctcatgcctataattccagaacttcgggaggccatagtgggagaattgtttgtgccccggagttcaagaccagcctgggcaactcagtgagacgccatctctacaaaagaaaaaaaaaaaaaattagctcagtgtggtgacatgtacctgtagcccgagctactcgggaggctgaggtgggaatatcaccctggcccagaagtttgaggctgcagtgggctatgattgtgccactgaactccagcctgggcaatggagtgaaaccctgtctcaaaaaacaaacaaaaaaagaaactgaggctgggcacggtggctcacacatataatccagcacttggggaggttgaggcaggataattgcttgagcccaggagtttgagaccagtctgggcaacaaaatgacaccccatttctaccaaaaaaaaaattgtttaaaattagctgggcatggtggcatgtgcctgtggtcccagctacatgggaggctaaggctggaggattgtttagcccaggaggttgaggctgcagtgagccatattcatgtccctgcactccagcctgggtgacatagtgagacgctgtctcaaacaaaaatcaacaggccagatgcagtggctcacccctgtaatcccaacactttgggaggccgaggtgggtggattacttgaggtcaagagttcgagaccagcccggccaacatggcgaaaccccatctctactaaaaatacaaaattagatgggcatggtggtgtgtgcctgtaataccagctactcttgaggctgaggcatgagaatcgcttgagttgggaggcaaaggttgcagtgagccaagattgtgccactgcactctaccctgggtgagaaacgagattttgtatcaaacaaacaaacaaacaaaaaaagacgcccaaaatcaacaacaacaaaaacgatattggaatgattggatccccaaagataaatgtttgaggtgatggatatctcagttaccctgagttaagtattatacattgtatacgtgtattaaaatattacaaacccccaaatgtgtacaattatgaggtatcaataaaagagattggaaggactgggtaatttgcaagtaattaaggcaatttacaatttttaatttttatttgtgaataagtagttatacgtgtcaaaattcaaaaaggacaggtggatatacagtgataagtcatccccccttctctgtcagctccataaagagcccctgtcttgcatggctccagggtcacatttcctattgtattttgccaccacctgccctgggagcaacagtgttagtttcttgaacatccttccaagcagagtctgggcctacacaagcaaaacaagtatgtctattctctctcctctttaatttttttaaaggaagtgattgataatttaacactcaagctataggtcattggttatatttttaatttccaatttatgggaatagaggaagtgtcagtgatccccttctggtttaagaactggaggatgcatgtgtttagaccctttagaaacctgaaatgtcacctaatataattatcagagtaacactttttagtaagcaagctatctatcaaaagtaggtttttgaagaagagggtaaggaaaggttactttcatgggacatagcaataatttctaaaatctaatggttttacaagacttgttcattagaagtaacatctgtgaggatggctttatgagtcaaaatattatctgcttaataccccacctgtagggtaagaagaaatgtttttttcttggtgacaatttttagcagcaagcggggagggcctgtggcttccaaggccaaacgttgaaataccacagactaggaagaaaaagatccactccttatacaggatttgtttgtttcttcttttttcttcatttttgtagagatgaggtctcactatgttgcccaggctggtctctcttttttttttgagcccgagtttcactcttgacgcccaggctggagtgcagtggtgtgattttggctcaccgcaacctctgcctcccgggttcaagcgattctcctgcctcagccttcctgagtagctgggattacaggcatgcgccaccacgtccggctaattttgtatttttagtagagatgggtttctccatgtgggtcaggctgctctcgaactcccggcctcggatgatccacttgcctcggcctcccacagtgctgggattacaggcgtgagccactgagcccagccatgctggtctcaagcaatccacacccacctcagcttccaaaagtgctggcattacaggtgtgagcccccgtgcccagcctgtttcttataattattcctctttctcaactctgtctgctgtggtacctcatgcttcctagtttaagccttcttgggagttctcaggagaaatctgttatctcccttactaagcatttgggattgatgttccttccaggttactataaaaccaagttttttttggttcttttttttttttcttttaaaagaaatgagattttgtcatggttagcctggtttcaaactcccaagctcaagtaatccaccttcctttgcctcccaaagtgctaggattacaggcatgaaccactacacccgatctgtactgttcctctttccattcactaaaacctacttgcaactatgagcatatgttattgccatctagaaatgagtttctagggacttgttcctttttgtactttatttaaacagtcgaattagaaattattattatcattatttattttttgagatggagtcttgctctgttgcccaggttggagtgcagtggcgtgatctcggctcactgcaacctccacctcctgggtttaagcgattctcctgtctcagcctcccgagtagctgggactacaggcatgtaccaccacacctggctaatttttatattcttaatagaaacagggtttcactattttggccaggctggtctcgaactcctgacctcagatgatccactcaccttggcctcccaaagtactggaattataggcgtaagccaccgtgcccggccaaaattatttataataagcaaggcatggtggcttgtgcctgaagtcccagctacttgggaagctgaggcaggaggatcacaggttcaggtccaccctgggaaaatagtgagaaccttccctatccccagtcttcaaaaaagaaaaaaatttgctggagaaggtcacacaatgctgataggtcccattgtgctttcatgctttctagttttcaatgataactggttgttacttttattgtctgactcattatagtgaccaactcccgattttttactttgccttaagccttcagctatctcctacctctaagcggatgatttcttccttaacacttaaaacctcaaaatttatctgtacttccactcttttactctctggctctttctcagaagaagaaataacacttttatttcttttcaaagccaacctttccatactttacttggagacatatttctttttttttgttttgtttttgtgagtggagtctcactctgtcgcctggtctggagtgcaatggcgcaatctccactcagtgcaacctctgcctcccaggttcaagcgattctcctgcctcagcctgctgagtacctgggcttacaggttagcacaccacacccggccaagttttgggtttttagtagagacagggttttgccgtgttggccaggctggtctctaactcctgacctcccgatccgcccgcctcaggtgcaagccaccgcgcccagccctagtgtagcaatcttaatcagaaatatgtctctggctgggcgaggtggctcatgcctataatcccagcactttgggaggccaaggcaggcagatcacctgaggtcaggagttcaagaccagcctgaccaacatggagaaaccctgtctctattaaaaatacaaaattagctgggtgtggtggcatatgcctgtaatcccagctactcaggaggctgaggcaggagaatcgcttgaacctgggaggcggaggttgcggtgagccaagatctcaccattgcactccagcctaggcaacgagcaaaactccatctcaaaaaaaaaaaaaaaaaaaaaaagattgctatgttaatcttatttatttatttatttattttgagacagagtctcacactattgccagggctggagtgcaatggcataatcttagctcactgcaacctccgcctcccgggttcaggtgattctcctgcctcagcctcctgagtagctgggattacaggcgcccgccaccacgcctggcttattttttgtgttttttagtagagacggggtttcactacgttggccaggctggtcttgaactcctgaccttgtgatttgcccacctcagcctcccaaagtgctgggattacaggcgtgagccaccgtgcctggcttatgttaatcttattttatataaaaagaaataatattaaactagaaggcaataaaaatgccaaattcaatacacaaattattttgtcagcatttccacaagaataaactattttatatgctaacatatgttcaatgttccttacagaattctgacattaaaaatgaaaaattaccaaagcttcagatgaatctataaatggacaaaagaaaaagcttaaaaggataaagagcaacactccaagtgcatgtataaacataaggactcttgggacttaacctttttaaaaatctttaggcctagcacagtatttgctatttaatgtatcaaatgggtggttttgacttcattaatccatatataggacagatgaaaaaaagaattatagacttgtaattacagttctttaggaaccatatttgctctcagccttttaaatacgctgtcaggcaattccagtcagcacttttgaaaaaaacctacctacctacctacctacctatctatctatctatctatctagagactgagttataagactagctagtttttgtattttttgcagagacaggatttcatcatgttttctaggctgttcttgaactcccaggctcaagccatccacccgcctcagcctcccaaagcgctgggattacaggcgtgagtcaccatgcccaaccaattccagtcagctcttaaaatgaaagcctagaaatggtagggttaaagaggggacagaatgttgattttaaaatacctagaatttggccaggtgcagtggctgtaacccagcactttgggaggccaaggtggccggattgccttggcctgcctcagcctcccaaagtgctgggattacaggtgtgagctcaggagttcgagaccagcctgggcaacacggtgaaaccccttctctagtaaaatacaaaaaattagctgcatgtggcggcgtgcacctgtggtcccagttacttgggaggctgaggcaggagaattgcttgaacctgggaggcagaggttgcagtgagctgagattgcgccactgcactccagcctgggcaacagagtgagactctgtctccaaaaaaaaaaaaccccaagaatttgattaattctgttggaattttaagagttaactgatccccaaaatgactcagctgtatgcaatttaatgcaatattaattcgcatgttgactctcagaattgcatacagctgagtcattttattgagtaggattgataagtatactatgttatgccaacagtaactgtgatgcttctaaaattgtgatttttaaattggcattgtcacagaaacagcagagtagttgtttttttctttaagcttcttttagccagaaacataaactgaaactgtaattattactgcaatcgtatgttgaatagacttgtgaaactagcaatttattaggcttttaatgatatctggaccaaaggctgagggagctgtgctgtgtgtatgttgctttgtgctttgttttttagaagcttgtcgtttctttgccattttacttctttctttttttttgagacggagtcttgctctgtcccccaggctggagtgcagtggcgcagtttccgctcactgcaagctccgcctcctgggttcactccattctcctgcttcagcctcccaagtagctgggactacaggcgcccaccaccacgcccggctaattttctgtattttttagtagagatggggtttcaccatgttacccaggatggtcttgatcttctgaccttgtgatccgcccgcctcggcctcccaaagtgctgggattacaggcttgagccaccacgcctggcccattacccattacttgtttcttaatgttacattctctttccctctttttttttttttgttttttgagatggagtttcgctcttgttgcccaggctggagtgcaacggtgccattttggcccactgcaacctctgcctcccaggttcaaatgattctccagcctcagcctcccaagtagctaggattacaggcacctgccaccacgcccagctaatttttgtatttttagtagagatggggctttgccatgttggccaggctggtcttgaactgctgacctcaggtgatctgtctgcctcagcctcccaaagtgctgggattacaggtgtgagccactgcacccagtccttaatgctactttataggtgaaaattgtgaaataacttaaatttcattttaattaaagttaatttttgggaaattaacgaaaggttgacattttattcttttgaatattgcagttgttatttgggtttaaattggggggcttaggaaggaaagaagcctgatggttgtttctgaattttctgaaaattatgtttgatatgctgtatatgaaatccagcttggagagaatatgtccattgttaaggaaaaattaatgaagatttgatctagataaggcattccaatcatttggaagtggtttgagtatctttttttctttttttaatttgagacagagtcttgctctgtggagtgtagtggtgcaatcttggctcactgcatcctccacctcccgggttcaatcaagcaattctcctgcttcagcctcccgagtagctgggattacaggtatgggctaccatccccagctaatttttttttttggatggaatcttgctcccgtcgggcaggctggagtgcagtggtgtgatctcagctcactgcaacctccacctcccagtttcaagcgattaagtgattctccttcctcagcctcccgagtagctgggattacaggcgtgtgccaccacgtcgccaccacgtctggctaatttttgtatttttagtagagacagggtttcgccatgttggccaggctggtcatgaactcctgacctcaggtgatccacctgcttggcctcccaaagtgctaggattacaggtgtgagccactgtgcctggcttaagttttgtatttttagtagagacggtgttccatcatgttggtcaggctggtgtcaaactcctgaccatgcgatccgcctgcctcggcctcccaaagtgctgagattacaggcgagagccaccgtgcccggcctgtttgagtatcttttaaaaccagtaaggacaaactagaggtgtcagctctcttcatgggctttggagaaacaagacaaaaaggaaagagatgtttcgccgggcgcggtggctcactcctgtaatcccagcactttgggaggctgaggacagcggatcacccgaggtcaggagtcaagaccagagccattgcactccagcctgggcaacaagagcacaactttatctcaaaaaaaaaaaaaccaaaaaagaaacaggaaagagatgttttgattttttaagtctagagtgttctgttcttactctacagcacttagcagtagtccatctatcctccttgtttgttctttacaacaaaaccccattggttctctcttaccaagtttgctttattcttggtttatcctttgtaagatgtgaaagggatatgaagagcaaataggaagtgttactcttgctgcttgagagaaagctgttttacaatttgttggcaaacaatttgtaaaagtacaacaaaagtgtgcatttttggcttcttatttatgttttatcattgctatatctcataatttgtgatttttaaaataactttttatttgaaaagcactacagggtcacgtcatgtttttaaaaaataaattaagaaggtaaacacccgtacttctactttacctctagtcctagtctatggtggtaatcagtgttaacagtttagtttgtgttcttacccttccaggggttttttttctctatgtatacagatatatgcatttttaaaaacatagttaacacttaaaaacaatatgggatcgtattaggaatacaatctgtattccttcccaacagtatatacagtttttttccatttcactatgtatctatttataaattttttatttctaataatttctcttgaataggtgagacatcatatagtataaaattcagtagaaaatcagtttttcagaggtacaaaattggctgactttgcacagactcctttcatttcacaggtagggatgcacagccacctcttccaccgacgagaggaaaggatatgtgtgcctgtgggctcttcaactctgttgattagttatgatttattttctggtcagtttgagaggaaacagtgataaaatactgggaacagggaagaagcataagattattattgtttttttttttttttttgagacagagtcttgctcagttgcccaggctggagtgcagtggtgcgatctttgctcactgcaagctccgcctcccgggtccatgccattctcctgcctcagcctcccgagtagctgggactacaggcgcccgccaccacgccctgctaattttttttttgtatttttagtagagacagggtttcaccatgttagccaggatggtctcgatttcctgacctcgtgatccacccgcctcggcctcccaaagtgctgggattataggcgtgaaccaccgcgcccagctttaattttttttttttttttttttttgagacagagtcttgctctgtcgcccaggctgaagtgcagtggcgcgatctcggcttgctgcaagctccgcctcccaggttcacgccattctcctgcctcagcctcctgagtagctgggattacaggcacccgtcaccatgcccagctaattacgggacctcgctctgtcgcccgggctggagtgcagtggcacagtctcgctcactgcaatctggcaagtgattctcttgcctcagcctccagagtagctgggactacaggtgtgcgccgctacgcccagctaatttttgtatttttagtagagatagggtttcgccatgttggttggccaggatggtctcgatctcttgacctcgtgatccgcccttctcggcctcccaaagtgctgggattaccggtgtgagccatcgcacctggccttcctactttattaagatacctaagggatttctgtgattgttaggattcaaatttctgtgagcataagaatcaagctgtgtgcataataattgcatgggatttcacagctgggccccattcccagggattttgtattatctacctccaagtgattttgatgctggtgatccttggaccagacttggtgaagctcaatgcttagctaggaaagccccaaaaatttgctttattggattgtgtaatttgactacatccattgtttcttttttcaaatgtagagttatatgccacaaaaatattttccgtagcagtaggcatcctaattaatctcgatgtttgtttatagccccattgatggggctataaacttggcagcaaattgttttcccactaatttggcattttccataaatgtttgtttatagccccattgatggggctataaacttggcagcaaattgttttcccactaatttggcattttccataaaaaacacgtatctgttgttagctgcctagacgttagctggacatggtttaggttacttttctcttaaaaagtaaattttaattcaagttcctttaagccagcagtctcaacctggggcagtttttccctccaggggacattcagcagtgtctagagacatttttggttgtcatgctgaggaagagagtgtatagtgggtagaatccagggatgctgttaagcatggaacagccccttacaacaaaaaattatgtagcctaaaatggcagtgttgccaagattgagaaattatgctttaaatgtgtttttatatatggccattttgtgtttactctggagataacatgcttttcctcatataacatgcttgataaacattttggtaacacaggaattgtaaatgctggtgatgtcagtaaatagttaagaaatttagggctgtgcgcggtggctcacgcctgtaatcccagcactttgggaggccgaggcgggtggatcccgaggtcaggagatcgagaccatcctggctaacatggtgaaaccccgtctctactaaaaatacaaaaaaatgagccgggtgtggtggcaggcacctgtagtcccagctactcaatttagaaagcagatttgtttcctttctatacctgtgtaatttgaggtttagtttactgtcacatcgtttataaacataaggaagatcgttgctcatctgatagcattccgaaccttgagtcatctgtaatgcctatggcctccagaaaagcttctctaatactgtacttagagatgtgtaaaatatgtaggaacattttcccaccttcgattgttagtttacctttcagcttcagtaatttacctttcagctattactttagtaacatcttcaacattgtttttcaaactgcaaggtgtgacccagtagtgggtcgttaaattagtaggtgacagagcatttttgaagaattaaatacaatagaacatagcagagtgggctcacgcctgtaatcccagcactttgggaggcgaggctggcaggtcacaaggtcggcaggtcacaaggtcagaagatcgagaccttcctggctctaacatggtgaaaccccgtctctactaatagtacaaaaaattagcggggtgtggtggcatgcgtctctagtcccagctactcaggaggctgaggcacgagaatcacttgaatccgggagctggaggttgcagtgagccgagattgcaccactgcactccagcctcagcaacagagcaagactatttcaaaaaaaaaaaaaaaaaaaaagaaagaaagaaaaaaagaaaatagagtgtatcacataattagagtagcaagtattgatttgtgaaacctattttaatcatagatctatgtatgtatgtgctggattgtgatgtaaagacatttcttgctgtggttacactgaaaaaaatgaaaagtcactgatttccaataacttacagaagcagtatgaactacatattctgtcgttcttgaaacaagctgagattttattgactttgggaagcagtagaattattttagttttttaattaacagtttttggctttgtactgtcaagaggtaattttagaaagcattctaaaaatgtaagtactggatttggcaacattcttgaactgtaattctgtttcgttaaacatcactatttacatgtgcaacagcgtgtctgtaacaatgtcccagtaatgaaattctttcttctatttaaggcatgtctgtttgataaaagtcaaacaaaattgggtatatgtcagtgtcttatgatactgcttaattaaacattaatttgactcttagctaatcaggaaatgtttgcctcacagtcttacagagctttccaccttctaaaaaagctaacgtttcagaatagattcaggattcaaccttctttctgtctttttttttttttgtttgagacagagtcttgctctgttgcccaggctggagtacagtggcgctatctcggctcactgcaacctccgcctcctgggttcaagcaattctcctgcctcagcctcccgagtagccggggttacaggcgtgcgccaccatgcccagctaatttttttgtatttttagtagagacagggtttcaccatgctgggtggccaggcgggtctcaaacttctgaccttgagatctgcccaccgtggcttcccaaaatgctgggattataggcgtgagccaccgcacctagcctagattcaggctgcttctttttttttttttttttgagacagagtcttgctcttgttgcccaggctggagtgccatggcatgatctcagtgcaccacaatctctgcttcccaggtttaagcgattctcctgcctcagcctcccaagtagatgggatcacaggcatgagccaccatgcctggctaattttgtattttttgtacagacggggtttctccatgttggtcaggccagtctcgaactccctacctcaggtgatctgcctgcctcggcctctcaaagtgctgggattacaggtgtgagccactgcgcccagcagattcaagctttttaaatggaattttgagctgatttagttgagacttacgtgcttagttgataaattttaattttatactaaaatattttacattaattcaagttaatttatttcagattgaatttagtggaagcttttgtagaagatgcagaattgaggcagactttacaagaagatttacttcgtcgattcccagatcttaaccgacttgccaagaagtttcaaagacaagcagcaaacttacaagattgttaccgactctatcagggtataaatcaactacctaatgttatacaggctctggaaaaacatgaaggtaacaagtgattttgtttttttgttttccttcaactcatacaatatatacttggcaatgtgctgtcctcataaagttggtggtggtgactcactcttaggacacattcagatttcttttttttttttttttgagaaggagtcttgctccgttgccaaggctagagtgcagtggcacaatctcagctcactgcaacctctgcctcctgggttcaagcgattctcctgcctcagcttcctgagtggctgggattacaggcatgtgccaccatgcccggctaatttttgtacttttagttttaccatgttggccaggttcgtctggaactcccaatctcaggtgacccacctgcctcggcctcccaaagtgctgggagtacaggcgtgagccacagagcctggccatgttcagacttctaataacaggtttgtattgactcttagcctcatggcagaagccaagagacatgagacagcttagaaatttttgctttttggaaatgaatgttagagttactggtttgtgattaaggcctattgcactgacagaggcagtgaaaaagggtttgattgccaaggaagattcacagggcctagaatggcagtggttatgcatctacagtttattacaggagaaggatacaatccagtagcaggattatggtaaggatatgcatcacagtcaaaggctgtcatagcaagtcatccagagagttcgggtgcaagttccagttttcctttgttgtgtaaagtctgtggtggggtgcattttctctctcagagcaggatgtgtgcacaggacaccttggaacctaggagcccaaaatagagtcttcactggactttttaatatttttcttgtcaagcggacatgttcctgttctctaactagcctcttcagtggaggtcagaggaagagcctcattgagaccaagtgcaactcatcaatcacatgaaacaatgctgataaataaaccacctaaatatcccctgacccacaaatacaaaacaacaccattcaatcagtatttttcatgccttgatcaggggtcattgccatgcaggaactttaacaaaacagtacaggctaataatagaattgttggaattaactcacacagcacacctatgagagagagttaagatagagggtcttggtggtctctaacagttgaattcaaagtgaagttaccagagtaaagtgagcaaagacacatattagtacaatattggtagataaaatcacgttgctctaataagcatagttttaaactttaaccatgtttctccagtaattttagtaattatattgttgttatgtctaatacataaagcattttttacttttttaaaaaatttttaggcaatgtggggtccaaagtaattaaaaaaaaatttttttaacataaagcatcttaaaattttacttaatcatgatcacttagaaccattaaaacatacgttttgatattatggggaagcttcgttgttcctttgtagacagacttaaagaaatacaactttatgatgacaagatataagataattatagatttaaattttatagaaaccttttcccttatctagtgcaagaggtagctaagtgcttattttctcaaagtactgtgttataaaaagtattcctagtgtagtcaaagcttctctttagactgataaaacttagagcacctgcatttacttccaacaaagcagaattaaagaaaatgagacttggccgggtacgtttgtaatcccagcactttgggaggccgaggcaggtggatcatgaggttaggagatcaagaccattctggctaacatggtgaaaccctgtctctaccaaaaatacaaaaaattagctgacatggtggtgcgcacctgtagtcccagcttctcaggtggctgaggcaggagaatcgcttgaacccaggaggtggaggttgcagtgagctgagatcacaccactgcgctccagcttgggcaacaaaaaaaaaaaaaaaaaaaagaaaaagaaaatgagtctttactggctgggcacagtggctcacacctgtaatcccagcactttgggagaccgagacgggcagatcacctgaggtcgggcattcgagaccagcctgaccaatatggagaaaccccatttgtactaaaaatacaaaattagcggggcgtggtggcgcatgcctgtaatcccagctattcgggaggctgaggcaggagaattgcctgaacccgggaggcggaggttgcggtgagcagagatcgtgccgttgcactccattctgggcaacaagagcgaaactctccatctcaaaaaaaagaaaatgagtctatactttgctgttttcatactctcttagtgtggtgtaggcagccatgtatcccccttgtgcctctatttctccattctgtgaatgagtgtcttccactgctgtgcttttctgattccgtaacctttgtttgtttgtttgtttgtttgtttgtttgttttttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaatgagcgtgctgccttcaagcatctgtttaacaaagcacatcttgcaccacccttaatccgttcaaccctgagtggacacagcacatgtttcagagagcacagggttgggggtaaggtcacagatcaacaggatcccaaggcagaataatttttcgtagtacagaacaaaatgaaaagtctcccacgtctacctctttctacacagacacggcaaccatccgatttctcaatcttttccccacctttcccccctttctattccacaaaaccgccattgtcatcatggcccgttctcaatgagctgttgagtacacctcccagacggggtggtggccgggcagaggggctcctcactacccagtaggggcggccgggcagaggcgcccctcacctcccggacggggcggctggccgggcggggggctgaccccccccccccgcctccctcccggacggggcggctggccaggcggggggctgacctccccgcctccctcccggatggggtggctggccgggttgggggctgaccccccgcacctccctcccggatggggcggctggctgggcagaggggctcctctcttcccagtaggggcagccgggcagaggcgcccctcacctcccggatggggcggctggccgggcggggggctgacccccccacctgcctccaggacggggcggctggccgggcagagcggctcctcacttcccagtaggggcggccaggcagaggcgcccctcacctcccggacggggcggctggccgggcagaggggctcctctcttcccagtaggggcggccgggcagaggcgcccctcacctcccggatggggcggctggccgggcggggggctgacccccccacatccttcccggacggggcggctggccgggcagagggtctcctcacttcccagtaggggcggccgggcagaggcgcccctcacctcccggacggggcagctggccgggcggggtgctgacccccccacctctctcctggctgggcggctggctgggcggggggatgacccccccatctccctcctggatggggcggctggccgggcggggggctaacccccccacctcccttccggacggggtggctgccgggcgcagacgctcctcacttcccagacggagtggctgccgggcggaggggctcctcacttctcagacggtgtggctgccgggcggaggggctcctcacttctcagacggggcggttgccaggcagagggtctcctcacttctcagacggggcggccgggcagagacgctcctcacatcccagacggggcggcagggcagaggcgctccccacatctcagacgatgggcggcctggtagagacgctcctcacttcctagatgggatggcggccgggcagagacgctcctcactttccagactgggcagccaggcagagaggctcctcacatcccggacgatgggcggccaggcagagatgctcctcacttcccagacggggtggcggccgggcagaggctgcaatctcggcactttgcggggccaaggcaggcagctgggaggtggaggttgtagcgaactgagatcacgccactgcaccccagcctgggcaccattgagcactgagtgaacgcgactccgtctgacatcccggcacctcgggaggccgaggctggcggatcactcgcggttaggagctggagaccagcccggccaacacagcgaaaccccgtctccaccaaaaaaataccaaaaccagtcaggcgtggcggcgcgcacctgcaatcgcaggcactcggcaggctgaggcaggagaatcaggcagggaggttgtagtgagccgagatggcagcagtacagtccagctttggctcggcatcagggggagaccatggaaagagagggagagggagaccgtggggagagggagaggagggagagggagagggaaccttttgttttattccagtaggaccagctagaaacagaaggtgattgaccagtattagggatggaatcagggtacaattatggagacaggctatctaaacaattcactctcaccatttaaatcagctgtttgatcattttttttccatatatctttaccatcgcatagtaaataatatcctttttattttcaagagggagtattggccttaagttaggaactctcttaatttttttcccccatcatcccacccgcacttcttactccttacttcctacttgcttttattctttactggctctttaccactgcgtatttttaggtgcatacatctattttttaaaaaagcacccttgttcctgggtcctcttccagtaccatctattaatatatctctctccctctttccactcccagctgggtttctgaaagcgtgcacttcccatcttccattcattcatctggtttccagccctgaccacagtactgaaatggcatttgctaggtgacctttatttttttttaaatccagtgaatgcggtatagtccccccgcttttttctttctttttttttttttgttttttgttttttgtttttttgagacagagttttgcccttgttgcccaggctggagtacaatggcgtgatatcggctcacggcaacctatgcctccccaggttcaagcgattctcctgcttcagcctcccaagtagctggattacaggcacctgccaccacagctggctaattttgtatttttagtagagatgggttttctcgatgttggtcaggctggtttcgaactcccgacctgaggtgatccacacacctctgcctcccaaagtgctgggattacaggtgtgagccactgcgcccagccttggtatagtctttaacgaaagttcactgatcttgaaaattttgatcttgaaactcttttttttttttttttttttttttttgagatggagtcttgctctgtcacccaggctggagtgcagtggcacaatctcagctcactgcaacctccacctcccaggttcaagcgattctcctgcctcagtctcccgagtagctaggattacaggtgcccaccaccatgcctggctaattttttgtatttttttagtagagatggggtttcactacattggccaggatggtcttgaactcctgacctcatgatccacccacctcggacctcccaaagtgctaggattacaggcgtgagccaccatgcccagccttgaaactctcctaaggttatgttaaacatttttgtattcttggttttctttttgttccatgggttatttctctttatccttctttttagctttcttaagtgttcctttaccttatcaaattctatttttggctcccatttcacttaataagaggaaaagctgggatttttttttttcttttgtggagacagagtctcactttgttgcccaggctggagtgcagtggtgcgatctcagctcactccaacctccgccttctgggttcaagcgattcttgtgcctcagcctcctgtgtagctgggattgcaggcatgtgccaccacgcctggctaatttttgtatttttagtagagatgggggtttcaccatgttggccaggctggtctcgaactcttgtcttccaagtgatctgcctgcctgggcctcccaaagtgctgggataaatttgagccattgtgctcgtctaagctgggattctttgaatgagttcttagaggcttcctgaaactttgtgcaacattttgtgtatgtgtatattttctggggaaaggatttgtaactttctattttttgagagggagtctctgtggctcagggtggagtgcagtggtgtgatctcggctcactgtaacttctgcctcctggttcaagtgattctcctgcctcaggctcccaagtacctggaattacaggcatgtgctaccacacctggctaattttgtatttttagtagagacagggtttcattatgttggccaggctgggaatttgtaactttcatcagatatcccaagggatatatgtctttcctggtagagagggaagaaacaaaaaacgtgtgtaaataccctcctctcccccagaaggtaagaagtactgctctgcacattccttgggtgatctttctcactccctgggataattaaggaagttagggattggggttgagggtaacttggcatccttccccaacctccctgtataggcacagtctaatatacttgatgacagtttgcaacaagtcaacaatttcctacttttctggtgttaggtttaagttatatagacctatggtgatcataacattatctaaatcagatgcttcacattataggtcttgcagctgatgtccagtttaggtgtttgaagtggcttagcctggaaaatgttacaggggaaaatctgctttccatgtgttatgctcagagctgtgttcttttcttttacacaatatgtttgacatttgttgaattttaggtgtaccctggtcattaggaactccctaaaggatctctgtgaggttttaaaaaaacaaaacaaaacaaaaaaacagtggcattttgcagaactcagtatagctctttaccatactgactgcaaggagaaagtaaaaagtgagactaattttgcaattagtctcccaagtttctttacaagaaaatagaccaaaggtactatgtttaaaagcaaaatcatggcttaaaagtttttctttttcttaatatattaatatattgctataaattgagtattgctctcttgctatcttgtgtttttttggtttttgattaactctaagcttaatgttattcctgacaaataaataaataaataaataaataaataaataaagtgaattcagagagacagtagagggcagcagccgtttagaaagtagattcacattgagtgattacggctcttttaaatctttctccactaagagatagctaatttccgaaaaggtatacttggcctcccatattccttatgtctcttaaaactaaaaaagctgggacaaaacttaaaataacagtattctacggttagggcaaatttctgatactgcttaaaacaatttaccgaggtatctttatttttttttgagacagggtttcactctgtcacccaggctggagtgctggagccttgacctcctgggctcagctcaagtgttcctctcacctcagtctgccaagtagctgggactacaggcatgcaccatcattcccaactaattttttaaaattttttgtagagatgggggtttcatcatgttgccaggctggtctcgaactcttgggctcaagcaatctgcccacctcgtcctcccgaagtacagggttataggcatgagccaccactcccagcctcagatttttttattgatgaattttattataacagctacaatactgagatgcataacccttccctttcctgatacccagttatcatctgtttctgtttaatacactccttaagtacctcacatttgctattcccctgccccccatggtctatgcatcttcttcattgaagtggtagtagtctttgttagctcatctggtcatgtcatcaattcagagcacattacctctttagttcagaacacattaattgcttcccataatcttcaggacacggccccatttcttcacgtggcttggccattgcttccctgttcagcttcccccacactccctcacctacaccttctgtctcagtatagtactgctagtctccagacatgccatgcctttttatgcttctatgcgtgttttcctgtctttaatgtccttgtccatgtgatgaacccctactcatttttccaagattgaactcaaatgtcaccttttctgtgagcttctctgctcttctcatgcagagtagaagtgtttatctccattgcccttgaccctaaataacagtacattagtataataatcacattttttacctgtttgtgtgctttccttctaaatggagaataagaatataaaagtgatttatttggcatttctgcaaagggagatgataaaaagaatctgcgttacttagcctttttaaaaaacccttagcctatgaaggctactatttaaggtttggttggattttgtatgttggaaatatgttctttaaatctcatcttcatcagtttataaaagcaatataagttctttgtagatcattatcatgccatccagatgtagtcattattgttttgatataggttgtttcagtctttaaaccaaattatacactgttccgctgtaactcttgttttgaaaacagatttgttccaatgtgggtggtatattagggaacaatttgagcataatgtaaattttgagtttgcttatgcacaaatccctaggcaacactaggtgaatgcagaaaaatgcatgcagctgaactcagcagtgtagatatatacaaaagatacacatacacacgctcttcaaatacctaccttattttcctgtatgtgttatgaaccatacccattcacatctggtattacaactttgccacccatttcagacagtattcctttgaccattctgcagtaactcagaagctgcagccctttagaagtctactccactgtggctcacgtctgtaatcccagcactttgggaggccgaggtgggtggatcatgaggtcaggagatcaagaccatcctggctaacacggtgaaaccccgtctctactaaaaaaaaatagaaaaacctagccgggcgtggtggtgggcatttgtggtcccagctactcgggaggccgaggcaggagaatggcgtgaaccggggaggcagagcttgcagtgagccaagattgcgccactgcactccagcctgggcgacagagcgagagtccgtctcaaaaaaaaaaaaaaagaaaaaaagaaggccactccacaagcaaaccgcagatgttttgcaaggtgacttatttattgtaatagttgtgtatttcttaaccatttcacatgtataaaactgtgctactacttttatgaggttcctgtctttattttttttaacatgtcgctggtgaaggttctgagagttgtggcttgaactccagttttctcataagcacggttttttgttgtttttttttgaaatggtctcgctgtgttccccaggctggagtgcagtggtgtggtctcggctttctgcagccttggcctcccagcttaagctatcctcccacctcaagctatcctcccacctcagcctcccaaatagctgggactgcaggcgtgagcctttgcccacctaatttttatacttttgtagagacagtttttccatgttgccaggctgctttggaactccttagctcaagcaatcagcccgccttcacctcccaaagtgctgggattacaggtgtgtcctaccacacccagacggctctggtatttactgcatagtgttctgatttttaggaatacatacgttgcattatatagcagaactggctgtattcaaaagtctaatagaaaatattgatagggtgataatgtatatagtactaattgtcagttgccataatttaactaatattgttttactttttactttttttttttttgagatggggccttgctatattacctaggctggtcttgaactcctgagctcaaggaatcctcttgcctcaacctcctgaggatgtttgacattttttgacttttttttttttttttttgagacggagtcttgctctgtctcccaggctggagtgcagtggcatgatctcggctcactgcagcctccacctcccgggttcaagggttcaagcacttctgcctcagcctcctgagtagctaggattacaggtgtgcaccaccaccacggctgatttttgtatttttaatagagatggggtttcaccatgttggtcaggctggtcttgaactcctgacctcgtgatcctcctgtgtcagcctcccaaagtgctgtgggtacaggcgtgagcctccatgccggccggctttttggcaatttaaatagttacagttacctattataattgatatttagctaacatctatttttattttaatattccaggaaattattatgcagaaactttaaaggtctgtgtacttctctggtgttttgattttttttttttctttttctgtgagtaattttctaaaactggtttctaggccaggctatttatgtcttgctttttattttttttggcgatggagtctcgctttgttgcccaggctggagtgcagtggcgctatctcatcttgctgcaacctctgcctcctgggttcaagcagttatcctgcctcagcctcccgagtagctgggactacaggcacatgccaccacgcctggctagttttttgtatttttagtagaggtggagtttcaccgtgttgcccaggctggtctggaacttctgagctcaggcagtctgcctgccttggcctcccaaagtgctaggattacaggtgtaagccactgctcccagccttattattttatttttatggattcggggtatatgtgcaggtttgtcccatggatatattgtgtaatggtgagttttggacttctgttgtgcccatgaacattgtacccaataggtggtaatttttcaattctcatccctctctctgcctctgcccttttggagttcccagtatctgttaattctctctgtatgtccatgtgtacccattgtttagctcctctattttttattttattttattttatttttgagacaagagtcttgctgtatcacccaggctggagtgcagtggtgcaatctcagttcactgcaaccttggtctctgggttcagatgattctcgtgccttagcctcccgagtagctggaattacaggtccgtgccacgatgcccggctaatttttgtattttcagtagaggtggagtttcgccatgttggccaggctggcctcaaactcttggcctgaagcaatccgcctgccttggcctcccaaagtgctgggattacggtgtgagccactgctcctgaccccatattttttcttttaattataaaggtaataatgtaaaaagaagtcaactcccagtttaactctagcagagtaaccagtgttaatttttttttttttttttttgagacggagtcttgctctatttcccaggctggagtgcagtgatgccatcttggctcactgcaacttctgcctcctgggttcaagccattctcgtgcctcagcttcctgagtagctgagattataggcgcccagtgccacgcctggctaatttgtgtatttttagtagagatggggtttcaccatgttggctaggctggtgttgaactcctgacctcgtgatccacccgcctcgatgctgggattacaggcgtgagccactgagcctggccaatccattcctttttatggctgagtagtattccattgtgtgtgtgtgtatatatacatatatatacacacatatacatatatatacacgtatatatgtatgtatgcgtatatatgtatgtgtgtgtgtatatatacacatatacatatatatacacctatatatgtggtatgtgtatatatatgtggtatgtatatatatgtggtatatatatgtggtatgtgtatatatatatgtggtatgtgtatatatatatgtatatatgtgtgtatatatgtggtatgtatatatatatgtatatatgtggtatgtatatatgtatatatgtgtgtctgcatatatgtatatgtgtgtatatatacacgtatatgtgtatatatatacgtatatatgtgtatatatacatatatacgtatatatatacacacacacatatatatacacatatgcaggcacacatatatatacatatatatatatacataccacagtttctttatccacttgttgattcatgggcatttgggttggttccacgtttttgcaattgtgaattgtgctgctataaacatccgtgtgcaagtatcttttttgtataatgatatcttttcccctgggtagatacccagtagtgggattgctggatcaactggtagttctacttttaaggaatctccacactgttttccttagtggttatactggtttacattcccaccagaagtgtagaagtgttccctgttcactgcatccacaccaacatctatttttgattttttgattatggccattcttgcaggagtaaggtggtatcgcattgtggttttgatttacatttccctgatcattagtgatgttgagcatttttttatgtttgtttgccatttgtatatcttcttgagaattgtctattcatgtccttagcccattttttgataggattgtttgttttttttcttgctagtttgtttgagcttgttgtagattctggttattagtcctttgtcagatttatagattgtgaagatttttttcccactctgtgggttgtctgtttttgtctgtttccttctgctgactgttccttttgccatgcaaaagctctttttttttgagacagaatctcgctctgtcggccaggctggtaacaaagacacaggtactggtaataactgccatggcttattgcctacattaatgatgaaagcaaatgctaaatttcagctagaggctagagaaaataagcctggaattttcttttatgtttatatactgctatgaataccaggagtccttgggttaagactgtagggctttctaaagcctgtgatcactagtggagaatgtagctttacaaagtctagttggaaattggcaactgggggttagtacaagttacaaggaagggatggaatttaagatgctagtgaaagcttggaggataagggagcaggtgaactcataaggaagtttatgaactgagaagggctgcagcaaagtgggctcatgtgcttgaggagccagaggacatgttgagggtgacataggttctgaagttcgtacagatacttatgcagtatggattcttggaaaaccttctttagtcatgtgatagaaaaataacagcttatggaaaaaacagggttgaggcagacctgaaaatacatgaaattttaaaaaccgcttctaacagaagcataacagactgtaataaaaactgtggccttcctggcatttgcacccaaacaacagcattagccaactctttgaagccttagatctgtggctcttgttttctcctttgaggtgtaggtccttgagggcatttgcttctaatagaggctagtttcatcagaattaaaaatctgaaccatggtatgaaattcaattcttttttttttttcttttttgaaaacactggcaaatgttttgtatccttgagctttcccacatatcttaacatagtgagtggaaagtacagtggctgttaagccaactactctgaggtcttcactgctaaggcttactcttaattgtgtgagagcttaaccttgatccctttaaaacattaatgggctagaaaaaaaaccattcataaaccagtgccacctctgaattttgctaccacaattcccttatttaccaatagtgcatgagctaatttggaataaagaactaggcattgtagcacaacagacattatgtgggcaaagtgttgtttatattctgtctaaatagtgcttcacatgtatgtactattttctaaatatgtatagatgcttttgtgattaataataaaacatgaattcttaaaacaattttgctgacttcatagtagcttttcaccgttttttcagtagctgctaaaatttctggagaagtttgggaactattgttttggagtgaaatgcagtgtgttagatatcacttgcagaattcttctaagggtatttattggcgattagaaaaaaaatccttgtgttataccagtagtaatacaaagtaattgttcagcttctgttaagtgtaaaggactatacaagtattgtgtatagttatctcatttattattttctgggtagctattgttattattacttcgtacaaaaagggaaaaggaggctcaaagtatcatgctccagataacagagccagtaggtagcagagctgggattgctacccaggtctctagtcctgctttttcacactatatactcattgcttcacttactccttcatacatgattccccagcatgtactcttttttttttttttttttttttgtttgagatagaatctcgctctctgttgcccaggctggcaggcagtagtgtgatcttgggctaactgcaacctccatctcctgcattcaagcagttctcctgcttcaacctcctgagtagctgagattataagcctatgctaccacgcctggctaatttttgtatttttagcagagatgaggtttcgccttgttggccaggctggtctcaaactcctgaactcaagtgatctgcccacctcagcctccgaaagtgctgggattataggcatgagccatcatgtccggcctccccatcatgtacccttaaataccatcaagcacagttccattgtgtaaaaacttggcttgatttaacctgttaattggaacactgtcattaatggaaattaggaatatgaggtaagctagaggttttattttaatgactttgggttattaaatctataagaaatgaaattcatttagtcataattaatgtcatgtttctgcatctatattacttgttgggtttacagacgaggtagtgtattattagtgggaagctttgagtgctacatcatctccctttctataaaataaattgagtacgaaacaatttgaattaaaacacctgagtaaatagtaactttggagacctgctgtactatttgtaccttttggatcaaatgatgcttgtttatctcagtcaaaattttatgatttgtattctgtaaaatgagatctttttatttgtttgttttactactttcttttaggaaaacaccagaaattattgttggcagtttttgtgactcctcttactgatcttcgttctgacttctccaagtttcaggaaatgatagaaacaactttagatatggatcaggtatgcaatatactttttaatttaagcagtagttatttttaaaaagcaaaggccactttaagaaagtttgtagatttttctttttagtatctaattgtagcacctttgtggacagtggatgtaatattaagtgacagatgggaaaaggatttttaaaaaaatagcaactgtttcagtggatgaaataaagattattagcagagaaaatgaatattgggcataactgtcctggtgaaagacaatctcataaatgaacaatttcataatttcgtaaatgcaactgcattttattttcaaagagaaggaaaattatagtcactggaaacggaaagagaagttagaggtaaacataggacacacaagaaaactttcattttgtttattttcttgtttttcttttgagacagggtttccctctgttacccaggcttaagtgcagtgacactatcatagttcactaacccctcaaattcctgggttcaagtaatcctcctgccttagccttagtaggtgtaaatacaggtgtgtaccaccatgcctggcgaattttaaaaaaacttttttatagagatgagctctcgccgtgttgcccaagctggtcctaaaacgctggcctcaagctatcctccggcctcagtcttagcctcccaaaatgctggggtttcagtagaagccaccatgccgggccacttctgtttcttttccatgtagagttctttgcaggaggaggttagaataggtgtgcatctcctaaatagttgtcgaatataactaaaaagttaaccaggactctaaatactatttacttctaaaatttgttaattgggaacatttagggtttaactgatctatatcttatgtctttaacaattttgaatgataattatatgtaaagtaagaacagtttgtgaaatagttgaaaatatccttacatgaaagtgaattttaaagcacagtttatgtaatgttaatgttttgttttgtatctgttaaaaatttgtttatatgaacaagtttacaggtttactgtggtgagcccgttgaatatagtgggttttttttgtttgttttgtttttgtttttgagatgaagtctcactcttgtcccgaggctgatgtgcaatggcgcgatcttggctcactgcaacctctgcctcctgggttcaagcgattctcctgccttagcctcccgagtagctgggattataggcacctgtcaccaaacccggctaagttttgtatttttggtagagatgggatctcagcatgttggccaggctggactcaggtgatccgtctgcctcggcctcccaagtgctgggattacaggtgtgagccaccatgccgagcctgaatatagtgtttttaagttgcaggactttaaaaataatattttgaaatttttctaagttaaattccctgttaaaatggtcatgcaggaatatacgcttgcattattcatattagggtaactgtttggtttgctagttgttagattctttgcattcctttttttttttttttttttttttttttttgagacggagtttcactctttttgacaaggctggagtgcaatggcgctatctcggctcacctcaacctccgcctcctgggttcaagcgattctcctgcctcagcctcccaagtagctggaattacaggaatacgccaccaagcccggctaattttgtatttttagtagagatggggtttctccatgttggtcaggctggtctcaaactcccagtctcaggtgatcagcccacctcggcctcccaaagtgctgggattacaggagtaatcccccacccttttaaaaaaatgagacagagttttattctgtcacccagggtggagtgcagtggtgcgatcatggttcaccgcagccttgaatctgggctcaagtgatcctcccacttcagcctcccaagtagttggaaccatagatgtgcatcaccacacctggctgatttttaaattatttgtagagatgaggtcttgcttgttgtctaggctggtcttaaacttctgggcttcagcagtcctcctgcctcagcctcccagagtgctgagatgatagacatgggccactgcccctggccgcatttttcttttcttttcctttctttttttttttttttttttgaaacggagttttgccattgtcgcccaggctggagtgcagtggcacgatctctgctcactgcaacctctgcctcccgagttcaagccattcttctgcctcagccttccagttatctgggattacagtcatgtgccaccacgcccagctaatttttgtatttttagtagaaacagggtttctctatgttggtcaggcttgtcccaaactcctgacctcagatgatccacctgcgtctgcctcccaaagtgctgggattataggcgtgagccaccatgcccggccctaactgcatttttcttagtatttgtggtttgagttaatacttgccctatgtgatgttgatttattattactggatcattaagtgaggtttaaagaagctaaatgccatttgctctatgccctctggattttaaaagtgcatgggtgtgcacgtgtgtaggtataaatgtttccatattctagtatattctgtgtcagtgatagagcagtcttagagctgtcttttccatttacttgtaggttaagaagccaaaaaaagttgtgtcatcatcccgtttaggaaaacttacattttggctattgtttcctctagtgctgctattagtggaatgattttaggtgttcaactttcagatcaatgggagacagaaatattgttctgagacatctggaagccgaatgtgttttattcctgcctgtctgaggatgtggtcttgcctttgatagggcaaagttatttgtaaacattgctttaaataaaaacatgtaaaggtgtttttgatggttaacaaaaactatgagtataatagagcctagtccctattacggactggtattgatctggtgtgggaagagtattgagcttttcagtgtcacctacctgtattcccttgaagggacccagagcccaggcaaagctctgctgaggtcgggcgtggtggttcacgcctgtaatcctagcattttaggagaccaaggcgggtggatcacctgaggtcaggagttcaagaccagcctagccaacatggtgaaaccctgtctctactaaaaatacaaaaattagctgggtgtggtggtgcatgcctgtaatcccagctatctgggaggctgaggcaagagaattgcttgaacccaggagacggaggttgcaatgagccgagatcatgccactgcactctaggtgggtccctgagtgagactccatctcaaaaaaaaaaacaaacaaaaaaaaaaaaaaaaaaaaacctctgctgaaatgctacagttaattttgccatttgtggtcagcattcttcttctaaattgctataatcttgccttcatattatgtgtctcaaatttaagcaggtatcagaatgtccacgggaacaaattgccatggctctaagcccagaatcagattcttcagatctggagtagggctggggaatttgcatttctaacacacaagtttgttgatgctgtttgtctggggtccacgcttgcctaacttctgatgtgatttatttctgccagtttctttttttgttgttgttttatttttttgagatggagtctcgctctgtcactcaggctagggtgcagtggcatgatcttggctcactgcaacccctgcctcctgggttcaagcgattctcctgcctcagcctcctgagtagctggggttataggcacactgcaccacacccagctaatttttgtatttttcgtagagacagggtttcaccatgttggccaggctggtcttgaactcctgacctcaggtgatccattggcctcggcctcccaaagtgctcggattacaggtgtgagccacccaccatgcctggcccttcctaccaatttctatcctccctgaaatgctgcacacttaggcagtcactggacaatatctgccccaaaattggtttgtataattgagaatatttaagaggttgttaaaatttgaaccactttctattcttctattaagtgtacacatctattaaagatccccttgtagctctttttatctgggccatcacatttctgcccagcagatgcagaggccctgtcctctcttccacctccccactacctctccttccctacttttggactgtaaaagctgtctttctgcagttaattgttttattctttgtaggttctactcgttgataatgttatctactgctataataattacagacggcaacaggatgatcaaatcttggatattttaaatttacattatgccttttttattttatttttttaaagtctctgcttgacagcaaataagcctaacgttccctaacaaatgatgatgtcccattaatgatttgatgacttcctgtttgtagtttttatttagagtgcttgtgggtagtttttcataacgacatttaaaaatcaggatataaataattttttaagttttttttttaggcggggcacagtggctcacacctgtaattccagcattttgggaggctgaggtgggcagatcttgtgaggtcaggagttcaacaccagcctggccaacagggcgacaccccatttctactaaaaatacaaaaattaggccgggtgcggtggctcacacctgtaatcccagcactttgggaggccgaggcaggcagatcacaaggtcaggagatcgagaccatcctggctaacacggtgaaaccccatctctactaaaaatgcaaaaaattagccgggcatggtggcaggcgcctatagtcccagctactcggaaggctgaggcaggagaatggcttgaacccaggaggtggagcttgcagtgagccgagatggcgctgctgcactccaacctgggcgagagtgcgagactctgtctcaaaaaaataaacaaataaaaaataaaaaaattaaccaggcatggtggcgcatacctgtagtcccagctacttgggaggctgggacagtagaatcgcttgaactcgggaggtggaggttgcagtgagctgagatcacccactgaactccagcctgggcaacagagcaagactctgtctccaaaaaaaaaaaatgtatttttctttgaagcttttctacttttaaatgtaatgtatagtattataacaagtgaacaaaatgatacaaagaagtatggcgggaaaggtgtggtagagatgggaaaacatatttcctccagcctcttaggttcattggaggagcttgggaattcaactgacacacgacagatttacaggagaaaagttttatttcaagtacacatgagagcttcatagaaaagaagtgaagacctaaagaaacagactggagagttcatatgccattttaataaaggataatgtattagtctgttctcatgctgctaataaatacatacccaagactgggtaatttataaagaaaaagaggtttaatcgactcacaattgcacatggctggggaggccttacaatcatggcagaaggtaaaggaggagcaaaggcacatattacatggtgtcaggcaagagagtgtgtgcaggggaactgccctttataaaaccatcagatctcgagagacttattcaccatcacaagaacggcatgggaaaaacctgcccccgtgattcaattacctcccaccgggtccctcccatgacacatggggattatgggagctacaactcaagatgagatttgggtggggacacagccaagacatatcagataataaattgtggagaggcagtaagattgaagaaaagaggtttgagcttcgaggggtggtaaattgtgggaaggtaattatttggggcaaactaatggcacataaggattgttttagtaaggcttgttatgcatacccaaaacaagtgccatctccagtaatttaagagtctatggtgatcaagagtagttctcttcctgctagaagaggggtgggagagaacaccttcacaaagggaaatttatattctgccttcatgcagaaagggggcgagcagagagttcctacgtatactgtttcttcattatcttcctctcaaaagaatacttaggctaaagtggcatgatttggggtgacattctgatcctcttcagtgacaatccttgatatttttccttctttctctccaggtaaacagtgttaacatcctggtatgcttcccccaattccattatactaactctgtattgtgggttaaagattttttactttgatcagcagtatttgaaacatacctgttatactagatgtactctgactgtaaaatagtggtcagtgttacttctttaatgatgctgtgggattaaaggattttattataaatgctgggaagagcctggatttgaggaaggtaagcagtgcagttaggtggatgtagactagaagaggtcatttgttctcatttcattgttgcccctatgacatgcccgtttctttcttttttttctttttttttttgagacggcgtcttgctctgtcgcccaggctggagtgcagtggcgcaatctcacctcactgcaagctctgccccccgggttcatgccattcttctgcgtcagcctcccgagtagctggaactacaggcgcctgccaccatgcccagctaattttttgtattttcagtagacacggggtttcaccatgttggccagggtggtctcaatctcctcacctcatgatctgcccgcctcggcctcccaaagtgctgggattacaggcgtaagccactgcacccagcctacgtgcccatttcttaaagtagaaaatttagtagttgatgatgtcagggaagaaaagctttttctctgccttacgttaagtagttgggggcaaattaaattaataaaagacagattagtgagagaaaaggctgtaagaatttggactttatataccatcataatagaggaagtaaagggagatgaagggcacttaagggaaaacagatgacttgtaggaaagataaatgaacccttaagagaatagatgagaaatatgaaggttttgtgacaatgtctgtttaggtggttacttctcttcttgttatgagagtcagtcttctggttgctggaaactgctaggagatttataacaattgggctctttcgagaggctcttcttttaagcagataagggagttcacaaaaaagcctgttctcaaatgatttcagcacacacacacacacacttacgacacagttaagtactgtgccagtaagatgtgagttgtgcatttcttttttttctctgagtagactgtttgaggttatttatatcaggacttgttatgcaggtaactgaaaactcaacataatctaggttatgtagttaaaagtatggagagaaggtaggctttatttagagttgcttgatcctgtagatctcttctaccttttgtaattttaatttcaaccaaggatggttccctttttggccctaggaccagttagcagttggggcaccattccaagcaagagtcctgcagtttgtagtgatgggaccatttaaacagtgattgtgaccagggacatagaatgggatgattggcccgaggtaaccatggttgggtatggagtcagcttccctgtaggaagagatagacaaagtctgagcactcctgggaagggggaggaagggaataactgttgtgtaaatcatcagcagtgtctactaagataccatctgtaaccataggcttctatgttttataatataaggctgtcttttaaataaatcagattccctgttaaagatctgttctagattccctagggggttgacctcatatagtatcttctttttctttggttacaaacttttaaacttgtctgaggttataaggtgaattcaactgtccactgtcaatgtagatatttttaatggatttagggatttaaattacatgattcagaaccactttgaggaagtctagggaatatcagttgtttctgtataatttctgaaagcttcactgttttctaggtgtgcacttaattcatgtgatgaagggaacagtatttacatgagtggtttggttaatttttcccctcctaagcttagctttgtgtatcgtgcgtgcttccagtgtttttgtggctgctttacataagtcttttagaagtattttctatttttgaagtaaatgtggatcaaaaccaccccaagacaggattgaaaaaaagacagtttttcgcaagaaagtaaataattttatttagcttgggactttaaatgatatgtcttaaatgtaaacatttctatactgcattttggccatcttttgatactagttttcagatgcatattgttatttcatttattattggaaaagtagtaactttaaacaaatttttattgaaaatgctgacagaggccgagtgtagtagctcacacctgtaatgtcagcactttgggaggccgaggcgggcggatcacgagctcaggagatcaagaccatcctggctaacacggtgaaaccccgtctgtactaaaaatacaaaaaaattagccgggcatggtggcaggtccctgtagtcccagctactcaggaggctgaggcaggagcatggcatgaatctgggaggcggagcttgcagtgagccaagatcgcgctactgcactccagcctgggcaacagagcaagactccatctcaaaaaaaaaaaaaaaaagaaagaaaatgctgaccaaaaaaaatgaaatagttttaaagaagccacagttgtgtgatcctgatacaactatatcattattgtatgagtatatatgagttataaaaatagtatatgtaaatgcttcataatttttattattagaaatgaaaaagtataacaaggggggtattcatattctctccacttagaattaaccctcaacatgttgacatctttgtttatagtaatccttttttgttttttttgttttttattatactttaagttctagggtacatgtgtacaatgtgcaggtttgttacatatgtatacatgtgacatgttggtgtgttgcacccattaactcgtcatttacattaggtatatctcctgatgctatccctcccccctccctccacccctcaacaggtgtgtgatgttccccttcctgtgtccaagtgtcctcattgttcaattcccacctatgactgagaacatgcggtgtttggttttttgtccttgcgatagtttgctgagaatgatagtttccagcttcatccatttccctacaaaggacatgaactcatcattttttatggctgcatagtattccatggtgtatatgtgccacattttcttaatctagtctgtcattgttggacatttgggttgattccaagtctttgatgttgtgaatagtgccgcaataaacacacgtgtgcgtgagcctttatagcagcatgatttataatcctttgggtatatacccagtaatgggatggctgggtccaatggtatttctacttctagatccctgaggaatcgccacagtcttccacaatggttgaactagtttacagtcccaccaacagtgtaaaagtgttcctatttctccacatcgtctccagcacctgtcgtttcctgactttttaatgatcgccattctaactggtgtgagatggtatctcattgtggttttgatttgcatttctctgatggccagtgatgatgagctatagaaatcctttttagaaacaacagagccttgttgtaaaacaggtaaatgtacgtgaggacttcaaaaagtttgtggaaaaatggaattaaaagataaaatttaaaaacacattttaaatttatttcccaacataagctcctcaagttcaagacacttttataaatgatgatctcagctgtttagttcatccgtaaagaactgagggtactagaaattttaccatgtcaatgcagtctctttacattactaactaaagaaaaataggtgctctttaaagatcttttaagattaggaacaaaaagaagtcagaagaagccaaatcaaggtggatgcttaacgactttccatagaaacttacaaaattggccttgtttgatgagaagagcgtgcaggaacgttgtcatggtggaaaaggactttgatgatgctttccctggcatttttctgcaaaaacttgggataactttctcaaaacactctaataataagcagagcttatgttctttatccccccagaacatcagcaagcaaaatgcctgaacatcccaaaaaactgttgccatgacctttgcccttgactggtccacttttgcttcgactggaccacttccatttttggtagccattgctttgattgtgctttgtcttcaggatggcattggtaaagccatgttttggctcctgttacagttctttgaagaaatgcttcaggatcttgatcccttgtttaaatttctatggaaagctctgctcctgtctgcagttaatctgggtgcaacagttttgtcacccatcaagtgaaaagtttgttcagctttaatttttcagtcagaattgtgtaaactggaccaattgttgagatgcctgtagtgttggctattgtttctgctgttagtcattagttctcttcaattagggaatgaacaaaattaatttttcctgaaaaattgatgtggatggtctgccgctgtgggcttcatcttcgacatggtctcatcccttgttagaacaagttatccgtttgtaaactgctgatttcctaggagcattgaccccataaaattttcataaagcatcagttatttcattattcttctatgcagacttcactataaatttgctgtttggtcttacttcaattttagcagaactcatactgctctgacatctaaactgatgtcttagccttcatagtgtctctgactagatcctattcagacgtgttatagcaaattagtaaagtttattttggtgccaaaaacttttgaatccacgcatagttttttcacaacacattttccatgaactttttgaagacccttcatatattataagaagaaagttaaaaatatcccctgcatctactactcagaaataaccactgttaacattaagtctgttctcaactctaggcattattgagggttttgaggacaggtcttgaaaatttctatggctaccttttactgggtggagactagcatgtatagttgaccgcataggttaatccctccactcaaaaagccacaattttaaagtgtagtattcactagcatttagtatattcacagtgttgtgaaatgaccaccaccatctagtttgaaaatatttcatcacaaccaaaagaaaacctcatatctattagcggtctctcctgtttccccagacaccggcaaccactaatgtactttttgtctctgtggacttgtcagttctggacattttatataaatggaatcatgtgaccttttatgattgacctctttcacttagtataatgttttagaggctcatccacattgtagcatgtgtcagtacttcatttccttgtgtattggtccattcttgtactgctataaagaaatagctgagactgagtaatttataaagaaaagaggtttaattggctcatggttctgcaggccgtacaggaagcatgatgatggcacctgctcagcttctggggaggcctcaggaaatttaaaatcatggcagaaggggaagtgcggcgtcttacatggtggagcaggagcaagagagagaagggggaggtgctccacacttttaaacaactagatctcaggacaagtcagtcactataatgagaacagcacccaggggaaaccgccctcacgatccagtcacctctcaccaggctccacctccagcactggggattccagttccaattcaacatgatacttgggtgggggcacatatccagaccatatctcctcgtatagctgaatagtattcccttatatggacataccacatttattattaatttattgattgattgacaggatcctgctctgttgtccaggctggagtgcagtggtttgagcatagctcactgcaggccttgaattcctgggctccagtgatcctcccacctcagcctcctgcgtacctgagattataggtgtgtgccaccacacctggctaattttttttattttttagcagagacagggtttttgctatgtttcccaggctggctttgaactcctgggctcaagcaatcctcctgccttggcttcccaaagttgtaggattacaagtgtgagtttagagaggtataatttcttactcaacttcaagtattttatttctcttatcatttgttgtttggtttgttaattatttggaagtatatttttaaatttccaagcttagtgtgtgtcagtttcataaaagttccccatgtatttaaaaattggatgtgtactctaattttgggattgctttttcattgtctatatatgcttgctaatttttgatctgctgggttactgagaaggatgtgggtttctccatctagttctatttttggttaatatgttaggcacagagctgttgtttttttgtggtgaattgaatcttcatcattctttagggactctgtccttaataatgctttttttgccttacattttgtttcattgtaagagagctatgtcagagtactttttaaaacactttttaatatggtatatatttttttcttttttaatgaggttttttaaccgtaagtttaagcaaaataaagcttaataactggattttatttagttttaaatttaatttgatttttttttttttgagactaagtctcactctgtcgcccaggctggggtgcagtggtgcgatctcagctcactgcagcctccgcctcccgggtttaagtgattctcctgccttagcctccctaggagctgggattacaggcgtgcgccaccacgcctggctaatttttgtatttttagtagaggcgggctttcaccatgttggccagtctggtctcgaactcctgacctcaggtgatccacctgcctcagcctcccaaagtgctgggattacaggcatgagccaacactcctggctaatttaattcgatttttttagtagcagttttagtctattatgtttgttgtagttactagtatctttggatttatttctacctaattatttggtgattcctcttcttcctggttccacttacacattaaaaaaaaaaacaaaaaaaacttagaatagagatggtgtctcactatgttgttcaggctgctctcaaactccagggctcaagttatcctcctgccttggcctcccaaagtgctgggattacaggtatgagccaccatacctggtcccccttgcccattctgttttacttttgtattgcttgggtttctaaaattccattttgtcctctccctttgctcttccccaatcctatctcatcacacacactggtttggaagatagccacttttttttttccaatgtgtttacttatcttatcagagtcaaaagcctatcagtatcttctcagatatcccaaaaaatactaggaccttaagacacctaaaatcaggttacatttcttcataattgtctagtattctagttctatcagttttacctctcagatctccattctgtaagtcaatgttaagtttagatttgtccatatgcatacgagtttctttggtattcaatacttcctgtatatttttaagaagttcctttgttggaggtctgttaggttttatttgtttgaaaatgtctgtatttcacccttgttcttgaaggatggtttttctaggtatacagttcttttttttttttctttgatacagttttgctcttgttgcccaggctggagtgcaatggtgcgatcttgactcactgcagcctccacctcccaggttcaagtgattctcctgcttcagcctctcgagtagctgggattacaggtgcccaccatcacacctggctaatttttggtatttttagtagacggggtttcaccatgctggccaggctggtcttgaactcctgacctcaggtgatctacctaccttggcctcccaaagtgctagggttacaggcgtgagccaccgtgcctgacaaaggcctaactttccttcctcattcttttcatcttgtttcttggtttcatcatcccattttttagtttcttttcagtctccttttgtgtagcctgaagcaataactgtgtttctgatgcctaggtaagtatactgtaggtaggctgatactgttcagctagtacatagtagaagtcagatgtcacatttttagaatactccagttctagataagaataccttgttgggtgatatattttattatcctggattgtttggcggatgtaatggattgctgaagacgcccagtttcctgtgtggcccttgagtatttattttagtaagttagaggctagttgttcacttttcccttgtttaactggggactcctcagcagccctttcaaaacagtataacctcatctgagaaaggaaaatgtaaggatattcattaagttttcttctctccagatttgggattatttttaggaattctcaagagttttgttgacttaccaactaggtttcttgaagatggtgagtgaggataggaacttggcctggtttggctcacctctcagattcattggaagaggcaagttcattagcacagtttcagtccaccattacagcatttttttcctgaattattataagtcttagtcaatatttccagataatcatcattatctgtttaaattactgcacagtattctattttactgatgtaccattgtgcaaatactatgatgttttattatttttaagttttgctataacagataagtctgcagagattttattcagctctgtattgttttgcttctgttgcattgtttcctcagattgaatttctaggagtagaattgctatgtcaaagagaataacaagtatctctgagccttgccgcatactgcttttttcatttttaaaggttataccaagttagagtctcactagaactgaatgagtgtactaattttactgtagctagtttctttttttttaaaaaaaaaaaaagctgtagaataatctcaaggttgcttaaatatttctgtcttttattcttacagcatttcctgtggattagttcactacttattttcttatctgtgagttgtaagtgcttacacatgcccacttgatgaccttgatgttttcttacacatggaagcaagtgctttttgtaaaagaatatattaacctttatctttttacattttgtgaagctttttttttaatgtttcatcttttaaaaattaggtttattcagaattttaaattttaatattatattgaatttcttttggttggtttaaattgagaaagttattttatgtatattctctttttttgctagctttctgtaatttgattttaattccttattccttgcatagtttgcttctggtatgttaaagtgtgctctctctaagtgggtagtaattaggaacaatttatctcaacctcatttattgaatgttttaaatcaagagaacggactctgttatattaagcttctatatataattgtctgtttcactgtaatgcctagtaaggatacacttcattctttttttagatgttctttcacaatttcatgtaaattttagttgttttgtttcaaaaaacaattcctattgaacaatctctaggaatagatagcttaataataatattagatctagttttctcttttcatagtttacctcttctttcttttctttcttttttttttttttttgagacggagtctcgctgtgtcgcccaggctggagtgcagtggtgcgatctctgctcacagcaagctccgcctcccaggttcgcgccattctcctgcctcagcctcccaactagctgggactacaggtgccccccaccactcctggctaatttttttttttttttttttttttttttttttgtatttttagtagagacagggtttcattgtgttagccaggatggtctcaatctcctgacctcgtgatccgcccacctcggcctcccaaagtggattacaggcgtgagccaccgcgcccagcctctgtctctcttttctttttctttttcttttcttttcttttcttttcttttcttttcttttcttttcttttcttttctttcctttcctttcctttcctttcctttcctttcctttccttttcttttctttcttttcttttcttctctcttctcttctcttctcttctcttctctgtctttttttgacgagtctcagtatgtcacctaggctggagtacagttgcacaatgttggctcattgcaacctctgcctcccttgttcaagtgattgtcctgcctcagcctgccaaatagctgggactacaggtgcgcactgctacgcccggctaattttgtatttttagtagagatggggtttcaccatgttggccaagccggtctcaaactcctgacctcaagagatccacctgcctcggcctcccaaagtgctgggattacaagtatgagccacgatgccagtccaattcttgtgtagttttttaatcagctgaatttaacattcaaattcttcttttaaatcttccaataggcagttatctttataaagatcctatataatcaagactttgtttctgaatattttatgtatgtttttgctactgtaaatgagatctatttctcattgtggtttcttgctgttattactggtaagaatttagtgaaacaaagtacttaagagtatgtctttaaattgtgagattttgatgaacttttaagaaataaaattctttagtttcttagagctttttgagatttctaaggtagatccttggtttgggcaacatataactattacaagttttgcacattgaacgttatttggtaatttttagagaggacattttaaatgtttaggaaaaatataaataaaatgtagaatactattgggggcatatacatcatcagcactgtaactgtttcatatgaatcatttttgtacatatagaactctaaagtcctaatgaacagaattttacatttctataaatagaaagtccttaatagttgtgactgaataacttatggatagcaaattatttaactgaaaacagtaaaatttaagtgggaggaaatatttgctttataatttctgtctttacccattatttataggattttgtcactttgttctgtttgcaggtggaaaaccatgaattccttgtaaaaccttcatttgatcctaatctcagtgaattaagagaaataatgaatgacttggaaaagaagatgcagtcaacattaataagtgcagccagagatcttggtaagaatgggtcattggaggttggaataattcttttgtctatacactgtatagacaaaatattgatgccagaattattttataagttccctgtccccaagatgatgacttcacatctctgtcaaacagaaatcgcccaacaggcccttgtatgatgtcatttaaacaagccctattttaaatgtcacctccactggtaacaggatactcctaggaggatcaccaagcccaattcttctaggagtagtgcattgattaggctttggggtttccaagcagttcattaatgtcacttttggaaaaagtctgtctttcataccagcttattaattccctatgggttcacacggttttttttcctggattttcatcaaacatgtgtaaggtactcagtacaaagaagtttagaaatccagaacaaagcagtgtatttaagtagtagtaaacttccagataatctgatgcccatatctacatatataaaaaatttgcaaatagttctgtagagagtccaaacatggagtagatccctaattaagagcctttgcattaaagtccaccttcctcatttcatagctaaggatattgaggctcagagagtttatgtgtctggagttaaagttattttgtgtttccttaatttttgacttactagaaagttaaagtacctacagatttctgtgtttcactatatgttaacttgcttggctggaagtttttctgctgataattggttttatgaaggaagaatcctgttaagaatgcatcattggactgggtgtggtggctcacgcctgtagtgatcctagcagtttgagagaccgaggtgggcagattgcttgagtccaggagtttgacactaacctgggcaacatgatgaaaccctgtctctacaacaaatacaaaaattggccatacatggtggcacgcacctgtggtcccagctactcaggaggctgaggtgagaggatcacttgagccagggaggttgaggctataatgagccataattgcactactgcactccagcctgggtgacagggtgagatcctgtctcaaaataagaaaagagaatgcatcattggccaggcacagtgactcatgcctataatcccaatactttaggaggatcacttcagcccaggagttcaagactagcctgtgccacatagaccacatttctaccaaaaatcaaaaggaaaaaacttgctgggtgtggtgatgcacacctgtggtcccagctactcgggaggctgaggtgagaggattgctttagcttaggtggttgaggctgcagtgagccatgatagcaccactgcattccatccagcctgagggacggagtgagagcgacaccttgtctttaaaaaaaaaaacagaggaatgcatcatagtatatattaaattattgcctatttttttatctattttattgagtgctaataagaaaattaatggcaaaaacttgttttttacagtataaattaagtttaatttcattttaaaattaagtaaatttgttttattaaaaagtatgttgaaagcaacataaatagcactcaaattgagacagaaactgtaactgtagtataagaagcattaggctgggaattgggaaacacgagttctagttgcagcttggaaactttttctgaagctctttacaaattacttaatttctctggttttcaccacattgttctatagcattaacatgttggattcattgctttaattcttagacctacgtgtcatcagaaatgccattacactttgaggatttgagccttattttaaataaagttgtgatcctcatggcagcctaggtttacatgtgttaaataaacagtattctgtaaataccattgtctttcatgtttagtgatgttgctgttgttaacactgcagtgaaatgcatatataagcaaactacattacatactcatgaacatggtcctttgttttgaaactttgatcactgattgttcgcagtctttcattgtggaactactctttcactttgaatgttttgagaggttcctttgttcagatcagtccgatttcgtttctgggtgggtctctactttcccttttctcactggtcaagcgaggtctgtctaattgtttgctactactaacatttgatggccacgcttcagcaagtacatttgtagattctctctctctgtctctcttaatttgtggtctagagatcatattggttaatgaaattatgaagagggaatgtatttataaaaactcaaattcttgatgcagaaggtctagctgattgtgaacccaaaatatccgagacaggtcacaaccaatttagaaactttattttgccaaggttaaggatgcatccatgacatagtctcacaaggttctaatgacacatgcgcaaggtggttagggtacagcttggttttatacattttagggagacatgagacatcagtcaacatgtgtaagatgtacattgattctatccagaaaggcaggacaacttgaagcaaggggctttcaggtaataagtagataagagacaaaaggttgcatacttttgagtccttgatcagcctttcactgaataaacaagcttagtcttgttagtgaatctgcgtttttacataaacagtaggtcagaggaagcaatcagaaatgcatttgtgtcaggtgagccgagggatgactttctgtccctcacctgtgaagataagctatcagtttccattgctagggtgaaattcaacagaattgtttgagagtgaacatctggaggcccacaaggactttccttgtggaggggaagtatgtagtgagggaagtatgtagtttttaaatctttgtcgctatcttatttagaaataagatggaaggcaggtttgtctgacatagttcccagcttgacttttccctcggcttagtgattttgcggttccgagatttattttcctttcacatatcagtcagatcatttggtttgtgaagtttcctatgcttaacagaaaatatgtgcactagttttcctagagtttcattgtcagagtctcaagtttttgtttggaaattgtatttggtcacattaattatactctatgttagttccaaagaaatacctttggttaagaaaagaattctcatgcataactcctcgagggtggggttacaccttaatccatcctcaggtgctcatggtaattggggcaaatatgttgcccagtgctggtgctctgcagccttggatgggtttacccagaaagcagctttcaagtcagaaactaacattcataagggagttaaggattttataaatagatatccataattcatgtagttttcaagtaagtagtatttgaatcttttctggttagataataattgtgagtatgttgtcatataataacagtatgtttttcactatttaaataattttagaattacattgaaaaatggtagtaggtatttatggaatactttttcttttcttcttgattatcaaggcttggaccctggcaaacagattaaactggattccagtgcacagtttggatattactttcgtgtaacctgtaaggaagaaaaagtccttcgtaacaataaaaactttagtactgtagatatccagaagaatggtgttaaatttaccaacaggtttgcaagtcgttattatatttttaaccctttattaattccctaaatgctctaacatgatgtgaatgttctatgataagttttactaatgtagtcatcaggtaagagtcaagctttcttccatagagcagtcagctgtcgcaacaccatttgttaaatagtccgtctgttctccattgactgaagtggtactttgggtctattttaaagactctacttttacctcgtctcaccattcttttgtctacacaaaatatattttatcgcttattctgtgttaccatatctattagagctagttccccctcatatctctgctttagttattttcacatgtttcttttatcttttttttttttggagatggagtctcgctctgttgcccaggctggagtgcagtggcatgatctcggctcactgcaagctccgccttccgggttcacgccattctcctgcctcagcctcccgagtagctgggactacaggcgcccgccactgcgcccagctaattttttgtatttttagtagagacggggtttcaccgtggtctcgatctcctgacctcgtgatccgcctgcctctgcctcccaaagtactgggattacaggtgtgagccaccgcgcccagccttatcttttttttttttccccctgagacagagtcttgctgtgtcgcccaggctggagtgcagtgacgcgcagtcttgactcactgcagcctccacctcccggattcaagcgattctcatgcttcagcttcctgagtagctaggattataggcatgcaccaccacgcctagttcatttttgtatttttagtagagatgggttttcaccatgttggacaggctggtctcggactcctggcctcaagtgatccacctgcctcagcttcccaaagtgctgagattacaggtgtgagccaccgtgcctgacccacatgtttattttttctaagaaaactttactatcatttatcaagttaagaaaattattctgatatttcaattgggtgtttaaattagttgagggaaatatgaggccattcactagatgataggttttttttgttttaatcatgtttcatgttgaaacaaaaaagttttttcctgccagttttctggctaatctcaggaagtccctgaaacaaattattgataagtaaaaaaaattatttaaaaaattttaaattatatttaaaatcttctgtgacttatggtggggggaggctaaagcctttctccttctgtactgttctggaaactatggcctgttctactccctcccctcctgaattttcccagaactttacaggtagcttttatatatatgatcccctgtcgtctgtttaacaagtactttgagtgtctattatatgcagacattctaggtgttcagacaccctagtaattagtttgttcctcataattctcagtaaagaagacatgtatatttctcattttataggtgaagaagctaagactttacttttcctcagttagacagctagtgctggtgggtgcctaaacttagatcttccattgccaaatctaggtgtgttgtttttccagcacactagaatcctcctggttcaagaaatgtatatattttagcttggataagatacaacttttggagtgttctaatcatcttcaagtttttcgtggattagttataacatatgaaaaaagatagggctgaatgggccacatgatgccaaaagtgaaaaagtcactcactagattatgacctgcagaatctggtccttgcctgcctctgcttttatattttgcagcttgtcccttcacacagtggtctcacttttataatgtctttccctcatgcatttctttaattctttttatttgcctgttccatagtagtctgtttgtgctgctacttgcccctgtactgttcttgagctatacatatacatgtctgctgtgccattgagtgattccatcaaggccacaattatcatcttgatgaactgattttctcccactgctgataattacttctctctcctttctttctcctttacatcacctctttttgttcttaatttcattccctccttgatgccagtgagtatttttttcttattttattctcatcttccttgagtattgtttatttcaacctctttttttttttttttttttggagaagggtttggctttgtcgctcaggctggagtgcagtggcacaattttggcccactgcaacctccacctcctgggctcaagccatcccacctcagccacccaagtagctgggactacaggtgttgcccactgctttgtatttttaatagacacaggatttccccatgttgctcaggctggtctcgaactcctgggctcaagcagtccacctgccttgccctcccaaagttctgggattacaggattacagatgctgtgcccggcccaacctctaattttaattttctcttcaaattgttcaataagatttagtttcaagacattttcctggccgggcatggtggcttacgcctataatttcaacactttgggaggccgaggcaggtggatcacttgaggtcaagagttcaagaccagcctggccagcgtggtgaaaccccatctctactaaaaaatacaaaaattagccgggtgtggtggtacatgcctgtaatcgtagctattgtggaggccgaggcatgagaatcgcttgagcccgggaagcagaggttgcagtgagttgagatgacaccactgaaatccagcccgggcaacagagtcagactacgtctcaaaaaaaacaaaacaagctgggcgccgtggctcacgcctgtaatcccagcactttgggaggccgaggccggtggatcacgaggtcaggagatcgagaccatcctggctaacacggtggtgaaaccctacctctagtaaaaatataaaacattagccgggcgtagtggttggtgcctgtagtcccagctactcaggaggctgaggcaggagaatggtgtgaagccgggaggcagaggttgcagtgagcctagatcgcgccactgcactttagcctgggtgacagaacaagactccgtctcaaaaaaaaaaccatttttcttattttgaaaacttttggtattgaaagatatttatactacagtaatgagaaatactgtgtgtgtgtatatatgtttgtgtttttttttttgtttttttctttctctctctctcttttttttttttttgacagagttttgctcctgttgtccaggctggagtgcagtggtgctatctcgactcaccacaacctctgcctcccgggttcaagtgattctcctccctcagcctcccgaatagctgggattacaggaatgtgccaccacacctaactttgtatttttagtagagacgggttttccccatgttggtcaggctggtcttgaactcctgacctcaggtgatccacctgcctcggcctcccaaagtgctgggattacaggcaccctgcctgtgtttgtgttttaaaaggggtaatagcttcagtcttttttttctttctctgagacggagttttagttttgttgcccaggctggaatgcaatggtgtgttcttggctcaccacaacctccatttcctgggttcaagcgattctcctgcctcagcctcctgagaagctgggattacaagcacgcgccaccatgctgggctaatttttgtatttttagtagagacggggtttctccatgttggtcaggctggtctcgaactcctgacctcaggcaatccaccgacctcaggtgatccacccgcctcagcctcccaaagttctggggttacaggcgtgagccaccacgcccggctgtcttcaatcttaaataaggattccatttaaatattttgtaaaaggacacagatcacagttttactcaggggaatataattgttatagcaggaattgtgccattgcgctattccaaacagtgtaaaagaacattaataaattgaattctaactacatttgtccctaaggagttgttcgttttccacttgtatttccattttaattatcattatttggatgtttcataggatactttggatatgtttcacgtagtacacattgcttctagtacacattttaatatttttaataaaactgttatttcgatttgcagcaaattgacttctttaaatgaagagtataccaaaaataaaacagaatatgaagaagcccaggatgccattgttaaagaaattgtcaatatttcttcaggtaaacttaatagaactaataatgttctgaatgtcacctggcttttggtaacagaagaaaaatcatgatatttgaagtgtgttttgttattttcgcaagccattacattctgactatttaatatgttaggtttcctatataaaataaggcatggtatgttacagtaggacacataactggaagttactcttgcacatagaaacaaaaaatggcagaaaagcacaaaacttactatagttgtaacagggaaaggaaacactagggcctacaacgtactaatgtcttgggtcatctatgggctcatgaggctctaggttatggaagtaaataccactgaaaagcaaatattaattacacatgaggcaagcctttttgagttctgtatgtcattttgtagattttgagttcattctagtggcaccatttgagatcattttcatgtaattaaaggaacacagcaacctggcactgtgttattgcccttagaatggaatgaatatatgtttagcacaaggtaggaagtgatgcgttaagttggaaggctttgccgatcatggtgtgtatgttgactaacctttattgtgcctttaaaaaatatactcaagaactaccttaaccaagtaattaaagtcaagattaccagttgtgggacaaatgacatgtacttcctggtgtgatatagaaggaaggacacagtatcacctatatagtattcttgaccagaatatttaacctgattttaaacaagaagtaaaaattcaaataaatttagattgtggtgcattcaaggcctgaactttaataaatgtccatgtcacggcagcaaaaaagaaatcaacaggtcttaaagagacagggcaaccaaacgcagtaggcagtagttgattagatcccaatttagaggttggagttggggaatagctatagaggacactattggggcgaattgagaaagtttaatatgagacaatatggtgttagtgtcagatttcttgtgtgaaatggtagtgttatgattaggagaatgtccttgttctcaggatatgcatgctaaattatttaaggacaaatatttttttaaaaggttatgtgcatgagtaattctataaattgtgttgctattatgaattgtcatggtaaatcaaaaggaaacataaaactcaaaaggttttattttaatacactttatgtattgaaatgaatggaattgatttgtaaagattacatttttgcttgttggtgtcagataactgtgacgtaataatcttttgctgaattatgtttcttaggctagatttcattttaaagaaccctgtaaataccatttatttgaactgtggatcttccttaaaaaataatatttattaagcacctagcagggtaaagtttttagattttaacatttaaattgaaggttttatattagaagtcaacctgaatttaaatgaaacttcttcttggtctgatattacatattatgagctatttttatttaaaaatgtaatggcggccagacatggtgattcacacctgtaatcccagcactttgggaggctgagctgggaggattgcttaagcccagaagtttgagaccagcctagccaacatagggggaccccaactctacaaaaaaatccaaaaaatattagccggctgtggtggtacatgcctgtagtcccagctactcaggaggctgaggcaggagaatcacttgaacccaggaggtcgagggtgtggtgagccataattatgctactgtacttcagcctgggcgacagagcaagactcccatctcaaaaagtgtaatggatcactttaataattttctatcatacaattaagtcataaaaggtcatgctattaagagccagttatgtgacatgccaagtatagactcttaattaagatgctttggtttgctttttatttatttatttatttttcagatggggtcttaccatgttgcccaggctttagtgcagtgatgcgatcatgactcactgcagcctcaacctcctaggttcaagggattctccccacttagcctcccaagtagcttgggactactacatgtagtagtgccaccacacctggttaatttttttttaattatcttttgtggagatgaagtctcactctgttgcccaggccagactcaagcagtcttcctgccttggcctccgaaagtgttgggattacaggcgtgagccaccctgcccagcctagttttcttttttttactataaacttattcttgtcagtatgctagcaattttacaagttttaaagtagttatagcaagtacttcactcatgtttaattcttaaaggcttctattgctatataatagggtagtctgaattcttcaaaagtgtactgaggccaggtgcagtagctcacacctataatcccagcattttgggaggccgaggcgggtggatcacctgaggtcaggagttcgaaactggcctaaccaacatgttgaaaccctgtctttactaaaagtacaaaaattagctgggtatggtggcaggtgcctgtaatcccagctactcaggaggctgaggcaggagaatcgcttgaacccaggaggcggaggttgcagtgagccaagatcacaccattgcactccagcctgggcgacagagcaagactctgtctccaaaaaaaaaaaaaaaaaaaaaaaaaaaaagtatactgaaacagaggaagataattaggtctgcttggccattgttaagttgatttttattttcaaaacatttgatcactgttgtggggaacaagggaataaaaaataagttaaatttccagcccctagattaaactaataatttttggttttcctagaattaaatgcttttatcttgaatgttctgtgaagcttttgacatgattgatagctgtatgatagtctgaatgacatgtgggtcatgcaccagcccctccaacctgttaacatttagaatctattcagaaaaatttaagcattgttaatttcctttgttttttgtctagcatgtgtcagatttttttaaatgtatttattaatagcttttaatgttaatactctagaacagtagaatcttgaaaatgttttaagtgacaattagagatttaaatttatgctgacatcctctgcatgtgatactgatgaggaaagaaagccaaactgtcttacggtcagttcgtacaatataccaggccttgatggtcacatttcaacttgctacctttttgcttacatttttcttatggtgattttgaggtgtcattctggtttctcagatacttaaaatataggaaaaggtgtgtcttaaaattgagagaatgtcttggataagcagctgtgtagttttatattttgctgataagggaaggtactctatttttgttttttgtgtgtttttgtttgtttgtttttgagacagaattgcccaggctggagtgctgtggcgcaatctcagcttactgcaacttccaccttctgggttcatgcaattctggtgcctcagcctcccaagtatctgggtttacagacatgcaccaccatacctggctaatttttgtatttttggtagagatggggtttcgccgtgttaccaggctggtcttgaattcctggccccatgtgatcccccggcctcatgcgatctgcccgcctcagcctccctaagtgctgggattataggcgtgagccacccaacccagccagtactctgtttttgatagctattcacaatgggaaaggatgtagcaacacattttaaccctatgttgagttttaggtgggttcctttgaaattttgttaaggctaacttttgttaatttttttaaaaaagtgtaaattaggaaatgggttttgaattcccaaatggggggattaaatgtatttttacggcttatatctgtttattattcagtattcctgtgtacattttctgtttttatttttatacaggctatgtagaaccaatgcagacactcaatgatgtgttagctcagctagatgctgttgtcagctttgctcacgtgtcaaatggagcacctgttccatatgtacgaccagccattttggagaaaggacaaggaagaattatattaaaagcatccaggcatgcttgtgttgaagttcaagatgaaattgcatttattcctaatgacgtatactttgaaaaagataaacagatgttccacatcattactggtaaaaaacctggtttttgggctttgtgggggtaacgttttgtttttttttttttttttttaatcttggagtagaaatatatttaaaattgatggagaaaattcccagttcttaacattagaaagggaatatattattcttaccagttagtaatctattcacatttggtttagagggaagatttagaaggtgagataaaagcttgtgagagaatagtgtattcatgtgaaacttcttccatgggttcagagcatttagaaacaaacatcccttcacactcaaagcttacctttgagccagtcctccaatagtgaggtctttgaaggtcaggccaaattggctgtgggaggacctcaggttaggataggaattattttaagacatggcactatattcatgtgaaactcgcaaaaactagccttgcatataggctcatgtatcatgtctcagctgagatgtttgagagatcttaactagattctagaaaacaaaaaaggaagtagttttggggcaaatatatttgggaaacagtttattgtatttcctttccccaaatggattttcaagttcttcatataatctaaccccaacaaataaattgcctgtttttcaaaagaaagatcatgtcttcaggtttttgtgtggggtttaaatgattcgaaagatttgaccatactgatacattcactagtaaccttagttactaatgagtaatggttttgagttaatcagttaggcctgaactacttttctggaagttagtaaattatctcacaggcagccctgtgagccatgggaaaatgtgtatatggtctttctaggccacagtcaaattacaggtatatttgtcatggcttctcttgatgaaaggcccagtatcggtttgtctgaagatatataatagcattgcttttgggggtaatatgggcagtaactctgtccacatctttgggcaggctgtggttctgcctttatatgctatgtcagtgtaaacctacgcgattaatcatcagtgtacagtttaggactaacaatccatttattagtagcagaaagaagtttaaaatcttgctttctgatataatttgttttgtaggccccaatatgggaggtaaatcaacatatattcgacaaactggggtgatagtactcatggcccaaattgggtgttttgtgccatgtgagtcagcagaagtgtccattgtggactgcatcttagcccgagtaggggctggtgacagtcaattgaaaggagtctccacgttcatggctgaaatgttggaaactgcttctatcctcaggtaagtgcatctcctagtcccttgaagatagaaatgtatgtctctgtcctgtgagaaggaaaagtatatttgcagattctcatgtaaaaacatctgagaatgtttgtcttagtttaatagttgttttcctgtggactttatatactttgtattgtcttaaaagagtgattgatggtagctacggaaaactttgatttttaaaattgtctctttaagtagacaatttataagctactggtacgagttcaccttataaatctccactaccatgtttttgcttggactgttcacacttcctggaatggtccttcttgccgtttatccaacttctttctaatttttaagtccctaatgatgggaattctatttctgtagtgatttttctggtcatacgaccgtaaggtcatgggtgtttttctctgaattcctcttgagatgcctgtaacttgaaccacgtttttattctagacattactgaaatgttttgtctttatttcactttttaggagcttccttgaaggtagggactataccttctatttcttggtatctttttctttctttttttaaaagttttttagagagacagggtctcactcttttgcccagactggtctcgaactcctgggctcaggtgatcttcctgccttggcttcccagagtgctgggattacaggcatgaaccaccgtgatcctccttatttcttagtatcttctaaagaacattaaatatagtaggtgcctagtaaattatgtattgatttaacttctttgaggttctgttgtttgtgaagaattataaaagcaatacaaatgtttgtatagtaattaagcaacaggttaatattcatgacttaaaagattaaagaaataagcaaaacatgttagctggcaactcacagaaaaagaattaaattgccaatgagcacacgagcacatgaaaaattagcaaaagtttcacccctttacatatatttggttaaaattgagaaaagaatagtaatagatggtattggtaggactgtggcaggcacacaatttacatgaccaccaaaagtgtatgcaggtatccatgtcaccacaccctggtctcatcttcattcagttttatttattttttttaatctcggcctatttgattggcacgaaatgaatgatagctgccttatttggaattcctttgattactactagtgtgcttgataatgtaaaacaatattcaaaatctgtttttcctttcatccgttgtttgttcatgttcatgacctttttttttttttcctattctcctccctccctccctccctccctcccttccttccttccctccttccctccttccctccctccctcccacacaaaggtgtgtgctaccatacctggctagtttttaatttttttttttttttttttttttagaggcaaggtctcactatgttgctcaggctggtctgggctcaagtgatcctcccacctccgccttccaaagtgctgggattacagacgtgagccatcatgcctggcccttgcccatttttctattgaagttttagtgctttttattgactttgtttatatattaagataatccattatgtttgtggcatatccttcccaatgtattgtcttaattttgtttttgtatgtgtatgttaccacattttatgtgatgggaaatttcatgtaattatgtgcttcaggtctgcaaccaaagattcattaataatcatagatgaattgggaagaggaacttctacctacgatggatttgggttagcatgggctatatcagaatacattgcaacaaagattggtgctttttgcatgtttgcaacccattttcatgaacttactgccttggccaatcagataccaactgttaataatctacatgtcacagcactcaccactgaagagaccttaactatgctttatcaggtgaagaaaggtatgtactattggagtactctaaattcagaacttggtaatgggaaacttactacccttgaaatcatcagtaattgccttattctaagttagtataaattattgatgttgttatagaacccatttaccccttaattcacagtctgggggtaggaacatgtacatcatatttctgtatctcatagtaggaccactcattctaaagcattcacagaaagaattatctgtactctttttgggacagaatctcgttctgttgcccaggctggagtgcgatctcggctcactgcaacctccgcctcccgggttcaagcgattctcctgcctcagcttcccgagtagctgggattacaggcgcctgccaccacacctggctaatttttatatttttagtagagacggggtttcaccatgctggccaggctggtctcgaattcctgacctcaggcaatccacccgtctcggcctcccaaagtgctgggattacaggtgtgagccaccacgcccggccagaattatctgtactcttgaacatcaccatggaggcattttctgctacctcccatggcagtatgttttcttgttgaattaggataacaaacaatatgctttcaagttccaaagttctagctgttattgtttaacaaaatcttcattataattagcttattttgtgtttaagagtgtgttatagaaacaggttcatttaaagctgggggttccagaaatcttgaaatagtagttatcacatgcagagtgacttatctgttgttgtttcatcctttcaggaaagtttgtcattcgtgggcttgggatctagtcagatccctgtattgatgagattcacatgttataaggctttcaaaggttttaaaaatcatactataaggattgatttcactagtcaccagaataactttttcagatagcgctctgattttccacgaacacgtttttctgcatcagttggttgcacatgagtgagataatcttggttctttatcctttgttatttgtacttcattgggaatccttttgagttagtatatttgagtcattattattattgctgtagaattcaggaacttttagtagatctggcagcataaaattttgcttttaaatcattgtttgtgttttgtatgctatagaaatgggttcagaatattttttaaaaggccagatgaagtgtgaagatagaaaaacttcatccttcactgtgaatgtttaacaaacatttgcttctactttatttttgtttgcttcctttagttgtgcaaagtattcagttctagaatgcatgagatatatgacaaagccaaaaaattctttatagttgataaataattgtggcaaaaacagctgtatagtaactttgcaagcatcatttgattaaatgcttaaaaagtcttgactcagttttaactatttcctgcaaataatcaatatttaattaaagctactccaaattagtgacactttacgtgtctgtctttctccctccccttctcccttctcccttcccccttctcccattctcccattctcccttctctcttcttcctttcctcttcccttcccttcccctttcccttcccccttccctcttctcttcccctcccccttcccatcccccatcccttcccttcccccatccctttcctttccccttcccttccctcctcttcctccttcccttcccccttcctccttcccttcccccttcctccttccctttcctcttccctttccccttcccttcccccttcccttccctcttcccttccccttcccctttcccctccccctctcctcccctcccttaccttcccatgaaatgagaaagcctcagagatagtggcttgattaatttttctttagattaagatatttgtctaagcctttaaggtttatctattgagcttttttgtctcctatttttatttttcctactatgtttgtcgaggataaaatacagcactgtgtgccaagtcataatcacttttcatttgagacttaattaaaatgcctttattttaatgatatatttggctaatgtatttgaagtaatccgaaattaagttttctaatgacaaggtgagaaggataaattccatttacataaattgctgtctcttctcatgctgtcccctcacgcttccccaaatttcttataggtgtctgtgatcaaagttttgggattcatgttgcagagcttgctaatttccctaagcatgtaatagagtgtgctaaacagaaagccctggaacttgaggagtttcagtatattggagaatcgcaaggatatgatatcatggaaccagcagcaaagaagtgctatctggaaagagaggtttgtcagtttgttttcatagtttaacttagcttctctattattacataaacaggacactaagatgaaggttttttgttgttgtttgttttcctctgtgtttctagtgcttattttttaatcagtttttttgatggcaaagaatctatctctgtgttattttgatttctgcagtatatacatctgcatgatcaatattcgatttcaagtaccaaagtaggagtaaaggaatattaacctaggtttaaaattagtcatttcactaaaattagttattatggacgatagatgtctaggtatatctttgttcataaacgaatatatcaagttcagttattaaattacacattaggtaagaaaaggacaaagaaataaaaaagcatgattcataattcctgccctctatttgtctagaatttagttgggaagataagaataacgaacgtgacacagagaataaagtggcatatgacaaatatttattcaagaaagctatatgtggacgggatgtttcagttctcatgggagaagtggattttatggtgcctttgagtaatgggtcatatttgggcgttcacacagaaagacccaagcatatgcctaattttttattattattattttttatttatttatttattttttagacggagtctcgctctgtcgcccaggctggagagcaggggcgcgcgatctcggctcactgcaaactctgcctcctgggttcacaccattctcctgcctcaggctcccgagcagctgggactacaggcgcctgccaccacgcccggctaaattttttgtattttttagtagagatggggtttcaccgtgttagccaggatggtctcgatctcctgacctcatgatctgcctgccttggcctcccaaagtgccgggattacaggagtgggccactgtgcccggcccttttttttttttttttttttaaattagaggattactagttctcttcaattataaaaataaaagaatcttatttcactgcctggtcctggaaacatgtactgcaatatacattgtgacaactttttacctgtcatgtttttagcttttacctgtgaatgtcttatcattgttcttatctgaaggatagatagttgctacaataataatagatggtgtgtatggtttttgagcctaaaaagtgtagttttatctgttgtacctatacaagcaggagaaatataacttgttaataattttaggtatggcaggctgccatcctaaatatgaagtggtctttgtatttgcactttaatgtgttgaaatcatagctttcagtgatccaggattaggcagactcttttatgcaatctcttgtttccagttagaatagaagtcgtgtacttttgataacattaattataatatattttgagccctgtgaggttggtaacattattcccattttatgaatgaggaatgtgtgttaaggagtttgcccaagagtcacatagcaagtcatagtcatgctctctgaagcagcaataacttggcaataaaataaaaatgaagcatcttctgtatgtgttaacttttcagtgactgtttatgccttccagtattctttgtaaaccttgaattctttttttcacagatgattaaagtttatcaattgtaaaggtggaggaatttgggaactagacagtgcacacataaataataaatatgttcttcaaatattgggtgggctaatgtgggaggagtttgagaccagcctgggcaacatagtgagaccctcgtctctaaaaatatgaaaaataaaaaaaaaattttttaaatgtgtgatatgtttagatggaaatgaaacaatttgtcactgtctaacatgacttttagaaaagatattttaattactaatgggacattcacatgtgtttcagcaaggtgaaaaaattattcaggagttcctgtccaaggtgaaacaaatgccctttactgaaatgtcagaagaaaacatcacaataaagttaaaacagctaaaagctgaagtaatagcaaagaataatagctttgtaaatgaaatcatttcacgaataaaagttactacgtgaaaaatcccagtaatggaatgaaggtaatattgataagctattgtctgtaatagttttatattgttttatattaaccctttttccatagtgttaactgtcagtgcccatgggctatcaacttaataagatatttagtaatattttactttgaggacattttcaaagatttttattttgaaaaatgagagctgtaactgaggactgtttgcaattgacataggcaataataagtgatgtgctgaattttataaataaaatcatgtagtttgtgg

SEQ ID NO: 5 - DNA, 23872 bp, Homo sapiens
ggcgaggcgcctgttgattggccactggggcccgggttcctccggcggagcgcgcctccccccagatttcccgccagcaggagccgcgcggtagatgcggtgcttttaggagctccgtccgacagaacggttgggccttgccggctgtcggtatgtcgcgacagagcaccctgtacagcttcttccccaagtctccggcgctgagtgatgccaacaaggcctcggccagggcctcacgcgaaggcggccgtgccgccgctgcccccggggcctctccttccccaggcggggatgcggcctggagcgaggctgggcctgggcccaggcccttggcgcgctccgcgtcaccgcccaaggcgaagaacctcaacggagggctgcggagatcggtagcgcctgctgcccccaccaggtagcggggtgggggtggggtcgaaggcgggggcatagcggcggggcgcttggaacccggcgaggggaggctcgcacagggggttgggggggtgcacggcctggccctgggctcggaggaggcggggccgcagagttggcttgaatgagtgcaggggtcgagtctggagcatttgggggtgtagcttgtaaacagggtcggaggagagaggctgtgcaggaagagggctgcaggggagacgcggagagttcgggccttttggagggaggagacgcgtcccgccaggtgggggtgctgggctaaggaaggggcgacgcgcgcagctccgggtggggagggggcctgggaggtgggagcactgggggtggggcgagaaggggaaggcgcccggcccacttggtgggcggggcggggggcggggtggcgggaaggaggaatgcctgcgggaggccgaacggggagagtccggtggtgtggggtgcgaaaggaggttcctcggccggcgcggagatagtgagttggggctccagtagtcgatcgaggtagacacttagaggtagttaagagccgcggtcgccgagacgccttggggacggtgggccttcggcctaggtgaggggccgccgagggggtgggccacgagctgcgagcgcgggggggtgtgtcaccatggggaccgcggggcctaattgggcggggcggggccgtggggagccgaagtgctgggatccggctgggtccttcggtaggtaggctgcacgtgcaccgagacgaagatagaatattttgacgtatgtggaaattcgtgtcgagtggaaaatattttattttatgaaatagtgtaatttttatggggcaccactgggcttttagaggccttaatcgggcgctggacaaagatgtgtggacgtgagtgactccggggaagcctgtcgggagttgtcctcactttatgggcagttaagtgcttttttttttttttcctttttgagagagagtttcgctcaagtccaggctggagtgcaatggcgcgatctcagctcaccgcaatctccgcgtcccggcttcaagcgattccccagcttcagcctcccgagtagtcgggattacaggaatgcgcccccacaccccgccaattttgtatttttagtagagacggggtttctccatgttggtcaggctagtctcggaattcccgacctcaggtgatccacccgcctcggcctcaaagtgctgggattacaggcgctagccaccgcgcccggtctgtttagggctttttatccgggcagctggcgacattttgaaaagcttgcttttgctgtttgccagatacatatatatgtattttgagacagagtcttgctcttttgtccaggctagagtgcagtggcgcgttcttggctcaccacaacctctgtctctggatcaagagattatcctgcctcagcctcccaagtagctgggactacaggtgcgccccaccacgcctggctaatttttgtatttttagtagagacgggtttcactatgttggccaggctggtatcgaactcctgacctcttgatcggcccgcattggcctaccaaagtgctgggattacaggcatgaaccaccgagcccggccgtttgtcagatactaaacacaaagtttaatggtcgctatttgaacaaacgaagaaataaaggctcagaaaaaataactcattcaagataagagccagttcgtgttttttgtttggttttgttttgaaatggagtctcgctctgtcgcccaggctggagtgctgtggcgctttctcggctcactgcaacctctgcccgccgggttcaagtgattctcctgcctcagcttcccgagtagctgggattacgggtgtgcccaccgcggtccggctgatttttcaccatggagtttcaccatgttggccaggctggtcttgaaactgctgacctcaagtggtccacccacttcagcctcccaaagtgctgggattacaggtgtgagccaccgtgcccggccgctagttagtggttttgagtaatggatttcaaatccatttaaatccagtttaaagtgtcctaaaggaattctgagatttttctaagtgtaattatagtgttacccttgtttaagcgaccctttcccgcagtttaaatatatatagttgtgcattagtagaatatgcttgtggggaacagagccagcatccgcaataacaaactcctggttagaaaagcatgacgtattgtttacttgagcatgaattgattgttgaatccaaaccaaacgggtgtatttattgtaaggatgtactttacattcatattgaatagcgtatgttatttgtttcttgaggttgagtttaagagacttgtaaaaataaaacgtatacatttcacctcccgttatggagaggattccagggtattcaagaaagatgggcatttgatactaggtttctaaagaaactgcagtgtctagatcactctgccgagcacagcattaggcattatggatcctggatacaaccatgaacaggacaaagcaaagaggcaattgtagactccaagtggaaaggggacggagaggatgcgggtcaggctaggctctcagctctgtaaaccgaaaccagaaggacaaataagcttagacagattatagtgagagtgggaagctggttcaggaagaggaaggtctgcaaattgtgggtaggatgaaaggaggaggagggagcattggagaagttaagcagagatccaatcatgaacagtctgatgagctacagagacattcggacttactccatgaatcatttaagccttaaaacatgttgagcgtattttttttttttttgagacggaatttcactcttgttgcccaagctggagtgcagtggtgtggtctcagctcactgcaacctccgcctcctgggttccagcgattctcctgcctcatcctctcaagtacctggtattacaggtgcctgccaccacgcccagctaatttttgtgtttatagtagagacgggtttcaccatgttggtcaggccagtcgtgaactcctgacctcaggtgatccacccacctcagcctcccaaagtgttgggattacaggcgtgaaccaccgcacctggccgtgagccaccgtgtctgtccgagcatcttttaatgtttgtcatttagatttcttcttgtgctgaagtgtttgtcttttgctgtttcttttttttttcctagttctttgtcatttgtgtgtgatataaatgtcttctttcacaatgagttctttcatttagtttatggctttgttgttgttgttgaataatagaggtctcactttgttgcccaggctggtgttgaactcttgctctcaagcgatcctcccacttcagcctcccaacctgttgggattacaagtgtgagccaccacacccagccttatggcatctttcgatgaacaaattattgattataatgtggaatttgtccttttattttctctgtggttagtgtttctataggttttatttaagaaatccacagggaggctgggtgcagtggctcatgcctgtaaacccaacactttgggaggccaaggcaggccaacatggctagaccctgtctctccaaaaaataagaaaattagccaggcatggtggcgtgtgcctgtagtcccagcttcttgggagactgagatgggaggatcgcttgagtccaggaggttgaggctgcagtaagccaagagatcatgccatgcactccagcctgggtggcagagtcagaccctgtctgccaaaaaataaaataaaagttggtgaaaatgttgattatatattttaggaacaactagtaattgacatcaaaattatgggctaaagagaaagcaaaaataatgtgattttaaaccagaattcaaaagatctgtttagcgtatgtttagacaaagccattacttattatatcaaagttttaacatttattttgtgagctgtcagcttttcctcttaacatttttccccaccgtcttaaaaaaccccaagaataccggacatttaagactcacttaaagctttaaaagcacttgcaaaatcctaaaatcataatttaaggtgtttttggagggcaggagcaatggtggcaggcagtgttttgctttgttgcccaggctgaagtacagtggcagatctcggttcactgcaccctcgacctattcggctcaagtgatcctcccacctcagctttctgagtagctgggaccccaagtgcacaccaccccatgcctggctaatttttaaatttttttgtagaaacaaggtctcactgtgtagcccagatggtctcgaattcctgggctcttaagagatcctcccaaagtgctgggatcataggtgtgagccaccacacctggcctattttggcattcttgaaaaccgcaggattaccacggataaaattttaaaattacctttaaagaattcaggtttacacacaaaaaaaatttggtttgttagcagtgagtgaagaaaaattttgagaaatgtttaaaatttttagttttgttacacaatacattttactacctgtttaattatcttttttgactcagaaaccagtttcctgggtccaggatgtttagtggtactctttttcttcaagctttttagcattggaggaactgcatattagtaaaatttttagtcttagcattttatagcttactgctatttcttttctttcattctttctttcttttttttttttttttttttttttttgagatggagtctcgccctgtcacccaggctggagtgcagtggcacgatctcggcttactgcaacctctgccttccaggttcaaatgattctcctgcttcagcctcccgagtagctgggattacagatgcccgccaccatgcccagctaatttttatttttttagtagagatggggtttcaccatgttggccaggccagtctcgaactcctgacctcgtgatcaacccgccttggcctttcaaagtgctgggattacaggcgtgagccaccgtgcccagcctttttctttttctttttctttttttttttttttttgagacggagtcttgctctgttacccaggctggagtgtagtggcatgatctgggctcactgcaacctccacctcccgggttcaagggagtctcctgcttcagcctcccgagtagctgggattacaggcgcctgccaccatgcccagctaatttttgtatttttttagtagagatggggtttcgccatgttggccaggctggtcttgaactcctgacctcaggtgatctgcctgcctcgtcctcccaaaatgctgggattataggagtgagccactgcgcccggcccagcatactgctatttctttctttctttcttcttccttttttttttttttgtttttttttttttttttttttttttgtgagacggagtctgtcgtccaggctggaatgcagtggcgttttcttggctcactgcaacctctgctgcccgggttcaagtgattctcctgcttcaggctcccaagtagctgggattataggcctctgccactgcacttggctaatttttgtatttttggtagagacggggtttcaccatcttggccaggctggtcttgaactcctgacctcgtgatccacctgccttggcctcccaaagtgctgggattacagacctgagccaccgcacccggcccatactgctatttcttaacagcagagaaattatgtgtcagattctgtaagtgtaatggtatataaaggataaaatgatgttgaaaaacaaaattttttgtttaaatgcttatgtttctaatattttatttcagaaaggaatttatttcaaaactgataatggttggatccagcttttcacacaaacttttttttcctagtgaggatgcacatttatcctgtaaacaaatggaagacattatttttttaattgcttgcttagaaatgaaataattcttttctaatgatcttttaaagcatgagacctcatacatcatttaaaacaatttatactgtattttacacatgacaaagttctaaggtaacagcccttttctaagactaaagttacagtcctccctttgtatctgagggggattggttgcaggacccccctgtgaatacccaaatccttggatgtccaagtcccttatgagatgtagtatttgcatataacctatacacatcttcccctgtactttatctctagattacgtacaatacctaatagaatgtaaatgctttgaaattagttgttcagctgtattttaaattttgtattttttttcctttttttttgagacagagtcttgctctgttgcccaggctggagtacagtacagtgatcacagctcactgcacctttaacctcccaggctcaagctgtcctgcctcggcctccccaagtgttgggattacaggtgtgagccatcatacctggtcactgttttttattggttttaaatttttgatttaaaatttttaatctaggttggttgaatctggactggaacccaaggatatgtttgttgagcatactgtatttactttggaatacaactagaatgcttaacttgtatgttaaaaatactttatttggccaggcgcggtggctcacgcctgtaatcccagcactttgagaggccaaggcgggtgaatcatttgaggtcaggagtttaagacgagcctggccaacatggcaaaaccctgactctacaaaaaaaaggtaaaaataagccaggtgtgatggcgtgtgcctgtagtcttggctattcaggaggctgagacacaagaatcgcttgaaccggggaggcacgttacgccctcagttgttgacttgagtttttccgtagtttgtagggggagggtaatagagtattaggtagcttttggaatacataggagtgtaactggaaaaagattccaagcaagtctaatgaattagataatttacctaattagtaaattatgtaatcagtatgctttataataatattgtgagttagatcctgtttctgatatgtacataccatattgtataggtgctactaatttggagagcatatacagtgagtccatgcctttttcctgccatcagcattataccaaaattctgccatggtttttaaactttgattctgagaaagtttctcaccctaataacataactatatttgtgtttgtcttcatagttaaatatgcattatgatatcagcttgcatacattttttaaatgacttgaatatctgactttaaaaattattctagaatttctgtgcttcaatattaatgccagaagacttggaattgtttatttgtaggtaactgcctttaaggaaacttgaccaaatattaactaagttatgtatttccttttggcaacagttgtgacttctcaccaggagatttggtttgggccaagatggagggttacccctggtggccttgtctggtttacaaccacccctttgatggaacattcatccgcgagaaagggaaatcagtccgtgttcatgtacagttttttgatgacagcccaacaaggggctgggttagcaaaaggcttttaaagccatatacaggtaagagtcactactgccatgtgtgtgtgtttgtgtgtgtgtgtgtgtgtgtgagagaaacagacagacaggcagacttttttctatatgatgaaattaagtgtattttaccccagtaaattgcaaggggtggcagttgtgaaagcttctggcatgggaaagggatgtaacatggtctttagctggtttgttttgtggaatggaatttttatttctgtcctttgagtgacttacagcaatattatacccttaataagggtaaactaaactgtccccccatcttgaagggtccaagagaaagttaatgtcatcaggatacatagcctatagatagcgacattctctagggaaagatggagatgcgcactacctggccttcaaactactcactaatgaacacatctgagttgagtttcacaccaaactcctggaaccataactttcttttcccagatctagtcttgtttatcacagacatcaacagcctggcatgtttagcctcacttgggctaggtgcaccccatcgtctcttgtacaagttctctttctttcttttttttttttttttttctggagacagagtctcactctgttgcctaggctggagtgcagtggcgcaatctcggcccactgcaacctccgtctcctgggttcaagagtttcctacctcagcctcccgagtagcttgggattataggcacacgccacgttgcctggctatatatatatattttttttttgagacggagttttgctcttttggcccaggctggagtgcaatggcgcaatctcagctcactgcaaccgccacctcccgggttcaggtgattctccttcctcagcctctaaagtagctgggattacaggtgcacaccaccaagcccagctaattttttatttctagtagagatggggtttcaccatgttggccaagctggtcttgaactgctgacctccagtaatccacccacctccccctaccaaagtgctgggattataggcgtgagccactgtgcccagccgcccagctaatttttgtatttttagtagagacggggtttcaccatgttggccaggctggtctccaacttctgacctcaggtgatctgcccatttcggcctcccaagagtctccagtctagtacgttgtcgtactcggtgttgtaaaatccaaacaagggtcagtttcccaggtaactgggaaattcccagaatcacactctttcgtcatagtgctcatcctacaaaaaaggattgggggcattttgtctaaaattaaatgtaaatggtgatctgacatacaggtggaaagagaattgggaagttttgttctctcttctaccaacttgccacataatcttggccaagcaaagtaacttgttttttcttttaatctttttaaaagaaatagagacacagttttgccatgttgcccaagctggtctcaaactcctgcctgagctcaagcagtctgcccacttcggcctcccaaagtgctgagactacaggcataagccaccatgcccctgggctcggccaactttttcgttttcttttcaagagatgggggtctcactctgtcacccagcctggagtatagtgttgggatcatagctcactggagccttgaactcctgggctcaagtgattcccccctgttttagcctcctcagtaaccgggactagaggtgtctgccaccacacctggctaatttttatatagttttttttttttttttttttttttaaagagatgacggtcttgctatgttgcccccagggtggtcttgaattcttggcctccagtgatccttctgcatcaggctcccaagtagttgggtgatctggctaaagtaacttattttctgatactgtttacttatatttagaatgaatctcattggggttgcactggggccgggcatggtggctcacacctgtaatcccagcgctttggaaggccaaggcaggtggatcacctgaggtcaggagttccagactagcctggcaaacatggtgaaatcccgtctctactaaaaatacaaaaattagctgggcatggtggcacatgcctgtaatcccagctacttgggaggctgaggcaagagaatcgcttgaatctaggaggcggaggttgcagtgagtcaagatcatgccaccgcactccaacctgggtgacagagcgagactgtctcaaaaaaaaaaaaaaaaaaaaaaaaaaaaaggctgggcacggtggctcgcgcctgtaatcccaacactttgggaggcccaggcgggtggatcacgaggtcaggcgttcgagaccagcctgaccaagatggtgaaacactgtctctactaaaaatacaaaaataagctgaaatcccagctactcgtgaagctgaggcagagaattgcttaaacctggtaggcggaggttgcagtgagccgagatcgcgccactgcactccagcctggggaacggagtgagacttcatctcaaaaataaataaataaataaataaataaaataaaataataaataaagtaaaaagatctctcattgaaccagatgatatatgaagtctcttttaggaccaatttcgagatttaaaaaatttggcagaattactttttttttttgcagcggagtccagctttatcacccaggctggagtggaatggcacaatctcagctcactgcaacctctgcctcctgggttcaagcgattctcctgcctctgcctcccaagtagctgtgattataggcgcccaccaccaggcccagctgatttttgtatttttcagtagagttgaggtttcaccacgttgtccaggctggtctcaaactcctgaccttaagtgatccgtccaccttggcctcccaaagtgctgggattaggtgtgagccactgggctggcccagaatgatttttaaaaagagatcagtaaggccaggcagtggtggctcacgcctgtaatcccagcactttgggagactaaggtaggtggatcacctgaggtcaggagttgcagacaagcctggccaacatggtgaaaccctgtctctactaaaaatacaaaaattagccaggcatggtgacacatgcctgtaatctcagctactcaggagggtgaggcagaattgcttgaacccgggagtcagtttcttttttctttttttgagatggagacccactttgtcacccaggctggagtgcaatggtgcagtcttggctcactgcaatctctgtctccggggttcaagtgatcctcctgcctcagtctccttagtagctgagactacaggtgtgcaccaccacacctggctaatttttgtatttttaggagagatggatgtcaccatgttggccaggctgatctttaaactcgtgacctgaagtgatccacccgccttggcctcccaaaatgctgggattacaggtgtgagccaccacgcccagccctaaagttgtattttgatggaacgaactgttttgagaaataaattttaacgcgttgagtctgaactgggctgccctttcaaaatgtgaaggccccttaaagtagcacattggttggttattcttttatttatttagatatatctgatctagttgtctttgggacaaactcatatttaatatcatagctgcatgtaactgacagtgtagtctttgtcttcctgaagtgtttgtttgttttttgagatggagtcttgctctgtcgcccaggctgaagtgcagtggtgcgatcttggctcactgcaacctctgcctcccgggttcaagtgattctccttcctcagcctcccgagtagctaggactacaggcatgtgccaccacacccagctaatttttgtatttttagtagagatggggtttcaccatattggtcaggttggtcttgaactcctgacctcgtgatctgcctgcttctgcctcccagagtgctgggattacaggtgcgagccattgtgcccagctagtaagtttttaagaaagattctcaaacctcttttaaatcgtctgcctcacttgaagaggtatgccctacctgtttagggctgtagacccaggtcattagaagacagactaagtagtcctgggtgaacccatagggcaccttcaaggaggtaaaattggtgattttagtttcaccagtagtttttccctgaatatttattccttttgtgctttattgatctatctatatcaataaaaagtaatggggcataacaaattatacttgtcattcttgttcattagggcaaatgttgtaggttgagtcaagtgtccagccaacaagttattttatgtgtgtgtgtgtgtgtgtgtgtgtgtatacatatatacatttttttttttttttttcatcgagacagggtcttgcactgtcgcccaggctggagtgaagtggtgcaatctcggctcactgcaacctctgcctcccaggtttaagtgatcttcccacctcagcctcccaagtagctgggactacaggcgcacaccaccacccttggctaatttttgtattttttttttggtagagatggggtttcaccacattgcccaggctggtcttgaattcctgacctcaagtagtccgcccacctaagcctcccaaaatgctgggattacaggcgtgagccaccacacctggcatatatatattttaagatagagatggggtttgctatgttgcccaggctggtcttgaactgctgggattacaggcgtgagcctctgcacccggcccttattgtttataaatacatttctttctaggttcaaaatcaaaggaagcccagaagggaggtcatttttacagtgcaaagcctgaaatactgagagcaatgcaacgtgcagatgaagccttaaataaagacaagattaagaggcttgaattggcagtttgtgatgagccctcagagccagaagaggaagaagagatggaggtgggacacggcaagcattcagttgttatttatgttagggtgatgggggaagaaagggggagggtgtattaacaagataccttgttttatatatgtgtgtgtatatgtattattttattatacatacatgcatacttctgtagttccctggactgtaggataagttaggttacttagaatctcaacagctagcatcgtttttacttaggttttcaagcctactggcagggtaagcaagaggtagtaccattttggtaagaagtagagagctagggacagtaaagatggagtaatatatatatgagggtatagtcaggccctagaaattaattatccagttttatgctttttataaaaaaactgagatggggtcttgctatgttgcccaggctggtctcaaactcctgagttcaagggatctgcccacctgggcctcccaaagtgttgggattacaggcatgagccacagcacccagccccagctttatgcttttaattctaaaactttttttgttgtattttgcattcataagaatagatgttaaataaaccttgaaatacaaccttggctcaaacgttaatggtcatggataaagtgaattaaaacttgttaggggccaggtgtggtggttaatgcctataatcccagcactttaggaagctgaggcagttggatgtcctgaggacaggagttcaagaccagcctggccaacacagtgaaaccctgtttctataaaaaatacaaaaattagctgggcgtggtggcacacacctgtagtcccaaccacttgggaggctgaggcatgagaattgcttgaacttgggaggcagagggacttgggaggcagagggtgtagtgagccaagatcgcaccactgcattccagccagggtgacagagcaagaagactgtcaacaacaacaaaaaatgttatagaagtgaaaaaaattgattaatttagaacaagcttgtccagtctgtggcccaggatggcgtttaaatcagcccaacacaaatttgtaaactttcttaaaacattttgtgatttgttgttgttgtttagctcatcagctatcattagcattagtgtattttatgtgtggcctaagacaattcttccagtgtggcccagggaagctgaaagatcattatcctctgatctatcatattaatgagctgcatcctaaaagacattcatctataactaagctcagtttcatgttttgttcctttttcaatagataagatagggaatgagcaagttaataaagtgggtattttaattttaaggttgaaactaaggatcataacattatcagaggtctagaactggatggcagctacagagatcatttagcctaatactggtttaacaaataatccgggagatccgtgatatgtgaatgtgctaggcctgagatgagacagccaattgtggaagagcaaacactagaaccagtataagttgcttactgctttcttatgctattaatgagcatatcgcctcctgatatttatgatatatggtcatgccaacagctttgtcataaatagaactcccatggcagcaatcacttaatcttgtagttagaggtggggtctcaccatgttgccgagctggccttgaacttctgggctcagcgattttctccacaggcacctgctactgtgctcggtgcagcactttgtgtttttgaacataacctcaagatgttattgtcttcatagtaaaacaaaagatgaggcttagaactggatcactttgcctgtctcttcttacctcctcccagttcaaaatgcttgcatctcttaatagctagcattcccttggattttgcacatgagctcaaactcaagcctcagcacaatcttttttatagttttagtcttttagccagagtcgacttaccccccatacccactctgcttccttcataatgctgctttccctgggcagagaatccttgcccttcttgtattatgtcactttgtggggttggtgtctgctacacttacagcaagtccagagattttttttccaccacgtttgcaggagaactattggcatggaaaatgacaattgttttaatgtcaagtgaaactgaagttgatgttcattgagaggtttctaatttctagaggtgggttctttttttggcatatgaagttgcagcatattaagagaatttacagtagtacagatggggttatcccatccacaacttatgatggggttacataaactaaaaacgtgtttaatacacctaccccaccgaatattgtagcttgggcgtagcctaacctatctcagacgtgctcagaacacttaaatgttagcctaaagttgggcaagatcatctaacacaaagcctattttataataaggaattgcctatctcatgtaattcatcgaatactgtactaaaaatgaaaaacagtggctgcacgggtaccattataaagtcaaaaaatcataagttgaactgtcttacattatggttttccaaattttgatttgtttttaaatactctttccttgcctggcaggtaggcacaacttacgtaacagataagagtgaagaagataatgaaattgagagtgaagaggaagtacagcctaagacacaaggatctaggcgaagtagccgccaaataaaaaaacgaagggtcatatcagattctgagagtgacattggtggctctgatgtggaatttaagccagacactaaggaggaaggaagcagtgatgaaataagcagtggagtgggggatagtgagagtgaaggcctgaacagccctgtcaaagttgctcgaaagcggaagagaatggtgactggaaatggctctcttaaaaggaaaagctctaggaaggaaacgccctcagccaccaaacaagcaactagcatttcatcagaaaccaagaatactttgagagctttctctgcccctcaaaattctgaatcccaagcccacgttagtggaggtggtgatgacagtagtcgccctactgtttggtatcatgaaactttagaatggcttaaggaggaaaagagaagagatgagcacaggaggaggcctgatcaccccgattttgatgcatctacactctatgtgcctgaggatttcctcaattcttgtactcctgggatgaggaagtggtggcagattaagtctcagaactttgatcttgtcatctgttacaaggtggggaaattttatgagctgtaccacatggatgctcttattggagtcagtgaactggggctggtattcatgaaaggcaactgggcccattctggctttcctgaaattgcatttggccgttattcagattccctggtgcagaagggctataaagtagcacgagtggaacagactgagactccagaaatgatggaggcacgatgtagaaagatggcacatatatccaagtatgatagagtggtgaggagggagatctgtaggatcattaccaagggtacacagacttacagtgtgctggaaggtgatccctctgagaactacagtaagtatcttcttagcctcaaagaaaaagaggaagattcttctggccatactcgtgcatatggtgtgtgctttgttgatacttcactgggaaagtttttcataggtcagttttcagatgatcgccattgttcgagatttaggactctagtggcacactatcccccagtacaagttttatttgaaaaaggaaatctctcaaaggaaactaaaacaattctaaagagttcattgtcctgttctcttcaggaaggtctgatacccggctcccagttttgggatgcatccaaaactttgagaactctccttgaggaagaatattttagggaaaagctaagtgatggcattggggtgatgttaccccaggtgcttaaaggtatgacttcagagtctgattccattgggttgacaccaggagagaaaagtgaattggccctctctgctctaggtggttgtgtcttctacctcaaaaaatgccttattgatcaggagcttttatcaatggctaattttgaagaatatattcccttggattctgacacagtcagcactacaagatctggtgctatcttcaccaaagcctatcaacgaatggtgctagatgcagtgacattaaacaacttggagatttttctgaatggaacaaatggttctactgaaggaaccctactagagagggttgatacttgccatactccttttggtaagcggctcctaaagcaatggctttgtgccccactctgtaaccattatgctattaatgatcgtctagatgccatagaagacctcatggttgtgcctgacaaaatctccgaagttgtagagcttctaaagaagcttccagatcttgagaggctactcagtaaaattcataatgttgggtctcccctgaagagtcagaaccacccagacagcagggctataatgtatgaagaaactacatacagcaagaagaagattattgattttctttctgctctggaaggattcaaagtaatgtgtaaaattatagggatcatggaagaagttgctgatggttttaagtctaaaatccttaagcaggtcatctctctgcagacaaaaaatcctgaaggtcgttttcctgatttgactgtagaattgaaccgatgggatacagcctttgaccatgaaaaggctcgaaagactggacttattactcccaaagcaggctttgactctgattatgaccaagctcttgctgacataagagaaaatgaacagagcctcctggaatacctagagaaacagcgcaacagaattggctgtaggaccatagtctattgggggattggtaggaaccgttaccagctggaaattcctgagaatttcaccactcgcaatttgccagaagaatacgagttgaaatctaccaagaagggctgtaaacgatactggaccaaaactattgaaaagaagttggctaatctcataaatgctgaagaacggagggatgtatcattgaaggactgcatgcggcgactgttctataactttgataaaaattacaaggactggcagtctgctgtagagtgtatcgcagtgttgggtaagactttgaacaagcttgttctcaggctttgataagtagtgctgtttgccagctgtatattatccctaaaaataagtaataaggtatatatggtacatattttgacatgcatatacatatttgcatcctgactaggctgcccacagcaatttaagttacttgaaactcgcttttatcttagtagccctttggcctttcttcagtttttttttttttttttttttttttgagacatggtcttgctctgttgcccaggctagaatatggtgacacaaccatggctactgcagcctcgacctcccaggcttaagtgatctttccacctcagcctcccaagtagctgagattacagatatgcaccaccatgcatggctaatatttaaatgtttgtagagagatggggtctcactgtgttgccaggactggtcttgaactcctgggctcaagtgatcctcctgcctcggcttcccaaagtgctgaggttacaggcatgacccattgcgcctggccctttcttcagtctttaataatcgaacaaaaggtttttgtttttagacagtgtcttgctctgttacccaggacagacctctcgtgtcagcctcttaggtagctaggatttacaggtaagcaccggcgtgccctgctttatttttttggtgggggaagggggaagggagttgaagcttccctatgttgcccaggctggtcttgaactcctggcctcaagtgatcctccagtctcccaaaagtgctgggattacaggcatgagccaccgctcccggcccaaaagatttttaaatgtgttatacttcatgagacaggctttattttagatcgaattttatttatcaataaaaagttgagctttttattatttggtgaatactgtttcaaggtgctttgttacactatctgttgatccaacatttaaaaattgttttattacaacctttgcatttcagtgaatccatctgcatacaattttaaaagaatcattccttttttctgtagccaaattgtcaaagattctttcctacaattgatttttcaaagccctgagttaggaatttacaatttggcaaccatctcaacttcataagcaattttgttctttaaatgtcacggccaacattacctggaaccattgctgttttatagtttaggtttatgttgtatattttttttaattttttagagacggggtcttgctgttttcagactggagtacaatgggatgactagctcactgcagcctcaaactgctgggttcaagtgattctccttcctcagcctcctgagtagctgggactacaggtggtcaccatcacacctggctaatttttgtatttttggtagagacagggtttttcccgtgttggccaggctgttcttgaattcctgacctcaaagcgatctgcccgccttgatctccgaaagagctgggattacacgcatgagccactgcgcccagccctgttttttttttttttttttttttaaataatggtagtttacttgaatttgtaacacagtaacacaaaactattttgatctgaacgcaagtatctaatggaacagaataatatacttccttttagtgtgctgcatttggttactgggtaatttaaaattcttcctcagcacaggtgttcaaaaaccagtcttcagagattgttttcatatcagtgtgccaactttggcacattctgctaagtaagaggcttaagtgtagcatgtttctgctgttttgtgtttgttttgttttgttttttgagacagagtctctctgtcgcccaggctggagtgcattggtgcgatcttggctcattgcaacctctgcctcccaggttcaagtgattctcctgcctcagcctcctgcgtagctgggattacaggcatatgccacgtgtattaggcactgctaatttctgtatttttagtagagacgaggtttcaccatgttggtcaggctggtcctgaactgctgacctcgtgaactctgcccgcctaggcctcctgaagtgctgggattacaggcgtgagccaccgtgcctggcctctgctctatcttttagctttcccttggcacttctatggtccagatgttagagggtaagtattttgatgggggagatcgttggactgtaattgaaagttatgtcttataatgaaatgtgttatataaagaagacctataaaacacttaggctgataaaacccccaaacgatgaagcctcacttttaccctctcttttaacagatgttttactgtgcctggctaactatagtcgagggggtgatggtcctatgtgtcgcccagtaattctgttgccggaagataccccccccttcttagagcttaaaggatcacgccatccttgcattacgaagactttttttggagatgattttattcctaatgacattctaataggctgtgaggaagaggagcaggaaaatggcaaagcctattgtgtgcttgttactggaccaaatatggggggcaagtctacgcttatgagacaggtaactgattcttaaagttttgttatcagaaagtcatttgtgacattaggaataacatacttaggtgatcattttccaaacacagttacataaaagtcagccagtgacttaataggaagcaaagggaaattactccctgtgttataaaattgagaattatatttagctgaaacatcgatgcttaatgttaaggggaatatatgttaaaaaggggaaggaggtcagtcattcaggtcatgaggccctttgacttgaattcatttcctcagaaggtaggtatattcatagtgaacaaaaatacaaaggctgtatgaaaagatgaaaatgttacaggtttatccttaaattagactcatttgcagaaatgcaaatgaggtaagaaagcaaatatagttcatgacctctagcaactgttgaaaactgctctttagggatgacatgctggcccttttttttttgttgttgccaaggctgaagtgcagtggcaccatcacagctcactgcagcctcgaactcccaggttcaacccttcctcctgcctcagcctccccagtagctgggactacagatgtacaccatcatgcctagctcatttttaaaaaaattttttatggcattgtatttatcttctctttataaccaggggttgaccagccacagaacttgtaaagttttttatatttttaaaaggttgtaagaaatagtagtagttggctggtccccgctgctctcctgcattatagtatacttctgttcacctagtttgctagagagaggcagtatagtgtgtatagtgatttccaaactttttctttaaatcagaatcacctgaaagaatgtgacaacgtgtaaaaaaaaaaaaaaaggtgcagagattccatcctgacatggattcacttgattggaattgattctaggcatctcagtagttttaaagagctcctaggtgattctattctggccagcgttgagaatcactagggtagtgggttggtaagcaggctctgatgttttaaaggccaggtgaggccctatgcctcttgtctctcttagcctcaactttctccatgttagcaaatggatttcagaacagaaccaacgtacatgtgattgtgaaagttgttttagagtgcctagctcttacgtaagggttcataagaaagacaaaagtttatgaaactgttactaccagtcataaaagaccttttcctccctcattcacaggctggcttattagctgtaatggcccagatgggttgttacgtccctgctgaagtgtgcaggctcacaccaattgatagagtgtttactagacttggtgcctcagacagaataatgtcaggtgagttttttgtttcccacttaagttctcattcagtcatttagatgtgataaaagatatttgcttcttgtatatgagccttttaaatctaatatttgatttttctggtgttactttaaaaacatcactttttaagaactgcatagtctctctctcttttttttttttttgagatggagtttccctcttgttgcccaagctggagtgcaatggcacgatcttggctcactgcaacctctgcttccaggttcaagtgattctcctgcctcagcctctcgagtagctgggattacaggcgcatgccatcacgcccagctaattttttgtatttttagtagaagcggggtttcaccatgttaggctggtctcttaactcctgacctcaggtgatctgcttgcctcggcctcccaaagtgctgggattacaggcgtgagccaccgtgcccggccaataattgcatagtctcttaatgagatttaatcttttataccaatatgtgtagctcatgatagctatataacctagaagatgaatttatgtaatatgatttgcaaaatgagtattcatttgtgatttttttttttttaaggtgaaagtacattttttgttgaattaagtgaaactgccagcatactcatgcatgcaacagcacattctctggtgcttgtggatgaattaggtaagacattaaacttctcatttgaagactatctatcttaaaaacatttgtacaaataactatttttatagaagattatctgaagtacatttaaacaatatgaatgtttttagagcacgcactcaccattgtggcacagaccgatagttggagataaaaggtgatattgtgaaaggtttttgattacccattaattattaggccttacactgtttagttgtaataaaacatttgttatactacggggatgagaacactaataggaggactcaggaagtttatgaccttgagcgatactgtattttctttaaaagaaacctcactccccatgggctgctaagcagactcgtgtagctaaacaaggcctatttatagaatgcttttagacgtggatgtactaaccgatgttgcttttctgtcctagcatttttgttttaattccttttttgttttaattcctttgagttacttccttatgcatattttactttaacaggaagaggtactgcaacatttgatgggacggcaatagcaaatgcagttgttaaagaacttgctgagactataaaatgtcgtacattattttcaactcactaccattcattagtagaagattattctcaaaatgttgctgtgcgcctaggacatatggtatgtgcaaattgtttttttccacaaattcggttttttgagagggcacttctcttgctagcacatgtatcgctaatatttttctttcttaaggcatgcatggtagaaaatgaatgtgaagaccccagccaggagactattacgttcctctataaattcattaagggagcttgtcctaaaagctatggctttaatgcagcaaggcttgctaatctcccagaggaagttattcaaaagggacatagaaaagcaagagaatttgagaagatgaatcagtcactacgattatttcggtaactaactaactataatggaattataactaactgaccttaagtttcaaagaaacagtaaaaggggaagggatgatgcactatgaaaaaacaaaaaaacttttttttttttttttttaattttaagggaagtttgcctggctagtgaaaggtcaactgtagatgctgaagctgtccataaattgctgactttgattaaggaattatagactgactacattggaagctttgagttgacttctgacaaaggtggtaaattcagacaacattatgatctaataaactttattttttaaaaatga

SEQ ID NO: 6 - DNA, 374611 bp, Homo sapiens
cccgctctgcttcagcgcacgctgaagacggcactaggacccagggaagtccccgagcggggttcgcggaaaggcagccagactcctccttatctccagtgtcaaacttgacatcagcctgcgagcggagcatggtaacttctccagcaatcagagcgctccccctcacatcagtggcatgcttcatggagatatgctcctctcactgccctctgcaccagcaacatggattgtcagctctccatcctcctccttctcagctgctctgttctcgacagcttcggggaactgattccgcagccttccaatgaaggtaagccaggtaccgcgacgcacggagctctgccccgcggggctcacgctcttcaaagcacgttctcaccgaagccttgcacgtcgggaaggtgcctccgaatagagcagtttgctctgagagtgaaggaaagatgtgccttttttttttccaactgtcttctaaaacacttcaggagataattttagatggtctaaactttgaaaatgtgtttttaatctgacaccatttcgagcaattaccttgtttgccaatttgagcagaaagaaagaaagaaaatcctccagcgttgcaacccagttatgttaattgccaaatagccaaggcagtattttattttctaattatgaccatgtggtactccgagaagtttgaaagaaaattcagccttcctctctagactctttagtatgtttaaaggtaatgacaggttgttcctacttgggatcatggcatttatgaatggactaaagggaaatcagagtttgtcgaagcggaggtgcgtgtttatggtgcaagggctgtgttgaagttgtgtgtatcccgccaggcaatggtttgctctatggtacaggttctaaagagcagcatatgccacattaacgtaagtaatatttgcaagaattacaataagcttaggttggattctctttgtttaaaggcttatatacaaataggagaatgtatttaatgaatagtggatagctcctgggaagatatagtaaataactgaatagtagattaagagagaatgttcatatgcagcaaatggcatttccttgatgttgtgttatttattatccttgtaatgagcattaattccttttcagtgggttaaagtgcaaacctaatgttaaggacaccaatgtgttctataagattgtgtacttaatacatacattttctttctcctgtattccttttgtgatctattcttgtgaatacagtcactaactcgtaaaacaaacttctctaaataattgattagtgtaaagccacacttacaacattaatttcctcttagtgattttgaacttataacagtaacatttagcaatttattttgcaagttaacaataccgagcaactgatgtgcaaacatcatgttatatacatcactccttagaaaatatattgtcaagccaatactgttgtatatgtaccttaattttaaaaacacgagtaaaaacaaaatacttagaaagttttttattaaatgtaataactgcctgatactcggtgacctactttcactgctaatagagcagtaatttatctccttccttactgactgcctttatcaatttggcagttttcattaaatgttctgaatcttttttctaaataagaaaatgaaaattctaaaatataaggatcaagaaaattatcttacccacaaatgactttttattttacaaaccaaattaaaatgtttatttgaaagtaagagtcaatcattcttcctgaatgaaaggtaagagtattcatttgtataacgggtaacatgtataataggtaacatatcaataaattaaacttaatgttttaaaaatttttgttctttgcagatattaaaatattgacaataactagaaaaatagtattaaaattcccacattgtcatgataaattatattttccagatagaatggttatgaactatgtagatatggatattactgaattaattatgcacaagaatgtagctgttagtcagtatttttgtggaaaacaacctttaagtaaactgcaagagaaaaaaaaagacaccaaactatttcacacctatgtaaaattaatcagtattaatttaatgaaacagagttaatcaaatacaaattgcttttaagcctcacctcatgtatgtttggggatataatgtatataattatacagacaggtacacattaaccatatggatatagaaaggtaaatatattcagaaagctgacataattgcatttaatttgcttggatgaaagtttatccatcattcatgggattattccttccagattgtgtcctatgggtagtgtctcttttccttcctgtgattgtgaagggaagctttaaaacaaatttaagatgatttaacttaggtaatacttgagtgagattttaaatattatccatagctgggctctcagttgagttgaataacatgaaaagtgaaaatgccaagtatgtgccaagatttccgtgcaatttttctaacaatgtaatttaaatagaaagcaattcttttgaaaatgtatatatgagaggagtggtgatttaaaaatggtattaatgtagttttctgatataattttttaattttgaaatatgaaatactagactgtatttaaaatattatgattgaaatatttcaacactgtaaaaaatttatgagaaatttactgaaacatatttactagaatatattcttcaatctgttatgaagttaggcatttgagaaccaaagagaacaaaaccaggccattgacttaattgctaggacatttgcagttgtgtgatgtgttttttaatttaagatttaatcattaaacatcaatattgaaatgccatgggtccctgataagaaaaataacttagaaaatgtttaatctgaattttccttctattaatgtatttacaaatatctctcttatatgctttcaagaaaatgactccaggtgataatagggactcatcaacgataacagatattcataattccaatgatcacttgactcagcaattggcctatatacttaaacagaactttataaaaactttattaaattcttatcaggtctctctgtttacatggcttaagaaaagacttttaatgggagatcagctgtttttcatggcaaaatatgattgctacactacgtattattttaaaagttcatatacttactcctagtttccataccacagggatgattaatggtaaacagaaataacattggaacaaagttaaaactggatataaaataaaattatcaactgtggttacttcaaccctttcagaattggtaaaaatactttctttaaacacttttatacatttatggcagtctggggtacaatgcactattaattcatcagcacataatacactaaatcattttttctatccaaaagagttcataaattggattaacatttacctagaaagctctttatattgaaaatagagtatccaaaataaaactgaataaaattaaatattcatatttatatactacttttttaaagactttttttagtagctaagacactatttctatgaaatgcatttccctaaatataaatattctaaatactagaggaaactatgcaattgtttaaaacttaaaagtaaaacttgcatatgaatattataagcttccctttgagtagtaggcaaatgttggagaaaataaataatcaattttttcatttttaaaaattacaataaattggcatcacttttcatatataaacacttttcctcaaataagaacacactgtgattaaaacattaatagagaactaagctatcatatcatctttataagtttttttggtttggaagagggtttacatttgcttttcatagcatttcatcatgctagactaaataattgaatgcattatacatttttgtaatttaatagctctcctaatagctcacccctacatcccccccccaccccgcctccatggttaactgtgctatttgcctgaaggtaggagaaaccttattttcactattttataacccacaacagttaacacttgacctaggtcattaacaggattatcagcaaatttgtttaagcttttactgacaatctgaattgctacgataatattttgaatgtcccgtaaagaaactttttgtaacctctcaaaatctatcacaaaattaattcattctgaatctatatctttgtaaagactagtatctataataataatttgagtggtgaaaaggttcactcggatacctcaatctctttatttttatgtttcataatcatactattccagtccttgtcataaatgagcaattataaactcttttagatattacatcttctagtaataacaatagatttatcaatacaaaacagtttcactgtaactatcaatatttttaattttatatttttaaattattgttactgtagttgatagggttttctttgcctattttaaggttaaaagttagttggatatacttctaattcagaagtgactggacttataaaaggggaactacatgtaataaaacaccattgccacgtgttagatcatggttgtattttatataaagttgtctttccatgaaacactagaaattgggagctataatgaaaaacactttaatacaaaaatttaaaacaaaatattgtacagaatcagatcttagagagttatttttaacattttttagtaggtttaggaagtttttggtaaagtttttcatttcttgaattgaattatggttggctcgttggtcatattaacaacttagtaatctcacgttgctcttaataagtttattattaaataaatgatttagtaacattctttatgtattgcctacatttaacattcaaactttggtgtgttccttaagggtccgaccatttttaatacttttccacaataaatttctttctaatgttaaaatcctttcagaaatttaaatttttttcggaaataaaatatatgcaatttttaaatatcaaatagttacttttgcaaatgatttttaaaggcaaaatatatttccaaaatatatttgatttactaatttcaacacaaatgaaaaaaaaaagaagtgttcttgaaagttacattttccaagtcataagatcttcaggaaaatattaataaaactttcctcaaatcatcaaactcgataaggttttatagacatttactaaaaaaaatctgtgatctgggctactttttatttgaatcattctttcaatgattcggtttggcataaatactagatataaggggaaacgtgtatttcttggaagaacattaagttttacaagttattttctgtcaagatcctcaactttattttttagcctgcacattttttctttaaaatatttaataaaccttgttcctttaattcctgtttgagagaagatttagaagaacagatgcaggtgtctccttttgggttctgttttcagagatctggattttatcatcacggaaggtcaataaagggcttttaccaagtacacaagtagctttccacagattttttaaataaagggttgaccagtagtgtgaaacattcattatattattcatccagttatacagaaaaccaggattagaaatttacttctcagaaatgtggaaaccttagctaactcttctgtaacaactttagaaatattagtaaaagcaatattgtgacatttataaaatgcaaagtcttccaagtcacaaatcaatccacctaggaagacatccctcagtgtgttcggggtgtggatacatgtgcgccacttgcttgatttcattaagtctgttcccagctgcttggtatcaggtagttcttggaacctggcaggaggttttctccaggaaaatctgaaagtcagcaagttttagtttgcctcctaccagcttcctttgtacaaaaaaaaaaaaaaaaaaaaaaaaaaaagaggggagggtggtcgattacaaagaaaaaagtttttgcaggagaaaagaaaataaaaaaagttgattagaaaactggagaagtagagaaaagcaaaggttttaaagccaatgttaatatataaatcatttgcttaaaagaaaggcatttatcacgtaaaacatctggctaatcaatttttattaaatccctaaaaaccccgcacacttaaaatggggttgaggtgggggggggctgcatttctttgtttctcctcaagtttacacacttttgattttttcccagaagaaaatatttcatccaggaaagttttaagagtgacagccaaaaaatgctaaaatgcttccccctttgaatgtctggacgaatgcatgtggaggggtggacagaatcaaaatcaattcagcaaataaagcctcaaatttgaagtgatgttattaaactagaagccctgagtgtgaacatcccccaacccttcattttctaaatcatgtcccgctgttccagtcaaagcaaagggtgaaaatccacataatccaaaccaacatggtgaagtgagaataataggtgaggaaggaggaggaaagcaagtggcagcactgtacaaacaaactgttgtgaatattcctcgccatggacaggagtagccacaggaggggataactgcctttcttcttcttcgccttacactttccacatttgataatgcaaattcattaaattacaaaagtgtgtcatgcgaaattttagcacaaagcagagccgtacgggtagagacagtaatgtggcaacagggagatgagcaagtgttccttgctgccaccacacccaccatcagggtgtcttaaccacaaactattctccgctaggtccaggctcgttggtgcaaagggaaaacaacggtgtctctcaacagttcactgcttgctcactctgcatcaaattaaagatgagatcataaaaaaacatctccgggtgcgcgtaacgcagtctcagccctctggaggccagtgggttctttgtgcacaagtctctccgcgcctggctgcccaagtcagttcccggagcgcgaccagggtgccacggcctccgtcccgaggtagggtgggtgggcgagcgcagcctgatgctcttttgctccgggtttctgcccccgggcggacggtgtagactctgtagcgagcggagagcgaaggtgcaaagttaagcgaacacgagcgccaggaggagactggagcgcgcgagaggcaaacgtgcgccctctgcctgctgccgcggatctgctggcactgggagagcacggcgtactccttgccacctggaccctccttacctgggcgtcagtaagacgccagagagtccatgcgccttggacgggcctggcaggtcctgacctgaggaatagactttaattcaggatctacgatcgccctgccgcctttcgcattgctgtcagctaggcttttcagtttgatgtctggaagtggcgtgtctcttttccatccattttcatgggttcaccaggtgacagccaggggaaggagatattctgcaaggttcgctgccggattgagaaagcatctcttactgggtgcgcttggttgagactcacaggagttgcctcatacgccctgttgtgcagcttgctgatttctaaccctatccctttactatttcttcatcttttgggcattcaactcttttggtgtcgctagactaaaatgaagaatatctttttttttttttagaaaaattttctttaaaactacctgctagtgccacctttaggcccctagtaattgctgaggggatgtcagtaaacttttcccctgtgcatattcaaaagttgtctgtgttctcccaaagcccgtgtttgactgacaccattttattaaaacaggatttttcctcttccaatattgggagtaaacatggaatgggcaagagagggtttttgggagctgtgctatcgagatagcttggtgggtggatgatcctgatgtttctgtggctgtgttagaacttcagtctttttcataaaagatgattttgttaaatcctgtagacttcaagactaatatatcctcagtgccgtgttcaacactgagaaaataattgctcagtgctctgctggcaaatagatttttcccttacattatcattcacgacttactgaacctcatttaatcgttaaagcagccctaaaataggtaacataatgtttcccattgttacaactgaggaaactgagaaaatggatcataataaagcggtaactaagccaagccctctctcgtctttgtcttttgattttaacctcatatgttttctcctagacacaaatgactatgaactagggaggcatcattgtcaggaaaagcactagcttctcaaccttaatcccagtgactgtactaatttgtcttctgactttgcaaggataatttagaaacattcagaaatttgtagtgaaaaattgaagaaaaccatataaatgagggtactttggaactgtagttacactcataagttatgattatctgcgtgtgggggggacccactaagaaactaagttaaaggaatttgttgtggacagaagagtagatgaaaatatctgtgatgacttttcttcacacgttcttacctctgtgttcctttcctgacactcaaacactcctttcatcaccctggaaagaagattttgtcaggaattccatacatacagatagtgaggaaattgtacaatataaccagagtgtgattatttagggttatgtgtaataaaaatgaagtgtgaattaacaattggaattatcttaaaggtcagtaataggagaaaatagaacatggtccaaaaagtagactttagtctctgtggaaatttccccccgtttaaaatataatttttaaattgcttaagatgagaaaataaattttagtgatttagctcttctttcataaaagcacttgtattctatttaactcctgccattgagaaaaggtagctaaaacaggcttttgaaaggtagcaaattaagttgggggcaattatatttttcatgtgggtattttagcacatatgttttgcattaattgctgcaataaattctgttaacctggcaaagagcaaaaatagcatattgatgacatcaggcttccaaagcagaaagcagcttttagtatcttgctgtcttcactgtaacattaaaaaaaaaaaaaaaaaaaaaactaatgtggtggttaaccaaagagttagccattctttcaagctattggcatattttccatgaacaaagtgaagaattagcaacaaactttttcccccttacttccagagaattcatgtcaattactcattttcctgttatttgattttttatattcatatttgttactcattttcctattatttgatttttttatatttatatttgggttttcagaactctctcaaatcaaggcaaatgtaaactgactttaaaggctccaaactgagctgtcttcccttttaagacaaacatcttgactgattacatagcagggcctcaaaagggacttaagcaaatagagaattgtgggttaattttattactgagaagtttagttggtcaatatcaaaactgtttcttctcgatttttaatacattcattttgagaaggttaatataggttttttcaattaatagttaagaaaaatagatgaataagatctaaaggtccagtaagtgtaaactgcctcatgtaagactttaaaattttactttttgcctatgataaagttgattgatttccaatcaacaggaaattgtaacatttcctatctacctcagactgactaaggggaacacagagcagcttgttagcagttaacatgtatttatttcctgattttcaaacgcaatttagcaattaataaaactgtatagcttttaaagggatatattctttcattgcatctgatggcagtcttcacactgagggaaagtctgggaagctaatttgcaatgtcttccatgtggattatctaactaatcctctgggtaagcaaaacaccactcacaggaaaagtctatttgcagcactgtgtggtgtgttatatcaccaacagtattgtcctcttacaaaactgagctattcccaaactgtaagcaaaatttaatgaataaatatataccttttgacctcattatggcataatttttttttgaattacaaacaggtgatgtgaaaaaaacaaaaacaaccattgatttatttgtcactatctaatcttgttcattttccccaattgtcctctaatcatctataatattcaaaggtggcaaaaaggctagagttatatacaaactgagatttctttcccccttgaataagtcacagctgatcatggtagattttgctttttttacagaataaaagaactgacagcatcatagaaaactagaactagaattaagtcagattgttactcttttatgaaatctataaacaccaccaaatctagtaactgccaaatattggaaatattttcaaagatgcagtataaaaggacatagtatttttctcttggtttacttttactatctggtttactatagataatttaatactcatttacattcgataactcaaaaagataaacttagaggttttattatagtgttcttgacacttctgatctaaattatgatttgattgtccttgttctctgaaaaagaaatttccatgtgtaattatatgtatttcatctggctaaactagttaatccatgcttaacaatggtttttttctatattttcagatacaagtgattttctttgacatttgtacattgcataaagaaaatttttcttatctttcaaagtgatgttccaaatcatactaaatgttttaatattcccacaagaaaaataaaatgagaggaagaaaactaaaaagatataaaattagtaatattcctttaaatttttctttccaaaggtgatcctttggaaattaactaagcatgttttattttatgtttggccaggtgtgtagtaggtttactaccctaaccctattagtgaaaactttggaactctaaatgtaatgacaaaggcacaactttaagaatcattaaaatgagtcaagaaaagggttgatatataactaattgcctgttacataatgactcatctttcatattataataatttattgtctgtttatttaccaaacagtacttatctgaggattagttacccactagattttgaaaaaaaatatctgctagggagtggaatgctctgtgctcttgaagatgtcaaattcaatgggataaatgaatctaaaataaatacttatataaaaattgttataacatagatatgaaaattatgaaaatatgatatgaatctttagtggagggtgcaatttaagtcccagaacagagtccctgagagacagggagaatttttttaaggtaaaagataataataaattcataaaaacaaggactaggagattagaagctttgcttaagttcatgtggtggggataattttaacccagatttatttttaactgcatgtaactttaaaaataatttaaatgaatatataacaaagacacacttttaagcatgtccaaaataactaaatattcagaaatagttcttgttaagcacataccgaagctaacataaattctttacattacatgtgagtgcatgtgaatatattggaaacacatgtgactgaatatcaaaatagaaccatctccatataaaaacttctgtaggtgctattcctattatgactacactacccaaaaatatctcattggtctttatttgcattctgccatctctttcatcaataaattaaaagttttctgactattccagtgcggagtttgatgctttccattgacaccatgctcctaagatgcaaaggaaaagactagtgttttgaaataaactgctaagaatgtggtaccatatttgatcctttggggaccattataaaaacccaaaaacaagtcttgaagagtttgttcgtgtgtgtgtgcctgtgtttgtagatgtccatcaaatttgtattgtcatgatcaaaataaatgatacacctgagattttagacaatccagatattctgcagaatatgatgaagtcagaactttattctgattttagttttccagaaatttgtttaataaggaaaccaatttattctacagtggggttctttcaaaacaaatatgtgtgtatgtatgtgcacatgtgtgtttggggatgccaaaatgtccagaggatgtttttaaatttaaacttacttttgtttcaccactacattctttgtttcctatgctagaattttgaatctttatatccaacggacttctaggaactatgtttatttctaaaggaaatactacattagagttattctgtaggccagttttcttcttgtattctattttcccagccaacagtcaaactctggctgaacagatagcctgtgctatctggatgtcgatattctacattttatgataatatgattttttaaataccaagatagactgattttatggggtgaaggcaaaatgcatatgctgtagtttaaactgctatttcccttaatgactatttgtatttcataattgagtaatatgttttcatttttcactttttaatctttcaaaaaggtctctctgaattggatgtaaacaatcattctattacttctggaacactttaaaaagcaaaactgtgaaaaataaaatgctgtttacataataatgtcctggttttagaaacttacattttgggagacacattttactcgtctgaatgattcataatatcagttaacaatggagagaaacaaagagctgttatttaagtcaggctgttagtgcactaaaaattcactggcagtagagcatcacaactcatttatgtgaaaggattattttgttataagaacacatttttctactgatatcttgatacctgtttgttccataatagttttgatatcagtatgacctttatatttctctgattaaaagagaaagaaagaaaattttaacacttgataaacagcataggattgacatttactaaagtaagtttctagcagaattttgttctatgttatttcctgaatcactctagttataaaaacacagactcatcttattgtgagactctgttttgattccaaggagttccccctactgttggcaaagattgagatgagacagctaattgcaatttcttctataagatctttatagaaataaatccaaaattattgcccaggagaaaaagctaatgagaaagaataagttaagtgcagaaatcttcttatatcacataaataggctgttaaaataccacctgaccaaaggtttttcatagcaatgtttaacatggcagcatttaaaaaattactacatcagcctggcacggtggctcacacctgtaatcccagcactttgggaggccgaggccggcggttcacgaggtcaggagatcaagaccatcctgactaacgcggtgaaaccccgtctctacacaaaaacaaaattagccaggcgtggtggcaggtgcctctagtcccagctactcgggaggctgaggcaggagaatggcgtgaacctgttaggcggagctggcagtgggaggagatcgtgccactgcactccagcctgggcgacagagcgagactccgtctcaaaaaaataaataaataaataaataaaataaattattacatcataattttagctgttcatttgataaaaattgtataaattaacatttctgtgatataaaatgctgctaaatttaacacagtttacaggaacttttatctgcacacaattgacacataatagttgacttcgtttatagtacaacatttttataatttttatctgtgaaataaaatactaattaaagctattaaagtattttggctgggcacggtggctcacgcctgtaatctcagcactttgggaggccaaggcgtgcggatcatgaggtcaagagatcgagacaatcctggccaacatagtgaaaccccgtctctactaaaagtacaaaaattagctgggtgtggtggcacacgcctgtagtcccagttactcaggaggccgaggcaggagaattgcttgaatccaggaggcagaggttgcagtgagccaagtttgtgccactgcactccagcctggcgacacagggagaccccgtctcaaaaaaaaaaaaaaaattatgcttgggtagaaagaaaataaatacaaacaggaagtccacaggaacaattaaattaagaatatacaagcatggtagataaaagttatgttgcaatatataagtacatcaaaaatctatcttctctaaacttctcaatatcataccctgctgcttacagtaaaacagaaaagctgagctttgctgaattcctatcagaaaatataggtcgatttcttaattctgtattatgtttgaccggagaactacacagagaatgataacactgagtacaaagtttatttctttctgtatcattttcttcaatttgtgacatttaaatatacttagaagcagattgaagagctctgtgtagtcctgtaacctagagcaaagttattctgcttattataacagaaagtggtgaaaatcataaagataagtatttgtgaaatgaggctgggacaattacagtgatggtgtgcatagaaagaaactgtcattactctttagtgaaaacaagatgtaatcaaaggatgggcttatttttgttgtagtggttttatagttatttgtacttggctataaaagtcccttataactgaaggttttactagagaacatgtgcattattatatgagtttgaaattctttagccattaaagcctactgttaaccttgaaatgattgtttaataattatttataactcagtttcataaaatgcaactatagccttaccacaaagcctatgggtgtattattaggtaattggaaagatctgcttcagtaaaaaactgtggcatttaattttaaaaaccttttagaactctctgcatgtttgtggcacttaaaaatctttcaaggtgtgaatattagtttcactctcagtctttctaagtggacaagtagccactatgaatcagaatttagaaatgtcctttaaaaatctttatgtgttaataattctctaaaaatcaaaactccagaaacttgtacatttttaatccgccctcactaactgggaacatttgtttcaagcccttcttttagtaactgagaatttgaaataaaaagtcttagtttgttccttttactaagaagaaaagactatgtaaattatttgaataggcaattatttgtgacactaccaatactaatgagcaattttactaggagtggacttttgattgagtctctccattgtgacagaggataggaaaggaagagagaggatgactctgggaatcttaatcccacaatccaaaagagggggaaacataacagtagaaatcagtggcagaaatgacatctaggtttcctcctttccataagtacttattaccaatttgagccaatttgctctatactttcctcctttttttgtttgtttgctttgttttgtttgtttttgagatagtttcgctctgtttcccaggctgcattgcggtggcgcaatctcggctcactgcaacctgcgcctccgggttgaagcgattctcctgcctcagcctcccaagtagctgggattacaggtgtgtgctgccatgccagctaatttttgtatttttagtagagatgagttttcgccatgttggccaggctggtcttgaactcctgacctctggtgatccacttgccttggcctcccaaagtgctgggattacaggcatgagccaccgcgcccgccactatactttgtttttactcctttactccattctacaccttcttatttacgtcagaaaccaccattccttctttccagatcttagtaacttagtgcccatctgaaagtcaaatcaacagtccaagtaaggattgccttccccttcttatgaatataagccccttctagtcatacatctctatttaaaagcaattagaggcagtaaaacatgtgaaagaaaaacctagaaccatatccatctatacttaagatggtgttttccaaattcatttttgcccagaaaaactccagttatttatttaccaacttaaatagaatcatgacatttaaaaacatttccaatttaaatcactttcattaaaaaagtttatatattccacatagttttttgaatataaaatattctaaaattaacaaaataatgtgttttctgttacacaccaaaaatatttggcaatcacatcattagaatatgaaatctgggaaggggtaacttacagctttgataaataactggcatgagacagccattaaagaatgaagtcatgcatatgttcctatctagccttaagaaagttttctttttgtcagattttatcattgcgaactcgtattgtccagcaattgaaataaactatccaactactagtgcaattaaaattcagtccacagtagtatatttgtatgtcacaactcattagcctatcctgtctgtcctagagtttgaaaggaaatgatcaggtctagatatgtttagagaggggacagcattatagtaaccaaagttcttgcctgtatcagtgtgagatttaagatatgtattgcaatgttacattgagtcaatgtatgcagagaaatcgctcacagatttactttgaaattccattcattgtcttttcttacctcaattatgctgtatactcaaacagttctacaatggatcacaggagatttgaggtttgtatcctgggagtcccaattaagtaacaattcactttaaagtatttagaattcttagacggtgttatttttatttgggtacaaacaaaaggcactttataaatccaaagtatgtgcttttaaagtgtgttttgaagttaactattctactctactagatcatgtatttaggtcatgtaattgaattataaatacaatttagaagccacaatggaactgttgttaaataatattaatgtattaaatttacgagaaggaagtctgtacagcatgttataaactcatggtggatttaaagatatttatggtatttgaacattacagcaacattgcaagatactcagggtagatataattgatagacaatagaatcagtcagaagtaatgctgctaattgtgtttttctcatttatgctgaatagagtgcactaaaaatttaatttctgagtaaatgcaataaatttaattaatcttctacacttactttaattgactgtatggtctaacctattttggtttatttgttctcctttgagtagaaaccaaatgctgatgtgattagtccagttcttttccattgttcttattatcagaagaaacgtaaggatatggtagttcattagttgacaacctacattccaataagtaatttactaaatggagtctatgtaataaccatatcttcttcttctcactctggttactaatactgagattaaactagtgattgatcttaacatgtggagtaacatataattatcatttagtaatgtgcaattactacctgaacacaatgatacattaagccatttaaacccctaaggacattgcaaatataatctaataatttatgtatactggcaagctgatttctactatgcaaatcccatataaagctcagagaaattaaatgattggtatcacacaactaacaactgaactaggtatatcttttatcagaataaatgttagtaatatcctttaatttaaaggtgaggaagtattttcatattttcaaaaattttctaacagttatctgaaatataatctataacattgattaattggttgagggtatttaattatttttcagagataattgcaatataattaagcatactgttaatttccaaactgatatcctgggaaataattcaattatggaaattatactatgtaatccatgcagcggctatctatcttctgttttaatttaaatacaattacttctaattaggattaatttattgggaaaaaattctttaatcattaaggaattataatataaaaggtaaagtttatgtttgtctttcactagcaaaacgtaaagaatctaactttgagaattgtatttcttttaaattgtagtgatcaagagccttacttttacccatttaatttatttatcaactaaccagataatcaaaattttagtactgcttgaaaatttagaaacctaatgtctatcaaatatgtaatttatttttcttaacattttataagattaatatttccttcacaaaaaaatagttgagatgattttttaaagtctatcaaatacacaatttatttttcttaacatttaaaagattaatgtttgctttgcaaaaaaaaatacttgagatgacttttaaaaggatggtgcttttcatgtatcaggaaacactttataaacaacatgagaacatgttgtgcggtgtatgtatttacattatgttttggtttgtgtatatatgtaacccctgaaaatgattcccttctattgtatttattgattttcatggtctggttcatgttaataatgcatgcttagtttatgtaaccttccttcacatcctccattagtcaatcatgggattgttttctaatttaggagaaagatgaggtaaaaccatagtttccattatttaataggtcagatagacaattaaagtgaaccttttgttattgattgtatttgaaatgctgttgtatattttattttctaacctattacaaatgaatattcagtatggaaaataaacagtgttccatcttcttttaataatatattaaaaatgcaaccatatgcatgctatattttactttttgtatacaaatatcgattaaaagtcattagaactagcacaaagttctgagtaaaaccactaaagcctttgagtaaaaataattactttaaataagtaaagctttacacaggtgttattataaaacatagttttactttgatttctcctcaaattggtagttaagctttttgtgtgttacatataagtaaataatgaatacatttttaaaaaatacacattgcagaataatatgttgagtattagccagggatgatatgaaggtgtcatattagatataaataaacagataaattgactcattctgtcaacatatttaagaaatgaattaattgtggaatcatatgtaaatttatcaaatttaatatttttgaagttattttgatatgctagcattaatgttgttttctattatgcatttttattgtttcctctttaaacccataattattatgccagaaattgccagtatattgaacattaacctatccttgtaaacaaatgcaaacagtttaaaaggacacagaaacttttgatctcttaactttccctgtgtattttttgtaatttccttctttttatcctaattatagacttataatgagaaggaagagttatgttttttgagcaacatcaacaacagacaatgtgaactcaacagaagcaaatagaaataattcactgttattaactgtgtttgtgtattatgttttattttagtcaatctactggattcaaaaacaattcaaggggagctgggctggatctcttatccatcacatggggtgagttcaataaactatcacaaggaaacattttctctattacctgtcttagggagcagatgaatttattgtattctctaaagagaactcttgtacttctggtgacaaattatacttataggagtattcaatatatggagtaccacagcttgacatttgtgtccaatggagctagtgagaattttgaagattttttttctccttaatttatcaattgcttgaatggactgattaaatagtttaattattattggcatcatgtcaatgatctaagagtgactttttttgatgtgatcagaataagtgaattaattagactgtctaaatttcaggtaatgtagaaagtgtgtatttggagacggtaatctccaaagtcatagccttaaaatcaacctcagtaactgctcttccaagtagttagaatttattggtcaacagtataaacctatgttgtcttaatttacttgtttcaaatgtctacagtttgcctagatcagctcaaaaatgggaatattacttagaaaaaatctgctgctgcctttaagttttaaactttttacatagctttggtattttatcaatccagatacaaattacagagtgtgtagcatattggtgttctgaatgactataatgaggcttttatgggagaacatttttcttttattttttctgaaaaatgaggggagtgttatttacatttctcaaactcttttccctacacaattgtgtaataaattcctgagcatacctttttgtttctaagtatagtttgtgaaatatgtgaagtactattttgaaatatttgtcataggaacaaatttatgtattcctgtccttctatgatagtcgtcttttcaagagattgtaattacttccacttcgtgttggcgttcagtctttagatttttgtgcctaaatatacacaattttttgatagcaccagcttcttcaccagcggatgttttccatcagagatacttcatctatctgtcatctttgtatctgcttctcttcctgacacaccttgactttgacaatatgccaaaacctaaaatcaagccttcattagttactttagaggagagagtatgaagtaagccaggatttggttttcccagaggtgtaaaaggaatcaaatgattaagataaaagcacagcctaggttgtcataaagagtgaattgaaactcaagtttgagctggaaaactcatttgaaactaatcatctaaaagtcaaacctcaccttaatttgattttagaaatttaaatttttcatgactccttcagataatataccagagaatctgctgcttcaggatataagaaaagcaaaagctatggtaacatttagtaactatatattagtatatggtatactgtataccatatatagacatactatatactatatatactatatactcaataatatagtatatatattactatattagtatctataactaatagatatgtatatgtttctttttaaaacaagaaatcatcttatatttcacagcaacagtctggcttatgttttcctttaaagaaggtataatggtaacacattttttatattgggaattgggggaaatgaattcccccattgttattctcatagataatgtgatgggatagagttggcacatctacttccagagctatgttggaggtagacagtggggtattcttagcaccttgctgggtaaagtgtggcacagggacaaaccagcaacatcaacatgtgggagattgttagaaatgcagactaccagaccctgctccagacattgtgaatcagaatgtgtatctcaataggtgactctttagcacattgaatttgagaaacactcctctgcataaattacctcttcacatttcccatctctggcccaatttactgtctctttgttccccagaaatctcttataacttccacagtcaaaagttttcagtttcttctttggtttactgttgcctcagagatccccacttggacccattagctcctcttcattgctgtcctctgttgatcttgcaactgtgattttcctatttctgatgcataaaatagcctaaaacagttggtcattctcttcaagcttatcattattatttgcagggagaaaagagacactccccaatagttcatgaaacttacaatacctgagaactccgaagctaaaaaaaagaataaaatcaaatgatgtgaattattgttctgtggtgatatatagtgtatatttcctttaaatttcccacatataaagttaaccataatatatataaggaaatatatagtgcagatttagaaaacattagattgttttttttttttttttgagaaactgaccaaattactgggtgaaaataatgtatggtaagtttaggttttggatttaatagcctggcatatacaaatatttgtgcctctagattcaattaattattgttattgctctcatttttaatatgacaaggatagattagttttgtggttgtattgtttttaaaggaaatagatacttataacaattgtgatatccttgctgaaacgtttttcataaaaaaaagacaagtaatagctggaaataactttgagtttgttatttttcaaattaattaactctaataactggcagtacatctgactggaggataactaaaatatgactgtaaacttaagaggaaaaaatcataataacaatattataccatattaaatcactgcaaattctcactcttgatttagggtagtggttcttaacaggttgagcgagtaagggaagagggaatttttattttgcctcggtgggatatttggcaatgtttgaagacttttgtaacaactggagaaagcaggcacttttacatttagtaggggagacaagaggtactgctaaatatcttccaatgaacatggcagcccctaaaaagaagaatgacctggtctaaaatgacagtggctaaattgagaaactcttacttaggggattaataatagcattccatcaggaaatgtccataactaaggagatttgggagactgccagctccctctctaacttccaatcatattctcatcagaagctctaaattccaaatctgttgaaatataaattttaaaaaataaataagtgattcatttcaaacttgaatctttcatggaatgcttgtatcatctgagctataaaaaattaacatatttggagaaaaatggtgaagagtagttcattcctacatataatttcttttctatttctattcttccttttcctccaaagacgtattcatacatgaaactttacaattcacctaggtaattttcttgggagtagtatttctatctcctttttttttttttttttctttttttgaaatggagtctcgctctgtcacccaggctggagcgctgtggcgcgatctcggctcactgcaagctccgcctcccgggttcacgcaattctcctgcctcagcctcccgagtagttgggactacaggcgcccgccaccacgctcagctaatttttttgtgttttttagtagagacggggtttcaccgtgtaagccaagatggactcgatctcctgacctcgtgatccgcccgccttggcctcccaaaatgttgggattacaggcgtgagacaccgcgcccggtccctatctccatttttaaatggtgcttcatatcttagagaaaaccttgtagggagatatgatactacatatattattaggccttggactaattctccaaataaatatctgggagtaaatttaatgaaactttaattttctctaaatgaaggtcatgaaaataatactcaaatttgtaaactgaaattatttgtggaggtcgtgaatagcaattcatttttcaatgaaagagttttatttgacactcatataatctggcattatatttggtgactttagcaaagcagactgaagcagttaccttctctggccctataaactatgaatgatatgatatttcaatccagggcttaattttattcagaaatttgggtaaataattcaatcgttctaatattaatatttgatttggagaacaatcaacacatatcaaagcctctatatattgttaggttattgtttttttctaaaaacagccttttgcttacacatgacttaaattgattgtacttaaattgattgattgattgactgattgatagtgtctatctaccacgtaaactttcttagactacatatcactacataaatgcattggaggagagatccaaggaaggttgagctacacagttttcacttagtatagtattgatattgtgattaactagtacaaagaaatcatgagctatgactcacttaattaaagaaactccaataagaagagagtgaggactggcagggttcagggagtgtagaaaaagcactgtctgaaatgagtaatatatgtttgtggaaaacagaaagaggtatccgaattagtaattgtggaattaaagtttctttagatatttattgatgtcttagcggtgaacatgcacttaaaggaaaacactcttttggcaaatagggagcttgttgattgcccacccaatatctgttcgctggattctccttgctgatgaaagaaacatcgatattgttcaagttttcaccctcccaggtgttcctggaaaatggcccctctgcgactccatgggttgaatgctgattcatcttggaactaatcatgaccatgatagttattgttgcagggattggttgaagcaagtgtaagtaaagccaatgagactggtgcagaattccagtgatttctaggaaaggttttcctcctgatggagagatagggagagacccatcatttcctccgtttgggcttgttctgtaaaggctctgggtctgcagcagctgcatttctctcgggactagaaaggcagagcccagtgagcataagagaagccagcatggaaccttgatatcactgaaccactgaattacgtgaaagaatgcctcttctttgttatttaagccactcttagtgtttttcatgctttcaaataaaaggcatccttacaggatagaatgttttatctttgctcaaatattctaatttctaaatggaggctatggctatggcataattgtatattatagtgttatttatattttccagattgtcttttttggtactttagtatgatgtcaaaaataatagagtagtaaaacaggttaagaacattggttagaattgaggcatctgcatttccattctatctctaccacttattatataatcagatgtaagccaattaatcaaaaactgaccaggtggctcatacctgtaatcccagcgctttgagagaccaaggcaggagaatcacttgaggccagggcttcaggatcagcctgggaaaacacagtgataacaccccatctccaatcaatcaatcaatcaatcgatcaatagaaattagcctggagtggtggccttcacctgtagttctagctactcagggggctgaggtgggaagattgcttgagcccaagagttccaggctgcagtggggtacgactgagccgctgcactctagcctgaatgacggagccagactctgtctctcaaaaagaatttttttaaatcttgaaaaacatttgtcttcacctctaaaaaaaggaattagagtaattcctatgtcatatcactttagagcaaatgagatttgagcaactgaaatatttctatgcatctaagaatacaaatacatataatacatgtgaaagagctatataaatatcatttcttattctaagacaagctttgaggttctcccattttaattcaaactcttgctaaattcatttacatgtctccttaaatctcagtctacacttgaggtcttgaatttgtatttaggagaaggaaagttgacagtgttgtgtgaagtctcagcaggcacctcttctaaattcagagcccaatacattgcctctgatgtcacttcatttttatttcatataatctgcacagacaaaagttcgcatacaatcttgctgcaaaaggaattgcggttttggaccacgaattttaaatcattattactaggctcaaacacatctttattagtcaaagtaggaaccattacaatcatcacatttttgtcaacgagaaataagtttgtttattcctgtagaataaaaatctgtgcttcgggattcgacgaactcttggaaagcattttctgcatcctgctagttgtggaagcgatttccctgcaaaaggttctggagatgcttgaagaagtggtagtcggttggcgagaggtcaggtgaatatggcagatgaggcaaaactatgtagcccaatttgttcaacttttgaagcattgtttgtgcaacgtgtcattgggcattgtcgtggacaagaattggaccctttctgttgaccaatgccggctgcaggaattgcagttttcgatgcctctcatcaatttgctgagcataatctttgaagtaatggcttcaccgggcttcagaaaactgcagtggatcagaccagcagcagaccaccaaacagtgaccacggcttttttaatgcaagtttggctttgggaagtgctttggagcttcttcttggtcgagccactgagatgcttgtcaccagttgtataaaatccacttttcgtcgcacgttacaatctgatcgagaaatggttcactgttgtgtagaatcagaaaatgacacttcaaaacaacatttttttttttttttactttcgctcagctcatgaggcacccacttatcaagttttttcacctttccaatttgcttcaaatgccgaacaaccgcagaatggtcaactttgagttcttcggcaacctcttgtgcagttgtaagagaatcagcttctatgatcactctcagctggtccttgtcaactttctttttttttttttaaaaaaattatactttaagttctagggtacatgagcacaacgtgcaggtttgttacacatgtatacacgtgccatgttggtgtgctgcacccattaactcgtcatttacattaggtatatctcctaatgctatccctccccactccccgcatcccacaacaggccctggtgtgtgatgtcccccttcctgtgtccaagtgttctcattgttcagttcccacctatgagtgagaacgtgcgatgtttggttttttgtccttgcgatagtttgctgagaatgatggtttccagcttcatccatgtccctacaaaggacatgaactcatcattttttatggctgcatagtattccatggtgtatatgtgccacattttcttaatccagtctatcattgttcgacatttgggttggttccaagtctttgctattgtgaatagtgccgcagctttcaatggccggtcactatgctcctcatcttcaaggcccttgtctcctgtgcaaaatttcttgaaccaccactgcactggaccttcattagcagttcctgagccaaatgggttgttggtgttgtgagttgtctccactgctttacaatccattttcaacatcagtaagaaaattgctccaatttgctttttgtctaacatcatttccatcgtctgaaatacatataaaacaaacagcaaataataagtcattaccaaaaacaaaacgagaaatgcacattaaaatgatgtataacatatttcacacttaattcagaatgtattccaatatcaaatggcaaatttcaacaatgcaaacactgcaattacttttgcaccaacttaataattgaggcagtttaaacatagtaatttggtatgcagtttatttataatttttagtgatgagaatgttctcaaatattgatatttcagatttcaggtcaaatgttactttttcatggagacctcctgacttttcacaagccaccctcctgccccaccacctcctaaatgactgtcacccctattcctagcatacaacacctgataagttcctctacctccttatgcatgttctttgttgtatatccacagcttacaattatacattaatgcaatcatttgattgatctttatttcagccaggaaactgcaagctgtgtgaggccaatccccatttcatgaaattctcccttaactctcagcatttacagttcctgtattaattgcccattaattaaaattatctaaaaaatgaataataagagctttcccaaataagagagctaacaacgatttttgttttgttttgttttttgaaaataatttgatgatttacactatattacttgaaataatgtcttttagggatttcattgtctcttttaatggcataaaattaagtacaattcttatatataaacgcatatatcttgaataatctataatatatctatattaaatatattacattgtcttttttactagcagacatatttagttaaatgtagctagaaaatacaactggcttgtgaactgaagtttaactgaaaaaaaaaactatgtaaagatagcttcatattgaaaattatattgattgttatcaaggggaaaaaagtgagaatcctgtaaataaatccagttgagcaaatcatagaactgtttaaaatgaataaatcatagacaggaatgaaaataataaaaatactttctaaaataagtaattacttttctactttacagtatgatgttatttgcctgtagtattagaattattgctatttgggaagtttgggttctaaaaatcttaccaactggatttctagctttcgctttgtgaatggggttttatatgcagaaataatattttgacaactgtgtgtcagcaataatcacctgggattctgcctttatgaatcacagtccaaattctacttcataggctgaatagtcaatccaggaacatcaaatttttgacatatgtgatatgtgattcttggtcacttgaaatttttctgactaaactctattttaagtatgtcactttcacctattatgctgacctttcaaggaaggatgtctgattaaattagaaaaacatggcaaaatcttacaggcttttttttttttttttttttttttgaccctttccttgaaacaaaatgcactctgaaaaaaaaaagggaaaacgtggacaggtgctagaaatcagataagatagaatttattctagcgacttttaatttataaaaagtaaaatgttttcttggtgctttaaaaaaatagaagtgatttttctgttgctaacactatgtctctttatgaattgtgttctcttcatcaaaacagtgtttatgttttaggagattggattagaattttaaaaatatggcatgtactatatttcatttcttttactttgatgtaagcttagtgggatttaaaataaaggagacttgaaacataagtgcatgggttttatttcctccagctttactcatgaattcatttgtgctttataatccttacctaacatatattaactataaagttaaataaaaagctaagatgtagtcaaataattttcatttctattttgacagtttaaatatttcatatatttgctataatcattctttatttttttaaagtagatttaaaaatttcaaatagaagacaaaattctgcttctgctagtttctcatattgataacattttttctctaaaacaaataactttggcactaagctctgttttgttgtgcaacttcaaattagcatattttctggtcaaaaatgcacagttattaaaataaaagtgaccaaaaatatacatattataattttaaaagaatggctttcatattcaattcattatacattaaatgtgttgaaacatgcaaaatagtgtatggcagactgaataggtttgtgcattattaagaaatggcctattcctttaatattttataaagagtatattcagactaaacattatgttttcaagcttccaaatgttcttttgtatgaaggatataagaacaagatacataccctgatggaaaggagtttcaactgtttcattccattacgtgtaaaacaagaatttataaaaataattcacacaaaagctttgcttatttaaaatattgcctcctttatgaaaatttttaattatttggacccttaggcttattacactctggtgcttagtttcttttgaaagattaaaaaaagaaattaaatttagtctataaaaactatggtatagtatactttttacgtaagtcccatgtcccaaatgatagtcattgaacctaagaatgcttaatggctatgatgtatacaacataaaccaccttaagtatttctgcaaccttaatagctgtagattaccattactttttttcctacatatgatgctcactttattgagaaataattatgtgaataaaaatattaccaaagtaatgtatgagattccttgggagttgctaaaatcattcatctccattgcatgtgacataagaagaaaaatgtcaaaggggctgatacacttggatttttctgatatacttaaaatcatattattacacattatttttattaattttgttaataaggcagtttgatatacataaactaacagatcaaaattgttacctttaaacttgtatacagtagttgttagaaatgcaaaattctgggccccaatcatgacctgttgcattagaaaccctgaggatggggcccagcaataggatttttaataggctgtccatgggattctgatgctactcaagtttggggattgctgtgttagaagatcgttatctgatgtaatgaggcacacagtacttactaagatattcagctgctgcttgattcagggctgtagttcatctcaacctctaaatacagcactgtgtataattcatgattaatataactgttgatatttttaaaatattggattttacaataaacacacaggaagagaaaagacgcgtttccctggcaacttgggaaatctattcctggaaatttgtcataggaatttatttccaagtcatcaaatttatctcatgtattcttggaatttagtttgaaccacatgtagtatcttcaatatttacaaatacttgtacagtatttatatatctggaatccattgctcatgataaaagagatgatactaaaacccaaaaactaaataaacaatgaattaagtgataggaaaatgggaatacagaattggaaagtccctgtcatgcagttactagaatataaggttgtctgggaaatgactattaactgttcctagagtgttactaggatcagactgtgatgaattttgtgtgccaccctaaaatgctcacatcaatcaaagacaacattttaagcaggtgatcagggaggatagtgtaattgaagaacaaataggaatcagaaagggcactgtaaaagttcccattataggttaatgggacctagaatgagccttttattctttggttatatatcttgaggatttagcatcaagtagaacttttattattttgttaagactccaggaagggctattcttaaaaatcaaatcttcattattttcttttcttttatgttaatcagattatagtatttattataaaggcacaaaacaaagagaagtcatatgtggaaaactgagtaacttgtaggacctatagaggactcagtgaacatgaaaattatctagtaaactaaggaaagcaaaagaaacaaacaaaagagtgtgtgttgggggacagaaaagtactctcgcagtagaagttattatatttcccttctgtataacagtcaatattcttttgggcctaaggttaagaataagctaattttttaaaaaatgtaaatggctacctcccttctcaatgtaaagtgacaagaccaagaatccagcaatcggggagacagcctagcctattcaagaaaggagagatgcaatgcaatgttttaaaagaattttaaccattttggatggtctatacttggatactattccatgccatggaatcccaggaaaactgatagccgcacacttcataggtttactcaaaagtcttcaataggatttaaatcttgtgggtgatatgagtcaatttggtaaactgtgtttgtccagaaattccctgaataaatatgtaatctgtatccgtattgttggatggatgtactaggtagccatttcttaagttgaattagtaacacaattttgatggaaatttgcctatcctgagtgctgaaaaggcagcaaataagccataaaaatattatatgtagaatcttgtgaaaacgtttattgatagagctgcttccattttccattaaaggcagcaaaattttactttatttagagcagtaaaatatatttgaatgagtaatcaaattttagaggtggcagaagcggcagcgactatagaaatcatctagtgcaatactctaattagatagacaagcaattgaggctcaagtaggcttagtgacttgatgaaggtcacgtcattaccttctgggtctgggttcggtgctcttttcattcctcctctctgtggaggagtactggtctgtgcacagtgacaaagaaggatttaagattgtgtagtttaatattatcagattatactttatagaatttcaagactacttcaaccgagtgtcatgcattgcagcagcacccaagataatatccaaatctggagacacagcagacaaaatagagctacttttctcagcaggtgaaaaatgctgatctttcataagcccaagagaaaaatcaggttgtataggattattattagctttccattctcgtgaatgtgtatcccttcatcacaacttgatttatgatccagagactgagctgtcacttgacgactaaagattcttaactcattttctgacaagtagaaattgattttagcttgaattcaaagattaatctaaatctgcttgcattgaaagagtattttcaaatgttgctatgtaactaaaataaatatcacatagtttcaatttctgtataagccaattaatttttgaagatcttttaaaaattagtatatcattttcctacaactagtcttaaaacagaaggattggatatgttatcttctagccagtaaattctcaagatttaaaatatctctaaattgttggctttattttgtgctttctgaactgctaaaataatcactaaatacatgttgttcatatgtagctttcaaaataattggataatataaattagagtaacaagttagtccttcaacaatttttggagactaaaatataaaacagaacaaatgagctttataactcccaaaaaacctttgtggtgaaatttgctttagtgattatctcttggaaaataaacacttttattttctgaaataagtgattctgattcaaagaaaagtttaggagaggaaaacatttaggggaaggttaagtgtaatagcattatttcagaagtgaaaatatatgaggtaatattcgtttctagaacctatcaaattcttaatagtttatgtagcatacaaggggcttgtagaatctttagtacactgaaatttgttcactctgttatccaacaactgctttagctcctgctgtgtactaggtactattgttggcagtagagatgcaaacaatacaatagctaatatttctctaaagggctatatactattcctagtgctttcgatatatcatttcatttaattctcaccacaatcccatgaagttttacaagagagaacagtaaggcccaaagaatttaaataaatcgaacaaattcacaaatctagtaagtaaaaacatcaggaatggaaatcagacaatctgattcccataaaatgcacgtcaccactactttatactacatatggtaagagaagtaagctatttccaaggaaatcttaaagtttagtggaaaagaccaatacagagcctcatacattatgccaagggtttggcttccatcttaatgcaaaattgttatgaagtctgggaattaggatgtttactccatggacttagactagaggtgcagagatcagacggtctaccaaagtcatcagagaaagaggtctaacaagatatggaaaggaggtaatagatgccaggtgatttatgctatctgttctataagaaagggtgtcaactaggcagaaagggggtagagaaatcaaggataatttccatgatattgtgattgatgataactgatgcatgtcttggtttctcctagatcaatgtttcccaaactttagagtacatcagaaccatctgaaggataccacccttatagttatggattgccttgctaatggtgcttgtccaaagatcacactttaagaaccaatgtcctacattaatactaaggctttcgcctgcaaataaatttaaatggcttggtattatgaaagtttaaaggacagaacttcaatgaaactttaaaaagagatgtgatctgttatatatatatatatacacacatacgtctaggtgtgaatatatctatgtatacatctacacatatatctgcatctataacacatatcctaacatacccagtggtatcccatgtgctatttcaatatatgaaattgtttcatggcccctatattataaataatttctaaattgctggaaatttagaagataggaaatttttacacagattcctccaggcagttgaagaaatttatataatgtacttctagagttttagcagagtcaattatgggtattttggaggtagagtatatatagaagctaaaaataaaacttttttctaaatattaattttatattgtatgctatttgctatctaaaactgatagtttctaaaaataattataaaatatactcatgacatttggttgacaaaagggaggtaatcatgaaactttaaatagaattttaaacaataatagccttaggaaatgtctaccatatcactttttcccccaacgttcaatttccctttgaaaagcactgaaatgatagatacaacatttgtagaaattatgattcttaatagaaactttggtctatatttaccgcaatgtttaaatgggagaggagttattgtttaatctgttactagatcaggggctgttccataggaagtggctgtaaataaacagagcatgaaacctctcaaggcacttataagtaaatgagctaacttttgtggccataggcctgctttaaacataccaaaaaaaatctcatgagtattaacattgatttcatcccaaaatgtttacagcaaagtaaaaggatgttttaattgtttaattattggtctttattcaaaattgacataaactgttacttatattaacgtgcttttagagtacttcctcaggaaatagacacttttgaattgtcatcttagaagaataggatatctctcatcaaatactgtggccaaagtgcaccaaaaaaagaagatttttaaaatgtaaaagccatttatttaaattgtacatactttatttttattgttataatcattaggaatttcatggattgatttagaccagtgagccatcaaatctttcaatagcctcacgcagtagagatcccctttatgccttttcaaaaaagagcatggatccggcacaatgctaaatgaagattatgttcaaaaaattgaaatgactgaacagttaactagctgtaacatgtttaacaatagaatggggaaatcctcttttaaccttttagctaattattaaatatcttaatatgaaagaatctaaatattatttatagaatattctataaaatataactaatgaaaaaatgaaaaggttacctgtacaaaaggaactataacattatatttataaaatctttaagtccggaattctgcacgatacctacagagtttgggaaaaaaaattaaattgtttttaatgagactagatttctctttacttttctagtaatacttttgtgtttcttttggaatatacaatgtagctggtctataagcaataattcaaattaaatagaaagctgtcatgttaattaatataacccaatctgtactactaagtggcgttgaaagatcttgctttcacttgattctaggtgattaagaatcagtcattagtaatgtataagcactttttccctagatatttcagagtcaaaagaaagctagaaacaagtcttacccacaaggaccaagtatactagtgtgttttgtcttgttcttgcactagagctatcaaagtcaagaaagaatatggtctatagtggttggaaatttcattctagctgtcaattatttcatgtataatgcgggttttaaaaaaattctttttaaaataattttagatatacggaaaagttgcaaagatagtacagagttgccattctctccacctactttctcataatgttaaatcttacataactgtggtacactatcaaagctaagaatttatgtaggtacattactataagctacagactttattcagatttcactatattttccagttacttcctttttctgttccaggatccaatccagggtatcacattgcatttagtaggaaggaatttttttcttttctatttatagtcaataatatattttaccacatatcattttgtcatcagtttaactttttaaaattaataggtttatttttagagcagttttaagtttacagaatgattgaacagaaagtacagagagttcacatatattccccatttacccccacagtttcctccataattaacatcttgcattgctggggtatgttttttgaaaattgatgaaccaatattgatacattattttaacttaagtacgtagtctgcattagagttcactctgtgtattctacagttctgttggttttgccaaatgcataatacatattttcaccatttcaatatcatacagaatggtttaattgccctaaatatcccttatgctccacctactcattcctttcctcctcccactcatccatggcaaccacagatctttttgctgactgtcgttttccctgtcagaatgtcacttagtgatatgcatgtaagattcctgcacatcttttcacatatgatgctgttttgtgtttgctttgaccatctatgtatccttccagttctacacatgccattttgaattctgagtttacaaaagaagcctctgtccttgtgtgccttccattttgtacttattgaggtgtgcttctttttgaacttagttttcttttggaattattaatggtaacattacaacaaacctttcagtgcagtttactattagaaaatatctgcacatatgaacactttcatttcttttcatattatcacttgtaagatgacagtgtgcatttcttttacatttcttgttatttttacaataccatactattatttatttttgcttaaatggagtgctgaatactaggcttgctcctcgtttccaaacactctgtggttgtgttttgttttggtttgattctttttacagtaataacatatggcaattgtttatattttcaatgcccaaagctgattattaaactttgggtgtttaataagagttgaggaaaaaagtccagaataggcataatttaccaattgaaatataccagtttattgacctactttagttgaactgtttgaaataaattaagaaataacaatcatatcgttcttatagtatcaatagtaagcattgaataaaaccactggatttgatcgatgatttaacagggtaaaaataaaattgaatttaccctcataaaataagacaagttctttttcctttccaggaagaaaagaattcatcctctaaacaaaattttgttttcttgatagaggaggggagacagggacagggattaaaaagttgatattcttttgcctacctgagtcattgttctcaaaactttgctgctaatgaattactttattttctataattcaaacaagttagaaacattctattttagttgtgtgtattacatatattcacaaacagacacacacacacacacataatagtgtatttacctttatatagagattcttcaaggaaatatacaaaaatatttaaaataatatccatcatatcaacttcttaataaaactactgtgtgaacatactcaatttccagatatgtatatacacatatattatttgagctaaatcaattcttagcacagttatttaaagcaatatagaatgatcttcataatatagctctttgaaagatcttatcttgcaatcttttctttataaatttgtctgaatttataacattcaatagcttatatccttccattcttttcactaagttgatttaaatgagtcaaattttttaaaatctgctttttctatattgtctatttcaaataatgtattaaatatccacttagtcacctaatgtagagacctttgagtcaattcttatttgttgttttatttttattcatattcagtatttatcgtttcctgaggaatttttttttctcaagtgtgtctagaatcgatttctcactctccatttcactgttgctttatttccttcagtcaaacaatatcatcaaagaagacaccactgtgtaataatatctttggctttaaaataagttgcataatttagttaaaaaagaaaaattaacatcaaaataataaaaaaatgagatgtagtgttaaaaatgaatagatgctaattttggaaaggaaatccttacagtagttctcacttacatgtgattttgatttctgtgctttcagttaccagaagtcaacagaggtctgaaaacattacatggaaaattctagaaatagttcataagttttgaattgcccactgctctgagtagtatgatgaaatctctctctgtcctgctccatcccactcagggcatgaatcatccctttctccagggtatcctccatgtatacacaggaccagcccattagtcacttagtagctgtcccagctatcagactaactgctgcagtttcacatggcttgtgttcaaataaaccttatttaacttaataatcccccaaagtgcatgagtaatgatgctgccaattcagataggccaaaaaaaagtcataaagtatttctctaatgacaactgatgatgagcttttattcatatatttgttggctgcataaagtcttcttttgagaagtgtctgttcatatcctttgccaacttttttgatgggtggtttgtatttttcttgtaaatttgtttaacttccttgtagattctggatattagacctttgtcagataggtagattgcaaaaattttctcccattctgtaggttgcctgttcactctgatgatagtttcttttgctgtacagaagctctttagttcaattagatcccatttttcaattttggcttttgttgcaattgcttttggtgttttagtcatgaagtctttgcccatgcctatgtcctgaatggtattgcctaggttttcttctagggtttttatagttttaggttttacatttaagtctttagttcatcttgagttaatttttgtacaaggtataaggaaggggcctagtttctgttttatgcatatggctagccagttttcccaacaacacacatatgtttattgcagcactatttacaatagaaaaacttggaaccaacccaaatgtccatcaatgatagactggataaggaaaatgtggtatatatacacaatggaataccatgcagccatagaaaaaatgagtccatgtcctttgcagggacacagataaagctggaaacgatcatcctcagcaaactaacacaggaacaaaaaaccaaacaccacatgttatcattcataagtgggagctgaataatgagaacacatgaacacaggaaggggaacatcacataccagggcctgtcgggggtgggggtaagggaaggcagagcattaggatgaatacctaatgcatgcggggcttaaaacctagatgatgggttgataggtacatcaaactgccatggcacatatatacctatgtaacaaacctgcacgttctgcacatgtatcccagaacgtaaaggaaaaaaaagccacagagtgcttttctaaatgtaaggtttctaagaaaagaaaaaatcttacaataaagttgctaagatgtatggtaagaataaatcttctatccatataattgtgaagaagaaaaaggaaatttgtgctaattttgctttggcacctcacactgcaaaagttacagccacagtgtgtgataagtgctcagttaagatgaaaacaacattaaatttgcagacacgaacagaatcgtgtttcaattgaccgcaatcagttcaatactgtctaggatttcaggcatccactgggggttttgtaatgtaccccctagaaaaagggcagaatactgtatttacatttaacctgacctcaggaataattcctcacccctgaggaattttggtctagaagtataatatagggcatcaaaagatgctagtatgaaggtggaaataatgactactaacaattgagaaaacaaaatgactcatatattagtgcaaaataaattcagtaaaaatcagtcagttctttgacagtagcatggagtagctggtcaaaaaggaggaaaaccagaatggaaaagtctgtatgttttgcctatggaatattaaggaaaaataatggatcgtgcattaggctaggagagtaaaacaccatgagaaagaaaaaggcatttgggtgtaatgatgttatattctagaagtatacaatgtctagaatgtacaaagatttttagggaaaaaatgcatgaacttgtgtgttgattaaatgcaaatatcagtcagtaacacacacatgtgctctctgtgtgtgggcatttgtgcatgtgtgtctgtgtttttaaaatgtattattggaaaactaaaatatttattaaaatgaaaacactaacatataaggcacttaataccagggtcattattactgagaataagagtctattcaagtacctgtttttaaagtatctaaaagataatggagagtagagtttatgaatttactgttttactggaaagagtctcttcttgggtttaaaaattttaccaattaagcagagaagacaagaagcattaagcaaatttatttaaaagcaaacaaaaggaatttatgaataaattaagattttatgacaatatcaaaagttatacaaaatgtttgtgtctttcatgaaacagacatccaaactgaaattaaatttagttttctctaggttttttcttcttaaagattgaaaagttatcagggaaaattgtgcttttaaactttgtgatgacatatgcttttaaggagcctgtataactttcagaataataaaacaaaaatggctattttagaatattccttgatgatgaattaatcttacattgttttccagcatacccatcttaggaaagttctgtttatcatgtcacttatagaaacaactggtgaatgcatctgaattattttcaattcctgtcacttgcatgtcaacttgcaccatcttccgccattcctaagttaggtatttgcaaatagaaaatagacattattgtttatttggagtcataattataaacatataacatattattatttcattggagtcatatatataataaactaattgtgaaaaatagacatcaggaacctgagaataccgagtcagagaaagctagaatgccataatgcaaattttgaagccagcgcataccaatcagagattatagttcttcaaaagagacagaaaaatgggagcatggtttttccattgaaacagaagatactattgcctaaacaatcataaaatattatatggttcaaaggattttatagagtgctggtttctacctgaaaccagatatgtctgacatggttgtatgcacgtctgctttgaaaaatattttcttagtctataaatatttaccaaaagcaatctatttactgaagcggtaccagacattttggaaagtattactttgaggatggaacaaccactattttataatctcagtcatcttttgggtttccttttctgaaatagaaaaccattgaaataagacacataggagtggtatgtcatccatcagacactagtatgtgttcttcccttcaagtgcttggtgtatattaaaaactgcccacattaaatgcatagaataatctttttttattattattatactttaagttttagggtacatgtgcacaacatgcaggtttgttacatatgtatacatgtgccatgttgtgtgctgcacccattaactcatcatttaacattaggtatatttcctaatgctatccctccccctcccccctccccacaacaggccccagtgtgtgatgttccccttcctgtgtccatgtgttctcattgttcaattcggcattacaaaattcctgtggaaaatatgagttgtgggtatttatctttataatatttaaaaagttataagaaactaaaattaagattctttaaaagcaaaaagaattcactggtgtgtgactatgtgataaacaatggaggggtgattgatattaattaataagaaagtttaggtcaaatattctgctctcatctcagctgttataataaacaaattaaatatttagtgagagtttgcaagtaaaagcaccgaaatatatttctgtgtacaagtaccagcttgttctcaggtaccactaaaatctacccttaagcagtagttgtttcaaaggtcctgtggttgtacatccatttccttgtatctctggctctctttttagtgacaatttggatgggaaagtatatgattcttaacggatattgatttcatgctaatgacttcatgattaattatttaagcatctaataagtcaaattatgttaaatcacaccacagacattgcagatatgaaagtctaagtggtagccaacaatttcagattttcatggggtatattttgtcagatgaacaaataattcaaattttaagctagaagtaaagtcaacatggtctttaggaaattcagacaataaaatttgatacatattcccaagatatatgtaacttttatttatatgttttttgtatagttggataataatgtgcattcgttattggaaaaaaagataaatttaaaaggctaaaacagatatcaatagagggtacccatgcacctcatttgggagaccttctagagtaggtaatagctaatatccttcattttatgaccaatagtgatttctagaatttaaaaattcatataacttccccagatgcacatatacatattattgagaaaactccaaaatgttgaaaatggatccatattctatgttactgaaatgtttaccagatatcaatttgaatcttatgtgtattcagtttttccatagcattaattccttacgtcatatatcaccaaaatgacggactgtttcaagtagaccagaatatcatttgtacctttagaacacttgtaatttgacatttttagtatagaatttactgcttagaaattacagcctggtatggtgactcatgcctgtattcctagctactcaggaggctgatgcaggaggatcacttgaccccaggagttagaggctgcagtgagctatggatcatgccactgcactccagcctgggtgacagagtgagaacctgtctataaaaaagaagacaatacagacaagttctaacaccttttcttatttacgcttaacagtagaccctgtagaagaagtctgatcttttaagtctgataataagagatatattatgaaaaagataaaaattatacaggaaaaggaacaactgatgatgcataaaagcagcagaggtatatctaattatcatacctaaaatatgtgccgtcgaaagccatgtgtgtctaatagtctactctcaaatccattatctttactagaagaaacccgatttttattcagacattcagagaatgtttcatatatttacttcactggacttctaagataccattatactggcattctactcagctaaaggagtacatttcccagcttctatcaaattgaagtgtgtctgcatgaaagagttttaactgaagggacataagtaggggtgtgggacttctacaaagatgctgtacaggaaatctggcatttgggtagtgactggcactacagaagccagtcacttggggacattagaatgagagctatgacttagggtcagcatagtgaggagcaggaagaggcagctcactggtgctttgcgggagatgccacagcacgtgccagctgcctatttcagtactgtttatacaagaaaattagacttgtgtatgactgaagattttctaggttcaatcattggagcataattccaaactaatatacaaacaatatattattttaggaaaaattaacataaatcaaacatggatatgtgtataaacgcacaaattctccattctctacatgagcataatagaaataatagaaataaaataaaagcatagaatttaaatattaatatcaaaacatccaaatccattttgtggtctggcatgacctgaagctcaagtaagaaaacttttctccaaattctgtttgcaatgatccacttacctttactcttagaaatagtgagaggcctttacagaaggctgcagaatagctttttgttttttaaattacagattttccacatttaaattttaatattgtttggtagaaatgtttgttttaatgaagacttctgccttaccttgagattattcagtgcatatgtttatgttatctcaaatatttggacgcatattttaattcatttttctgtggatcacgaaggtactcatcaacattatggtgtccttattaatttatatccatgtgttctcttctttacctgattaaaattccaaattctatctctaactcaacaaatgatcagagggaatacaacatacataagtcacctatacattagaattaacataatactctcagttgtgttctggtaaacctaaaacgacctcctcatgctgttccttattatgattaaacactctcagaaactgcacaggccttctctttccacccacaacctcctttcacatatggaagttttaacttagggtcaagaccattcaagatgtctaggtgattttactcatctgttgttatgagtaattctcaggacctaaaacgttcatactgttaaactttttagggaggactaatggaatacatactattatatattttttaaaatgctggaattcacatcattattctttcacttatagtttcaacctccagaaacttaattatactttttaaaaagaacgtgcttacattttccatccagtcaatgttttttacagagtcaaaatatactagggtaaaaagtaaaaaccatctttgaggttataggaatatatttaacaaaaatgactgtgaaaaatcacaaaggaattgttaatatgtttctaaatgaacgaagaaatgtaggcattatatgtggtgaggaaagtttgaaaagattcattacaaactagcaactaaattccagaattttgataattagtttggtaaatttagaaaaatcacccaaggctcagtttgtagtatttatctgtaaaactgtctaattattttttgtctactatttcataaatatcatgtgtgtatttataagctattataggttgatggatataaaacctaaacatagattgctacaataaagcatatttaaataagcaccactgtaataagcactatgctataagttaattactaaatgggctatgtatgcaataaaagccacagatgtttggaaaatgaagagttccattgtgaattgacatgggtaaaggaaaaggcacttaaatctagaatttcagcttcatcttgaagcaggtaaatgagtcagagagaagatgagaatgtttcatatatttacttcacttaagatactatgctctcctgctttaattttttcacacttgcgggtccttcttcattgactttgctgttgcctctttattttcagccttctgcaaaatgtagattcatatatccaacttccttattaatatctccatttctgagatattaaaaggaaaaaagttgttttcctctttttctttgagcccacccccaaaacatatttctcctgcagtcttcctcatccatggccacttcttccttccaggtatcaggccaaaatctctggagtccactttgattattttccttctctcacatttcacttgcagtggtggcaattcttgttgactttactttcaaaacatatcagaaatataaccatttcttacccaccagcaatgctacctttctgaccaagccaccaccatcttttacctattttttgttaaatccaggctccctgcccctgcatgtgtcctattatagttacactctgtgttcatcatagaatgatcctgaatctacttatctcactcctttgctgatgatcctctaaggttttcccatcacattcagaataaaagccaaagtcctcagaatgacctgcaaggctcatcatgatttgtcccccagtgacatctgtgacctgctcctctctccttccttacactgttccatccttgctagtgtccacggtgtctatgaacaagtcaggtctgcttttatctctgagcttcagcacttattcttcccacttcctgcaaatggttcccctttgtcctgaagccatgaggccccccgacatttatttctgttctcttcaaatattgacctctcgttgtggcttgccttgatcactctattttaaattgcatttactgtttttattttctccataacaattatcatcttctaatattctccttagtgcatttacttgttactgttattatttatatcccctttccttttgagcaggagaacaggaaagttttgggcttccttgttttttgggtttttgtttgtttttttttttttttatttttatttctcattctttggacgcataaaaaggtgagcactcaatagatatctgttaaatgcatgaataagttaatgaattaataaatgtaggaaagtgtcatttctccatgattttttttcagaaaaagttatgagtatcaatggactgtgtggtgcttatatactgctaattatgtataaatgaagtgcagcaaaacatagtctcataataatttcaaaaatactgattttggacctagcttttaagatttatttatttaatgaacagctatactgaacaatattttaaattgtttgattgaactaggattaattatataaatcatgtgaaaaatttcaatcatttggcagccattttgtaaacaactcactctatcattttgtaattggtagattgctcaaatgttggaacagtgtaacacaaagttttcagattcaaatagatcatgattttaaaaggttggaactttaaaaaaaacaggattttatttgagacattaggcaattatccatatatttcatctaaagacaaatgtaacacacagccaacttcctttaagccacattaaagcatctaagaacatatatatataaaatatatattatataattataattatataatatttataattatcattgctccactattataaccattagaaacataattctgtttaaaagtttcaaactttttaaaattttttcaaagaataagtgtagttaaattttcttgaagtttattcaaactgacagctattaagcacttactgtgtatatgtctgatagtgctgtacattaaatatagaaagatgaatatatgtcataatccccaggatgaaggcattatggagttaatagactcagaagtgtatgtaaaatcaatacataatgagaactattctaaaatatgaataatgatcttgtacattttttatctgtaatagcttaggtactatttctttatttgttaactatggttccagcctatctgcgtcatttaaaacaaacttctcaaacttcaagaaacatataaaataccctttttctagttatattaataagactatcaagtagcatttagtgggtgtataccttgtgccaagcactagtgacaatatgtactgtttcatttaatcttcccaaaagtccattgacatttcaagcatagtattaaccagacaatgctcatatagataaaagagtaaacaaagtttgtaagaaagatttcagattagattaccttacaattgcaatccattttgattttcatggtggctttttgattgttcatggaatttctgaataagaaaatacattttcacaatgccaggctttacaaatatcatttataaaagctaaaaagtaaagcaaaataactactgttttacaattacgttttaataatgttaacttaaaacttaaaaataaaaccacttctcatataccagtttgtggaggattgagttcccttgagagagtgaaaatatggtcttagtgatttcttttatgagattaccctttctcatctttgaaaacattgaacagattcatgctttatacagtatgtagttgaacgttgggaaccaagtcgtactgcagtggtaggagtaattacagctgtcagttctttcaacatgagaaaacaaccttgtttcaactttacaagaaacagattgtaagtatccaaaggaaaagaaataacagtctttatgtgatgaacagtgtggtgattgttaaactagtaaactcggccatttggagcgatgtatttactggaggccgttgggaagaagatactgtttacgtgcaagtttgagagtgttttatgaatgaacaaacaaaaacatgagcactaagtatctcatcaggaagattataatgactggtggacttttcagagtagagacattgtgtctaaagaaacttgtcttaactgctttcatgtgagttttgtttttgtgtgaaagcacttcctttgtatctgggtgttcctcacatctggtttatttggatgttagaaatccaggacttccttatactaaacaagaagagagcagatttaaaattggaaaaacttgaaaacacattataaaatgaggagcaagtgctcttatttttaactgctctgcaataaattgtttattttttaagctatttgtttaacatgtgcttcttctcttaatctgtgtggagggggttatttggtgtgcttttggcaaaattcagtctaagtgccaaaatcagatgacagggaaactgacagaaaagcaaatccattgtttttattccactgttaggtaaaacttaaggtcctggtttcaagcgtttgccattttttttctttactttgtgaaaatgtttacttcttaggtaaaaagaagaatgatattagttagcaaattaaccaaaaaagttagtgtgcaaaagctaaaagatgtttttaatgctaaacagagcaggaacattttatttaaaaaaacgagaccatgaaagtgctaaatatataagaatataagattctgatgacttttggtggcatcactttcctttatctttacatattcactcatgtccactacacattttattttttttttggaaaaaaaaatgtaactaagggcagccagatggcctaggacagaaaacaggacacctctccttgcctggacagatttcaagattgacactgcatcagtgcacaaatgaatccggataatgtggcagaaacaaggtgtctgcctcttaatatgtagcatgcaaaagctgaaggaataaaataaactttcactgacagttctggtttgcagatatataagaatgaaattgtgatgaagtgaaggtttgtactgggaaagaagccaggatgctatggtagtgcgatccagtgttccactcttggccaaccaaattctgctcttttatgatcgaaccacttattctcaagttctgctttagaaaaagcaagattaatgtggaagtcttcattaaaattcaattgccagatattccttaatgcaactttaatataattttctaggatcgccaaatttaaacaaattctatttgacctttattaacaggcaccccttctcatacttcagctgttatccataacacctgtagcaaattcctatggtgttctttcacaaaaccagatctcttgcaaagttgatgaaaaacgaagaggaacaaggagcatagaatatcatatttcttttaggtgtttctcctgatttcctttgggtcctggaacatgtgcttaagtttacagttatctaaataaccctgctgctccaagcagatgactgttgtaaaggggtaaccttgcggggataaaaccagggcaggggaacccagaagcagagatgaaactctctgcgggctgatgatgtatgtatattgatttcacaattgtcctacaggtactaattccaggaagttgcttctacatgtctctggggatgcagcagtaagtaaaagagaacaaatcatccttggcagtagggtagatagaaaataaccaacactaatatatacagtgtaggtagtaacactcgctatgaagaaaaagaaaaaaaaaaagggaaagaagtcaggggaaagagagagttaatgggcagggctgaaattttaaatagaatcaacagagaaaaccctgagaaagtgagataaatgcctaaagtttgtgaggtcttttctgtccacctcagttgaaagagcctaccattgcttgtttgtgtttttaacagatacttcagtagttctatgtataccattgcttcacaaatattaattcatttgaatctacaagataacacaatgggacacattctattataattttgtagatgaaaacaaaactacaatgaaaataagtaaattatccaaggttgcacaaccagttaatgttgaagataagatttaaacctaaacagcttgactccagaatgttctaaaccatttttagatgcgtctttaaaagtagatttatttctgtggattctaccacttcattgaggattgcctttaatgttcatggtagacagtatgtggtttttcattaggtgacattgtctcttacttctcaattaaggtatacttataaattcttggggctttcttttacactgtctattaaaaggaatgaaagaatatgcaaagtattggttggctatttagtctggtcaagaattcctaaatttgtttatcagaaaacaatgtattattacaaaaaatgttaaagatgttaagcaagataaaataaatgtacaggatgctccttattatgtctgcttttcccagattcataataaatgaacacattaatattttatagatttgagaagtcctctttcaaagagacaagatttgcttttgtatatcccgttgcttctcaaacatattttacagtgggcctcttcttctcagcaacaactgcaacattcaaaggaccccaatgtgctaaggagcattcttaataaacagtgccaaaagagtactggatcaagctgtcttccaaatttggaattagttctatttgaaaggagtggaaacttggtaggcaaatacatatgaaaaaatacatatatttgcccttaattttgttaaagaaaaaattcctatgcatgtatttggggaagaagaaaagaaataactacttttttttgttatagtcctaaataatacatcactgtagggcaagggcaatatattataaatagcctcacccacatttccttaagcatatgtgcattatttacctaattcattaatatattagttcattttgtactaatatgtctggcatattttcaaatgtttctaatgtgattttactgattcattaagtcaatatttatcaaatatctactaggcattttgataatcaaagattttatttttagcatcatttctatagccctgattattttacacaaaactgaagttccttttaccaaaatcagatgcatgttttatgaatcagagctcttagttgtaagcattggaaacctgctgaagctgatttagtcagaaaataaatttactgaaaagagtattactaacccagctcagaaagtggctagatacaagttagggagggtacagtaaggaccacagcaagcaccaccaaaatccactagtgaagtccctgtaattaccaccaccgttagtccctggctatggtctcattgacaccacgacaaggctgtcaattgaagtcagatggcattgccaaagctgctgccaaaataataaattctccactgcctctcactcccattacagagttctgggcaggaatagtcaatgaaaccaattggaactacagaaaataagtgaggtgtatttgatgattgtgtatctaaatataggaaagtggctcattttcttggaatccaaagcggataaatatcttcatgacccccaacattaattactattagtgctataattttcatcatttttattattacattgtagtatatagaagtactcactgtaatgaaacatcttagcttcacacggtgatttatgagattgtgttgaggtataaaggagattaattaagaaaactctaaacaccaactaggctttatatgggctatgagttccttccttctttgcttccttccttccttcctcccttccttccttcttttccttcttcctatttttgtattttttaactttttcttcaaaaataaaagaaaaattatactagatttggaaatatgactaaatactacaataacccgacactctaagaccgttatcctaaagcagtataccaaagagtttgaataagaaatgatggtaatcaatttccttacattccgttaggagaaggaagtttgcaaatgctgtaaatgaacataatatataatatattagaaatcaataatgtttggaacaatcagaatggatctcacatttcttctgggggtaacagacaacaaacatataataaatacataaactgtatgctatgttaaagtttgaaaagggatatgaaaagatagaaaaagcagtgtagcatatcttgttagtgtctgtttcttacagaaaatgatggtaatatttagattgttttccttaggttgtttggagaataaaatgagacttcatgtgaaggccctctgaaaagttgttatgattacaaaattgtcaatattcttaagtaaataattataaataactgttcataagtaaataaagctttatattccacaagtcagagaaaagtaatattagattttgtgtgtgtgtgtgtgtgtgtgtgtgtgtgtgtgtgtgtgtgcgcgcattctttttctgtgtgtatttctttcaccaaagtttggatcatgttgtacagcaaacttgtatctttttaattgtcagccctaaagattcaaccctaaagctttcttcaatattgtcacaaacttggtatatctctttggcaactgctttccagacttttaataggaaatccatcagcaaaattttcactttttatagtctcctcagcttacaaagttgctactgtctcaaacctcaaatatttctacattaaaaacattttttaactacctatttcagagtggttctccaattttttggtctcaggattgtactctaagaaattattgaggttttgcttatgttggttatgtgtgtaaatatttaccctaatggaaattaaactgggaaatttaacgaaattattaatgcatttaaaaattagcagtaagtccactagaaggatgttaccatctgagtgatgatctcatctcacatcacgcagcttctaaaaatctccaccaaactctggtaagacaattagagtgaaaaagacaaacattactgtactgttactatgaaaatcattttgatttccctggatcacactttaaggaccatgccatattagaaactagaataaaaaaggaaaatgtttgaatgggtaacacattcacatggttacaatttcaaaaattatagaagaaatatagtgaagtctctctccacctctgccagtaagtcattgtttctcctctctcaaagccattaatagtattagttatgtggttatatgtatacaaaaattgtgtaatgtttacatagtataaatataacacctgcttttatacaaattgaatctttcaattatgtcttatagcttactttttttgaaatctaacaatgtatcttggagatctttcatataaagagcttccttgttctttatttttatgtttgcatagtattacagagtatggatataccatgatttatttaattagtttttttactgacgggcagtcattcattttatatatacatataaaacaaaaacagtggctgtaatgagtaaccttgtgtgaatatcctataatttttattattttaaatctgactttgtctaggcacagtgatttatgcctgtaatcccagtatttcaggaggccaaggtggatgagttgtttatcccaggagttcaataccagcctgggcagcatggtgaaaccctgtctctatgaaaagatataaaacattagctggatatggtagcatgcctgtagtctcagctacctgagaggctgaggtgggaggatcacctgaacctgggaggtagaggctgcagtgagccatgattgcaccactgcactccagcctgggtgatgggagtgagactctgtctcaaaataataataataataatagtaataataataaataataataaataataaacctctcttgcttagtgagccttcttatccaagtgaggtaattcacttaaaacacaagtaagagatttacacaggaactgggaattagatgaacacataattatcctcagagcaggaatgcttgaggctgaaaaggggtattacttaaaattaaaattggggataacatgtagaaagtaagacaatcctggacatattaggtaatttggtgtcctggaaatcatgcattttagaaatgaggaaagcaggagtaaatacaggaacatgccatactccaaataaattagatcagaagaaataaagtaccttattaattaataatgtccaaataatctatttcagccattgtgaatgatgatgttagttttatgcaaaagcaaatgcaatgacctagcagaatttgttctttgaggatctgatttctgctcattttctaaaatgttccttcactcagtattgttctcttccttcctctcttgcccagaaatcacttgtccaacctctctccttctcctcaattgtagtttgggttcccctgaaatcagactgtaggaaggcattttgtatgctgaatgtttagaaaggagtgcctttgggattcaaacctgtggaaaggaaagaaaggaagcaggaatggacagaaggtgaagtgaagctgtgatctagacctaccaagggttttagcccaaccctgcatgctggaactgagaggggcttttagaaagatcttgaattgggctgagattgcaaggcctttttattcctgcaaaatcactggatgtgccacccttgggaaggacctgaactctaggacggccactccatgcagcaaagacaatatctgaaagggttgaaagctgcagggtgtctgctgacagcatcccagcagccggggctgcagtccttcaatgaagaggtattcaggtggcaaattgcagtgtcagcctcttgtatcaacatagtcgcacaacaaacatgattcatactaagatataaatgattaaagtttatatttaccaggatatttcattttagcatgagcaaaataaatgagccaaattacaggagtgattatagctttaggatcattcacacctaaacttgaaccctgccattgcctcttattcactgtaagcttcagtttcttcttctataatatagggatgatgatacctattttggaggatagtgtacagattagaggttatattttaagtaaaggacttaagcgcctagtacatagtgagcatttagcaatgatgacttatttttaatgagtaatcataaaattgatattaacttgattaacttttagtttgatactaaatactttgctatgattttgaggggtcgggggagaagggaacaataaggaaataagaaagctttcccagaacatctcatttatgttgctgctgatgctttatactaacctttttatcatattttttaatattattgattttattacattataatagcaatacctcatattcatatgatataaaaataatgtgtagatgttttgtgagttcccttaatatccaatgtatacttctattgaaatgtgggaatgaaactttgtaaataaactaaatgaatactagttgtgagtatcttaactacacacctgggaaatcgaggactcttgtccgatttcccaatcagacaagattgtgagctgtgggtctctgctgtagctgggtggcaggtataaatggaacactcctgaacaaatcagaattaattgccaagagaacctacagtgttactttcaaaggatgatggtatggggaaggaagagacacaaaaacccattctaaagtgactgttttctctttgaggtcaataaaactggtctggtggtttatccaggtgaataagaggctgattaaggaatgagatctttaaatctgattgtgcctagtttttttgtatagagaagtcaatagttaggagcaacaaaccagagtaccaaataatattaccatattattttcaagggaatagaaacatctcaaattaatccagtgatgattttgaattcttcagacagaggtagcgtttcagacataaaggagtagagaagactaattgatttagcagcgcatggatctaccaggtagcctagacaaggaatgtccaatcttttgtctcccctgggtcaaattagaagaagaataattgtctttgcgccacatataaaatacactgacactaacaatagctaatgagcttaaaaaataatcaccaaaaaacttataatgttttaagaaaatgtacggatttgtgttgagccacattcaaagccatcctgggccgcatgcggcccactggctgtgggttgaacaagcttggcctagacacgcccccctaaaaaatccaacaaacctttgcagagtgtatgctattgctgggattaactggaaatctttcttggaagacatttttcagacctgtgtcacacctgacatctgaattttcccattcacagcttctcttgccctttggatctgcttccacccagacttgctgtagggtaaatcccactagtttttctgtcttcctctgaacttactagaaatcttccagcacaaaattctagatgccttcatgatccttttcttttatggagaaaaaagattaagtaggccaaggaaaggatctccagattattcaatgaaagtatatgcttttctgcccatttactctctagagagcatacaattagtgttaatagaatgtgtgctggtaggataatgccccagaacaccctgcagaatagtcacagtatatctcagggactagaagagagtgtttaataaatgaaattatctgataatactacatttaaaatggaggtgtatttacacaactacacagagacaacttgtagtactactcaaacaaacaaacaaaaatctttcaatgcagcattgctgagtcagggttttcatatccttatacttcagaaactgtttcttatttggcttttaaagattgcaggtccttcttagagtctttctgtcacctctgattttaatcagtgagggattaggaacataaaacagattaatacaggagacattttgtaagtgattctaatgcaacaacattctagacaatcccactgggatccatgggaaaattcaacctcatttcttttgtagctacaattgaaactctgggaaagctgaatgagaacacaaagaactttcacttaaaataagacaaattgccaatgcttaactaatcctcaaaagcagatcttcctaagaattaaaacgaaatgtcatagtatgtaatccacccaacatatattatctgtatataaaacattcttgaaagaaattatacttttcgtaataattatttttaataaatgcaatgcaatgcaaatatatttcaaattggttcaatcattccatccccaatgctatcaccatagaacagaccatctcttaactgttctaatgcatggattaaaaacttctgtgctcttctgtgcctttcctctttccatctccatattgtagtcaaaatgatccattcaaaaatgcaagtcttatgttaattctctgcttaatttttaatgttattaccttcaaaaaaatgtgttacttttgtattctccttttgaatccttgatccaaatatcttgcatctttacatactcatcttctgaaataaaagaagacatcagcttttgtgcaacaaaatcctgactcctttccaaggctgttcaggccttgaatgataaaggcccctgccgttctggaacttggtcatgctgtggctacactggccaacaatcagctcctcagaaacaccaaatacccattcagggcttttgttcctgtgttttcattttcccagaacacttttccctggctcttcaagcgccgttcaccctatggtttgttttagatgctatcatcatctttgttttacagatgatgaaactaaagccagagaggttaagtaatttgctcaaatgctcattaatagcaaatgagtggcaggattaaaaccccggtgatctaactccagattcccggctcttcactgcatgagatctctgtcttagcacccttcaggtctggttctcagcctaaacgtccgggtagttttccctgttccaccgtctaaagtaggtttaagaaccaccttcatcttctcattcttcgtttatcttcttcttcatataatttatcaaaatttgtaattatttattatggtagttgttcagctttttaaattgtacactaaattatgaggtttctgtgggcaagaccaaaatatgcccagcacatatactatcttttgaacagaagcactcactctacacatttttgcttgaaataactaaaacacatggagaggaagggtagttattggatgcctgtaacttttgaaaatgatataaagtctttaaattataataattgtttttttctgattttttactctgataaccatgttacaagattctatttcattcaaacgtataaaaacaacaccaaccataaaaacagttctttgaaacaatgaagacaaatcaattatcttctatccttagcatttctccctttctctcccaaattcacctgcttcctctgatttgctctccttttttcttttgcttcttggaattatttgcatataattagtttccaacacagtgacatatcagaaatgtcgtactctcagaatattttagaatgaggtctagggagaacctaaacaaaatgcacccttttattaaattgacctgacaatattaagggggtgcttttgaatggataattctttgaaagcatcagttaacaaacagcacaaaaacacaagcacagcaacccagcaagtatgatgtattatttaagaaggggttgagtggggtctttatctgacaagtcacaggcagaaaacacattcctgcaaattgccccatttctcctcaaaatgtgtctgaggtgaaatggagcatcctttgtttcgtacaaagaaaataactcaggaaaatgacagtttagtgatacatatcctcatggtctaaaagtcaatgacctggaaaaaaaatgatgaaaactaatttgttttaatggacagatagtattgtatatttttatcatgtacaacataatgttttgaagcatatatacattgtgaaacagttaactagctaatagatgcattacatcacagagtttttattttgtgataaaagtacataacattcactctgtttacattttttcaaatataaaatacatatacttggaaattcaaaggacatataatttaaaatatcacatttatattctctttaatattttctattctttcaataagaagataaagcataactacaagatttagcatgggtaggggtagggggagaaatgagaaaatgaagtagggagaaaagctatttctctcccctatgtggggagaaataacattacaaaaaagaaatagaagctaaaatgcatcatcttcaattgtgtgttatactaactccatagtttgaagtttgtgcttattagaaatcctgacatctgtgaatttaaggtagttgtctctgtttttgtcttaaatgaaagtcaaagttgaatacactgaactttctgaggagcagcagaatttcaagggttccttcctttagaaattatagggagtatctgaggactaacttgatactggagaaatatttgcacattgctaaaacctgttattctcttttcaactggagcaagatagaattcccacagctaggtcattactatactttgactcctaaactctcatgtttatactgtgtctacatatttgagaattgcaaaaggtgggaacaacactttcttcactgatttctattatttattatatacacatatatacacacacacaaatatacatacatatatgtacatatatttttaaacaaaattatgattagcattttatttgaagagtgcaaagtacctaaaagtcactaagacaaaggtttgaagttgacactggataaaaagacaaccttgaaataattttaaagtttgcaattaacacagatcacagtgtggcaagtaaaagttttaatagcagactggcccaggccttgaggtaaattatgcataattattcataactgctatttttggcttgcctgatttgtcctagacctctggctgaggaaacaatttgaaataattagtgtactagtgcattgacaatgatgaatgaattgaatacttcttgtgccaaacatagatcttgataggaagcagataactttgacaactgtggtattttgttattagatctctgaaagtggaaagtttatgttattttttgtgattttttatagggtgtttcataagtcattctctaatgtcctcaatcattaatgaggctgtgattaaaaacaaaccaaaaaaaatttaaaaacagcattgatgtttatttataccaaatttttacatgtttaatgttaagagtttaaactatgatattctaaaaataacttcatggtaattaagagacttcctttcaattttaatttcatgactaaattagagtttagtatattatatcaaaactatatttaagaaaaataatacagataattaaacacaatgcttcttgaaatagagaagctttaaatttttcatatgataattagtaattttttctaaatattacaaaatgcatatttgcctacctgttgagttcctattgctaggaaacaaaaccttccctttacatatgttagtatagaaaataattttcaatgattaaaatatgcaaatgtattgaaatttaaaaatttagaaattctggtacaccatcaaaaaataaaactagcagaaaattatagaaaagtctcagagagatgtttttccaattcattgtacataaattatataaagctcctcttttaattaagcaaatactcagaacacaatatattcgcatttttcagtagaataaacactaacaattgtctgtctggagacaactgttccttggctggaggtttggacagacaggcaatctttgttttggtataaaagcatcagcccatttaggtcacctgagtgaaaagaattagacttattttttctgaaaccataaaataatttaaaagtataaaaagatgaattcacagacaacctttggcatctataataattttatcactgctaattatacatgtttttttttctaattttaaaaggttagttagggcatccacatttgcagtaaaatttttttatagatattgtacatatttttcagaccgaaattataaacatttatattacacaggcacatagtagttgggtcttagctgtgcttctgaaatacagcatctaatcaatgttctcattctctgttacttataaccatgacaaaattatttaaatgattcttgcttttcatgtatagaataaactgcaatcttaaataaactgctaataaaatatatcaacttgtttgataactgttatatataaactattattttatgtaactcttacccataatgaagagataaaaaatcacacaggtgaccatacagtgtttttgtgtatattttcagatatcatatatttcaaaattgtgcctatgaccttgaaaaagctgtttttttgtgggatcatatggctacataaagagacacttctcttaagttctcttgcatttattaggtttaaagttcaaatatatcatttcttcagttttactgggatgtatgtaaattctacttcataaccttaattttgtttttttgttcatattttctgatagtagaaattgcagcattcaatctactttacctgaagcctttgttaattagatacagttactggttttgacagagccagatgaacggctctgaaagtcaacaaactctaatattgagattatagcctcggcggggcgcggtgactcacgcctgtaatcccagcactttgggaggccgaggcgggtagatcacgaggtcaggggatcgagaccatcctggctaacacgttgaaatcccgtctctactaaaactataaaaaaaaattagccgggcgtggtggtgggcgcctgtggtcccagctgctctgctcgggaggctgaggcaggagaatggcgagagcccgggaggtgcagtttacagtgagcagagatcgcgccactgcacttcagcctgggcgacagagagagactccgtatcagaaaaaaaaaaaaaagagattatagcctcagaaaataatgatttaatcacagaactagaattacttaagtttaaacctaaggatacttggcttaatctgtgagatagcttttattttattttcctcataaggactttgtcatattggattactttggacccaaaccttcaaggacacttagcctggctctctgtcctgatggaaatggaatagcggtggtctgggagtgaagatttccactggtctatggaatgcacacaacttggctataaagtgtagccaaggagttgatgacatacgaactagttcttctacacttttcttctgagacaggtgctgttgcgactactcttgctattgaagtgaagatagagcaaaagtgtagacagtgggatcccaagctcaaatataaatatttaaccctaagtatcagttataaaaatgatacgtttctatatgtcattgcagaagagaaacacttggggattttgagacccttgagtgaagaaaaagaaaaaacaagaatttatttgagagcaatttgagagcaatttttgtgaatgctcattttggttatttttgttaatattacctagaattaagttcagtagttttctggtctagtggatcgttaaatagaagatgtttacagcatgaagagcatatgctaactctttaaaaccattttttttttttttaagaattgaatctgatacttttgcttagctggataagggaggcaaaatttttaacagattgaacactttaaaaaggcttctgtttagtatcacattatgggcatgcattttcagattggtacaaattagccttgatattacatgaagatttttatgtctcaaatttatcaacgttgtttcaaaaactatatgaagaaagaagcgttttacccactaaaataaaatgaactgttatatagcaggcttaactacctctgtggtaagttctctgtgagagaatataaaataagcatattttatttttcaaatgcctcttgtcatttgaagccaagcagattcaactttgtggcaatggctacatactgaactctatgagaacaataatgtctcaaattgattgaatatcactaatcggttctaaagaaggtgatactgtctttaagttggaagcaattaattttggtgtacaatgaagcaagcaatggatataataggtgtttttcttatgacacaaattgataacttgattttgaggcttatattgagtgaatgtcgtgggaagtaattttacaaactcttctcacatttgtttcattctaagaaaatggtgaatgataaaataatgggaaagaaaacagcatctataacttattcaggattgcacactcttttcttaattgctttagggtacaacttcagagcttattgctaaaaggttatatgttttccttgtgatgtgattttctaatcacggggaaaaaaaatatgatatcatcccaaaggaggcagttgaacaaaagacaacacataaccagaaaagcaaaggttcatggcctgacttaaaactcctttgaatcaggaaccaccttatgatcacaactgccatgtttaaatgcatgactcagagatgtgcctatcgttgataacattagcgggtcattgtgtaagcctgaccataatctttctatagacagaagccctctgtttgggtggaaggcttaaaaagtagtgttctgtgagatagattgcaatttcttccattcgcttttgtttcttccttcttcgtaaccaaccgccccttcttctctactcccccaccaccccctttacgtctgaagccatcaattcatgtatttaaatgtccttggaaactgaaagtaatctagaaggttattagcatattgttataaatgttaatggcctgacagcaaggatgggctttttcttttatgcgtgttgttgtgaacattgtgagtttaaatggggtaaatcttccccattcagagtgttgccctggcccttcattcacatgtcaggagctcattgtgtgcccaaaccttgtcagaggcttctagatgtttagtggcagcagcttgccattgagagctgggaagagggctgtttgggatgggggaaagaccagcctaggcagccaggtggtggccaactggccagtaactgacagacaatttaacctaaccaggctgtacagtcaggcctgcgttacaaaagacccacatgtgtccttagcaagcttcattaactcttttggctagggctgtactcctctgacatattaattagttgcaatgctttctcctactccaacttaacctttccattggtcactcgattcaagtggatccattggaagctattagaataatatgcaaaataactggaaaaatagctgtaggaggaacaagattccctatcacttcactgattttgtaagaaacaacaatgttgaaaagaaaatgtgtgatcattaatacttcactcagaaaggtgatctattccatattgttaataataacaggacatcaattacagtgtaattatgtgcatgtcataggtatagaattgtcatgatttattctgtctctgtaataaaaataaaggaaaatactataaaacaacattttgatgtattttaggttatcttaatgaccagagtgacttgatgtggggattataaattggttcagctttttgagtaattttcacaagttaaagtcttaatgaagaagaaattgcaatattcaaaaaagttaatatttttaatattataacaagtacagtattcagaatctgtaaatatgtttcatatgtacataggtagagatagatatacatataaatgtatccaccaaaaaagatgagttttttgtgtactccttgatattttacatttcataatcaagtgctgtatcatgtaactctaagtagagatgcatcaagtattgaatttaatgactattgaatctaatttgtatcctttgtttgttttgcttatagaatgttttttgtcagaggtattctatacgcataaattaaatgtccaaatttaatttggaattcctaaaatccaaggccaaaaatgcattttatatatcaacccttacataggcagtaaatcttcagtggtatagtacttttaacttctcacagcagataagtcacctctcaaatccattgggtgagtaaactcagtttcattttatcgttttagatactgttatttttccaacttaaggaaagtttcatattacttagttcaatatcctaaagaaaaaaatagaaacaagtacaatgtgtatacttattattaaatgtttttattagctatgtaaaatcaataattctaaaagtagattttgctttaaactgtattaccagaaagagagaagctgtattcaaaacctgatgatgagcattgtctgcttactttttggtcagcttcactgtatttttcctcacaataattggttaatatgagtcaggctgactctaaaataagcatatctgaggcaattcttgagaactaaaacaatgtgtttagttttaagttacatataaaaataacatactgtcacatttcaagaaaaaagaaaaaaatgatcccttcaacattggctattgtctctaaaacatgttctataaaaaataaagtaaattaaaaaaacatagtgaacaaccacagtctggtagcaaacatgcattttattcccaaatcacacgtgtgtcttttgggacatatattttgggaaaatagttgatattggtggtagaagcaaggaaaaattactcggcttttacagagaagaaactcaagaaaaatgctatgtaagaaaaatgactcatggagataagttataatagttttaatttcaattgattttaatttaattgtgaatcttagggactcagaaatgatctgttttctgttggtgaaagctgcacattaaatatcaagaggtcttaggtttccgtgatactaggtgttctcatacttagatagtctcatgtatttgcatagtaataagattataatatctgtctctaggagtgcttaagtcttctttatcatccacgagtaatctgaatatacctgatcaaggcaaaaatgtaagtgtggtcattatgagtatttcattattgtttttatcagggaaatgagattatctgcagctacatacaatgagcttattatctgttagtagattgggtctcttttttaatccatttctaagcagcatgtgcatttacataatgtacatatcacttcaggaagtaaaattacaaaaagattgattgcagagagtatatttaccctatattctagcaagttcatcatttttttaagaatccctgtcttgaatgtaaatcagaattattatatccttaataatatagttataaatcagagccaacagtcttagaaccacacatcttaatgaagttactttttaaaattaaccaccaagttaaattatgaaatatatattagagtatgatatttgccaggtgataatactttaaaaaagatggagctttggaaagaatttatactaatcaatttaataggatataaataattataagatgttttgaccctacatttttaaaaatcaaatcaaatttggtaaatctgataagaatagcatgtgcagaggaaaaaaaaagcatgaaacattgtgtgaactaatttggttgtctccatttaattggaagcatgtattaacattctgtggttctgcataatactttttctgttaaactaagcttcaaaaatctggtaacaataggtttggtaaagaaaaaaagtgatagcattttttttttttttttgtaatctggccttgaaactttcacctgaggaaataagcatgtgttggttgtatttggcagtagaatgttacctttgaaaataggccctttttatttgatgtgatccaaaataaagctgaaacaaattgggtcacaggtgccaacacttgataatttacagtgtggtaaaaccgagtggtgtttgtaagtataatttgctccgggaaaatttgaaaccactttaagttggaaaagtgtcaatattttataacatattttataccaaccatacccagattgcaagatcctttctaactacaagctgtagttaactttcaactattcatttaaatttgtggcttacaagtgtagtgtaaagtcactggtcatttattaaagcacattctttaaatattaagacacaggaattgataaacatatatattttagtatgtggaagtttattttgaaccttgttgagttattaacttcaaaaaaattttgaccaaattagtaaaattatgtttcagccttattggctttatgacatttaaaagattataggcgttgaagttcaaaaactaatattattaaatattagtaactaacattattccactttaaattttgatttatacaagttaattaaaatacttcctaaaaggacgggttgtcatctaaaattttccttttggtttctgaaccatgcctgcgattctattctggttctcttatattctggtacccttagcattgaaaaaggaaggaggaagaggagagagaagggcaaaaacatcctattctccaggactgaattcctccttctgattagagttattctgttgttattgttgtttttttacagttgttttcgttttggccaccactgacccccaagtgatgctatcttgtgcaactttgcttttattttttgtttaagtttcagatatttttgtgagatattttgtaatactttaatatagaatctgaagtttcttttagcattttcccatttcatttctcattttgtgatacacatctcaatatattccaatttggagatattagtatatgccactgtagaaagattataggtgttgaagttcaaaaacttgacttagaaatatctttttgtggctggacatggtggctcacaactgtaatcacagcacttcaggaggcggaggcaggaggatcacctgcggtcaggagatcgagaccagcctggccaacatatagtgaaaccccgtctttactaaaacgtgcaaaaattagctgggtgcggtggtgcatgcctgtagccccagctacttgggaagctgaggcaggagaataggagaatctcttgaacccacccaggaggcagaggttgcggtgagccaaggttgcgccactctactccaccctgggtgacagagcaagattccatctctaaaaaaaaaaaaaaaaaaaaaaaatatatgttttttcacctactgtttattcttacaccagttacttaacctttctaattctcaggaatttctcttgcagaatgagagtaataatacatgtctcacagagttgctgtgtgcaaccatattttgtaaagcatcttacacatattaacagtcttaaatcttatttagaatcatagtgttacaaatgtatttaactataagtttattaatacatacatcataaaatccttgtctctgttggcatttgttgtgcaaaccacttggaatttatctgtaatataccataggaaaatgaattgaagaaaataaaattttcaaaatggctttcaaatattttattttaattttatatggagattaaaataaatacatgcagatatttttcttaatatttcagattctcttgtaacaacaaataccaaatacaaaaacacagccacatacaggacacatatctcacacacacacacacacggttttcttagacattgactaatttgcaaaaccaaacgcttacttatatgtagcatagcataaagggttcactctgcgtgtgtgtgtgtgtgtgcacgtgtgtatgtgtgtgtgagttttatcacttctcataatcatctgaaatttcctaaatattataagagtagtttttcttcttatatctgattccacatcttaacaaaaacttttacctctaagcatggacagaatgctggttagctacctgccagcaattctttacatctgatctgcaaaaggacacttgtctgggtgttgtgcatgccttggtgtgcactgacaactgagtgttaaaatctctgggggacatccagagcgaccacaagtctgaggccttggattacctgtccacatttgggactgtaactgtgaaaaaagatttctctctcatacatctgccttctctcttctgatttgatgttccctctcccattggtaagatttcagtaaacaacttcaaagactgacataggctgacagcacacggcagatgtgaagggttacttcctttctcttttaggtttcattttttaaaaatttttgaaattatcaattagccttaaggtttagtttgttagaaagggttttgaaaagccactcaaattgccagaaaatgtgaaggatagcaaatcttcaaggtgttagttcaaattagtggttgctaattaaatgcactgttttatcaaatcactctgtacatctcctgtgggtaatttcaactgtagtcctgacaacatttgatgtgttttatatttgcattcactgtttttgatgcttgctttatttcctcttcttctacctctctttccctcactcgttttattctctcctatttaaatactgtgctgttcaattaaatattgattgattgatttactacactcagaattttccaaagaagactgagtcacaaagcaaaaatataatgtctaatgataatgaacataatatcctccaaaggaaccaaagtattagaggaaaatcccaaggggtgaactaaattcatatctatttgtacatttacatttttattttgggttctaccactgaaatttttatcttctttgtggatagtcttaaagtgttgattacaattattctactgaactttttcaaggtgcagttcccctggcatgatgattctaaaacaaatatttactaggaataaatgacattttaagggcttataatcaagagacatatgtagccaatagatagatagatagtaaataatttcaagtcatttttatgttattacatcttctaaatataattttgatttccatgttgatattcctttattccatttgtgcaaagatggaactaaggtataaagaaatgctgttagcatacgtataattacacatacattattgttgaggaaggaattagaaataggagtctggctgtggagttatatgtcatagcaaagatgtaccaactgttttgaaagaaattcttgttctgaatttttagtccttggggaataatagctcctgtgaatccattatttattactgtagatagtacactatctatgaagtttgtggattggagcagatattgtttagatgttttagatgcactgaaaattatattataaaaccttttctgttttattattaattctgaataatataatgtattaactaaaataataatattttcaatactgttatatagaatcctctatttttaaagcattttgagtccataacttctatttgttgagccacagaagaaatttatattttatttttatgggtaaaagaaaagtgttttatatcagttactgcttataactagcatctgaatcttgagaataaccttttctatgtgtttaaagtcataattttattgcttttatccattgtgtattaaatcataataaggtagtcaaagtcaataaatgtttgtggtataaaaactagatgtatattatattattaatgtgggatgtttttctaaaagcaaaatggtacaaactatatcgcttatattttataaaaattttcatttttctttttttacttgaataaaataatttctttatacctaatgaaccatttgagtagtgttatttgtgtttcttgcaatgttgaattgtttcatgtgcatttttatgtttgccaatgattcaagtattgtgaaattatatttgagatggaatttatttggaagactaattaatatgtctttttctaatgtttttcctactgttatactgatctctgatatctcttattcctccctcaaaaatcacatgggaatggagtatagatagttatcagagaaggggttttaaaccagtctaatttctttaaaaaggaggggaacttttataattagttaccaccatttgcctttatttttcatataataggatacttactccatcatctaataagaaataaatcatgattcatagtgagtctctttatgatctttggtccagaccagtccaaggggaatacaagcataaagtctgaatcttctctcatctttttcgcttagattgaggtcactgttggggcagagcagggaactgtgtggttaactgtagtgaagacagcctttgagcccaatgctaagtgttatgttcaaatgttgccaatatttttaaagtctgtaaaaaaaaaaaaaaagatcttcaaaaaatgtggacaatgaaatccttgtctagctcctttttcgctttttcctattaacacataaagtcacaaatgcatgttaccaagtcaaacatactcacacttgtagatacatgttcccagcagggtttcatttgtgcttagtgctgcggtttggtgaaaaaccctctcatgtgtatagttgttttcatttttgagcttgtcacagcatgaaatcagtgtctcactgagagcagggtttttttttttcaataccctgagacttagaggctaagtaatttaaatgtttaaatatgcagaaatacaactcaagtgcagttcgtatattcatatcaatttctgttataaaaggttaaaacaaaatgctgtaatctgtagttgagggtgtttagaaaacctgttctatttgtttccgtgtttttctacaacagcataaatttcttccctaaaaatctacaaatgcatagtgtgccaattaaatgatgtcaaaacagctcaacattaatttttttttcatgaaagctttcttacctgctatacatctaagatatcttaaatagaccaggcttgaatgtggaaatatttaggcattgtcctttatgcaattccaaatctgattttttttttaaagtaagttacccactataccataaacagagtcagaagttagtttctcttgattttcaagtctgtgtgtattcagttccctaaaaagaaagatgaaaccattctcttaaatttatggtgtgtatatttactgactggcatgtgacaggaacactggttagaaagccacagcattatgatgcattgggtcaaatattgttttgacattgtgcttactttacagtaatcaacatattaaactgaggagcatttccttatatatgcaaaatgcaaagtataagggcagcagtttagtagcgttataaggccatagaaggttaaggtttgcttgccttgtggtgcagctgataaaacaattggactgtttccaaaattccttgactccagctttgtcatttatttttctctgtcgttattttttaaggaaaaaaatagacttgtttccatgaaactctgaggtggcaaacctgtacttcacataaaataaaaactttttttgtaagtgaagtgcatatgggactactctggcaagtttagtttgtgtaatttgctaagacttgcttgtataggaggagctaaaataatttccagagagttggaaaaaaagagattttgtcacagccttttggacaagatgttgataaaccaagtgactgataaacccctttaaatgggatattttccatactccaacacatagtatgaaaatttattttcatagttttgaaaatgtttctttttatgtaaacaaaaacactcatattgtaattatgtaatttgagtttgacagacttaagtaatctcctagttttatttaaatgacttttgtattctacctgtttcttttatattgaagtttactttttgagcatttcagtgaatttattggtgttcattggttttctgccttgttttcaaaattgtaataggcatgttgaagaccacagaagaatttctgagttaatttccagttgagcaaatatgacagatatattaaataaatgaatactaccatagagtttaattcttctaacttctactgattttttttcttacagcaaaatatatcagttatatattttgtcacatagctcagttttgtacactgattaaaatatttgagaagccaggcagacattcaaatggacctgtttaataggtagtcaatgacaacctcagaaggtgatgcagccaaataaacagaaaaataaataaaagacaatgtaatggagatggtagtggagagagatatacttaatactgcggtgttttaaatttgagcttttggattattagtgccatatgcaatcagtaagtatgtcataaatcttgtccttcagaattatgagatatcaagaccagctccataatctgggggtatagggtatttttgaaataccttgttcaaaaactaacaactttaagattgtggcagcagatcgttaaatctaagcagagagccctaggagacgatacagattgcatgctcagaaagctggcctgtcaggcatgctaattgagtgaaagtcttcaaagtaagaaatggttttcaattatttgaatcattattccttggcaaaatgctagtaccttttttaagggtcgctgggaaggttgatgaaatatttcatgtaaacgtcttaggcaacagtgagcactttagatagcatttgaccagtgataatcattttcatccttacttatctgttagctttttttttttactatggttttcctcttatttgatgaccatactatcataaattttcctttatttttcccctttatccttctcttctcttctttatgactttaattggttttttctcctttcattgaaaaataaatactggttttataccactctttatttcctataacaaggacagctgtacccagtggtgccactttatagccccaaccatgcctccatgctgagtgtgtcctttcatcagatttccttgacatctgtaaaagatcagtccgggaatgtataattgctaatggtatagtctgtacagtacagaaaatatggctattcattgtggagagtagcctagtcactgaagtttaaatacatcagagtgtcctttaaaaataagaggtaggaatgcattgatagcttggtgtaggaaattttatagtctgaatagattctcaattgattttccgtatagtacacatagatttctattcactttagtggagaatttacaaaaggtatgccttacattatgtcatgaaaaggaaaatattgaaaaaaaggtcaatccatacataaattttgagcagagaaagtatagcttaaatgaaataggtttttctaattattggtaatttgtgtggtgcgtgcataggcatgtgtgtacttcttttgctttacctggaaatagtctatgtatgtaaaagttgaggtataatcaacaaaaacttagcatatctttctacatctgtaccaatgtcagggaactatgatgtctctcacactcctttgaaagagaacattaaaaaaaatcaaaactccctctaagtaatataaaaatctattcattactggttttcagaatcacatggtatatattacattgttactaaaatattttgaatgaaaattatctacaataaatagcttattatttccactgaattacacaaagcagacattgaaacttgtcagaatgtcagacattttttaagatgaaaggaaaactgattacaaatgtgattttaatttgaggactcggagaggtaatccttgaagtcagagttccagtataatttaaaaacatccaaaacttttgatgatgtactctgatagttaaaataattattgagttcctactacatgtatattcatagatagctacagatttagttattaaatttctacatgtacctttctatatattgtacacacaattgaaattaaatatgaattttaaaatggactgcacaaggatggatgacttcctaatctcttcccactgtctcacatgcttcattgagctcctaagaggtttattctattatgcatagtcctggatggtgctttgggtgagatctgtaagatttggtcttttctcatggctgcaattagatcttctcttgctacatcatcctaccaaatacccaaagatatgtcaatattatcctgattagaaggtatggtaacccacaggacctttataaatcaccttttgcctcaccttcctctctatcacttagggtcttaataattattgcctaaagttctgaagtactccctacacacacacacatggcctccaactttatattaaggtgatttaataaagaaactattttttaatgaaaacagatgcattctaagccttttctattaacatgatgattttttaaagactttatgttccttttgctttatgagcagaaatctagaattttataactcttatactttgtttaatggctcaagaagtagctgtcactttttgggaactgggaattagctacagattatatactgctgtcttatctgaaattcatttgcaaaactctagggttgaaactacttgtaattgtaaaagtctgtgagatttgctggttacatagagacattgaaatgattatgtaaatgatcatttaaatcatattactatatcctattctatgactataaaaatttttaagatataatttttatgaacagtattttgtgttttttttaaggtttgaccttttcctttaaatatattcacatgattcggagcagtgtttggaattttcaagatgttggtattcttcaaatgtttcagggaccaaatagttatagagatcactggaaaatgatggtgattttcctcctcaacttattcttagatagaaattgaaagaaaccagttcccctaagggaaaatattttcccttggcttcatgaagaaaacacaaggatatgtgtgtagaagtagttgaatggctggttgacttgagtggcttcatcaaaatggaggcccctgtagagtaatggtatccttagtaggttccaagttacagggatttcttggcatgaaaaccattgtgctctatttgtgtttgaaaggcctccattcattgggctggttgtttacattggcattaatctaattacattccggttgttttgaatttagtttagatatgccataagtgattctactttctataatcatatgcagaaattacaaagtagcagtcaacgaattacttttaaaataagcaaacactggaacaaccaaactcttatgtttttcaggagcaaaatccaaaatgtaaacacacactgaaaagctctttaaaaatcaatgaaagatactgtgcttttccaagccagaattcttggtttcccttgtgattgttaaaacaaaaggaagcaaaactcttgaaatggattcgtttcagcattttcttccccacatctaataagagggaatgttttccagcaagataatgatggggagtcaggcggaaagataggggacttaggaaaagggatagcagcagtgatattagaatgtgaagctggaaactactgctcccaggactaaatagtctaagtgctcccaaatcttgtgtccattaccaacagggagattggcatgtctggtttggaaagcatgtttttaatttgcatttgtctaaaattaaaaagccaacttcttattgggtgcttttctccccctgctgtctctggattatttttctgctgtgagctcgtgctttatctgcatgtgtgggctgtgaaggtagtatatgactgggcacctgtaatcaaagtatggtaaagaacctaaacctagaaacattatgttgtttcctgtataattcaaagtcaaagcagcatcagtaatataattgtaacaacgtccagcaaagttctagcttttctccttgtcaaacatttatttattttcttttaaaatatcaaacaccgttttagattttagaaattagaaaaaaaaagtttggtgactttgctgtcccctacatacatgttgaactctctggtgggtactccagcacctgttggggctgaattaagcattttattggctacttatgtagaaaggaaattatatttgatatattaatatatttagtagttgagagaatagatctcaggaaagctaagtaatttaacagatatcaacagatattgtgaaaacaagaattaaaatccaattttcttacttgttcaattccctggtcctcctctacgtttttcactgctggctagaggactgtcttttgtatcttctctagggcttaaacttggcaaaaatgtgaagtaggtgggattggaggaatgtgttttgttccttcagttctaccctctcacttttcatttcacttgcatcctcacaatttccacacagctctccctttctactttgtctactctcagagccttcttggttcacatattcgcatttacacaaatgatgatttaggtttaacattctattatacccaggggtgtggtcatttttagggacaagcaacaggatttagagggataaatggttcagtagtggaatgttgtcttttgaaaagtgatattttgagaggaatagcccctcattgtctattactcaaatttaatgcatattacaaataatgcttattttgtttgcaagaaggttcattttttttctttcttccttctttttactttctcttttttctttctctctctctcctctccttctttctctttttttcttctttctctgtctctcctattcattctttctttcatcaagtggtacatgtctactgtttgtttctagagatgaaacctaaattatagtcttacattcataattggcagttagtgagtccaccttatttttcatatagacttcttttggtaaaatttcactgcattatcatgatatattaatccatcttgatactatattgtaacttcctctacacctaacaccctttaccttgtctttgaggtccagggacctgtttaaatacctctgttcatttttataatgatacaatctgtaactatcaatacatgtccttggtttaaaaaaaatataaataagatagtaagtttacaactcacctatagctttgttaacctttttttctttaattcttaaaaattatttcaaagtcaaaacggcttcaatttactttccactgtcacgaatttcactctgtgaaatgagaacaactcaaacttcacattgagaagtattttctgatgtttattagttgtgcttgtatagtactgccaattacatttattagccctaaatattaaacagctggcagaattccattgtatataaataagacatttgagacctggacaagtgccatgttgaatacagccagctggtgctttttacagtttttttcgggctactagtactgatgccacagtacattcagtgtttaggtaaatgacaatagaaaaacatgttgtgaattgggaattctataggaaattccattatgtagaaatatagcatttcaaagacttttaaaccaaggaaatgatacgttatgcacctgttgattgaatttgttgaattttgtgttgcctggaatatgtttttaatctttaatttactgtgtgcccattttatattgctgagttatgccatgcaaaatgatgactgcttttatgtttcgtcttctaataaaataaatttttatttcagatttattttaattataaaagtgtattgaacttaatagtagtatacagtttagattctcactttatatgtagaatttactctttcagagtactacagactttaatttttatcctcacgaatatttttatgttcatatcctacctttgttgaattactgtataaaagccctttcttattacatcaaatttgtgtttttgaaaagcaaacatatttataatatgcttaatgtatattaataagtaattaatatttatttatgaatgtatttaatatatgagtctatacattaccgatttattagtattcattaataaattaataaatattaataaataatatacattataaataaatgtatatatctatgcatttaatacatatttatttatatattattcataagtgtataaagctatacatgtattatgtaattaatttatcttatttaatgtgtattaataaataattgacatatatttacaatatacttattgaataagacaaatgctagtaaagtgacttgcactgttgcaaatataaaaaatatgttaatttaaattaaaaaatgaatttgagctgatgaatatcagtgtgattctaaaaatgtccctctgttttaaaagactatatgttcttaaatttaactggtaaatactgtagaaaatatttgttgatttacatgatgtgcgagagtgtgtgtatgtatacaagcatgtgtatgaaaagtttaaattaaacagtagccttgtcaccataaacacttatctgagataattggccatgacatagctttgtaggaacacttcagaggctgcgctgggcttgagaaatgtaatataacaactctcttgacttcagtgaaataaatgtatattatatattaattaacactaaaaatctcttagcaccacaaacctgctttctttgacaattctacatatattttaaagtgtataactggtatctcctaaacagaaacaagtaatctgaaaaaaattcaggattttaatgggcaatatataacaagttactttattccaataatataaaagaaaactagtaggcagaattttgtttttatttattttgtgatttaatgattttcatgatgacaataaatggatacattcttgtttgtaattccccctttaatacccacacataatacttcctcaataaaatgttattgaagaaacaaatagatgaaacacatccagataaaaataagccagctacgatctcgttctatcataggcacgtgaatgacacccatgttgccaaacgctgtggctcagtcgtcaaccgtcaccttgctcatcttgcagaagtatttgggagtgcttactgacttttcttcttttcatcatcgacttttattcagaaacttcttcatttggtgtcagcatactattttcatagttctcttgctttactgggcactttttcttaagctctttcctagattctcccaaaaattcttgatttctaataaatgaaaaattctagaactcattcttcaaactccttctattctctgtacaatcttttcctagccaatatcaccatctacatattgaccgtccttatattatatccttgacttcatcatgctcctaaattccagactcataacaggtgctattacaaacttcacttctaactaatatatccaagatacttctatattctttcaccaaacctgctccttcttcagttaatctttcccatcttaataaatgattttcttcttcacatcattcacacctcttcccatgacaatttatcagagctgtgatccttgaccactgtgtccctctaccctccttcattcttcactatctgttctctttttcctccttaaaagtaggttccatgaaacttgagactgctatttgtttatctaacagcctctatccccagttttgaaaagtgtatggttcatactaggccctcaagaaatacttttgagtgagttaaatataagactatagtaagtgcttctctcatgtgctatctagactagatgcctgtgcctggagtgtaatacctggagttaaatggattccagtttatgtagaaagtttagaaaacatttctgaaaggaataaattttagtctttctcaggagtatgaagaggactaaatgggaaggattgtccttaccttatgaaatgagatgtataccttaaactataattgacattaagtgggattctagtattaaagtccaaaccttcatttcattagtattaatgtccaattcttcaatcctaatataatgttgaaaactatactaagagactgggcacggtggctcacgtctgtaatcccagcactttgggaggccaaggcagggggatcacgaggtcaagagattgagaccatcctggacaatagggtgaaaccccatctctactaaaaatacaaaaattagctgggcacggtggcgcgcacctgtcatcccatctacttgggaggctgaggcaggagaattgcttgaacccaggaggcggaggttgcagtgagcccagattgcgccactgtactgcagcctggtgacagagcaagacttcgtctcaaaacaaaaaacaagaaaactacactaagagacctagctctagtctaagccacttttctcttcttgagaattcctcgtttcctgaacgttactttgagttctgtattgctcccctgacaaattctttttattccaaaacagaacccttgctttcatttgcaatattttttcacattatctattttttaaaactaaattactgtaagtactctattttaaacaactggttactaaggaggcattaattgtgtccattatgatctgcaatttattattagtacgtcttcctttgttcagtagccctgccattttgcattgagatttaatactggaaaacaaattttaaacccagttcagctcatttggaagtataatttcaacatgagatctgagctgaaaacaggtacctcgttcagaaatttaaacctaagacacttcctgtgcaacagtattaaacatcctctatctgtagcagctcaaggttttactatttaaccattttatgactactttacctaaaagctgcacctgcttctttgatttatattatatatcttattgaaatcaggccacactttcctttacttatttttttaacacttactaagagaagctgataaagaaaaatattaacatttctggaccggtctgatgatagtactttaaattatttttcctaactctcttcaaacaaactaactctcttatttttcctaactctcttcaaactcgttgtttgccaggtgagtctatgaaaacaaatgaatcagtcatttcagagaacaatatatctaccaattaactgggtaaccaattaaccaattacctataaacataggctttattttaatattaaacatttaaattttgtataaatattgttacaagatatattctttgttacatatactgtgactaaagaccacagactgggtggtttaaacaaaagaagtatttttctcacaggctggaagtgtgaaatcaacatgttgacacgattgcttcctctgataaccttgaaatacaggtgtaattgcataaagttgtagtttttataaatataacatttgaaaccccaaaataatatattctgtgaatatcttctctttatgtaggccatttacaaaatatggaaacctttgagataccacagttgagaagtatctgtttcaagcctctctttctggcttataaatggctgtcttctcgtgtctcttcacattgtcttccctcaatatatgtctgtgtccaaatttcctcttcttataaggcctccgtagtatcgaattagagctcacaataataacttcattttcatttaattacctctttacagatcttctctccaaatatactcccatcctgagatcctgagggttagaacttcaaagtatgaattttgggggtatatgattcagcccataatatatgtttaaacgtttacccatttcattttattctttttattggaaatattaaaatacaatattcctctttcattggtgtagtaaacattgactgggtgacgcctgccagatattatgctagcttagaagacaaaaatggatgaatacatttgagccacagtgcttattaaaaattaaagtggagtttcttctgacctttaatgcactctccagcttaccagagttcccatgattcctaattgtacccaactagtattatatttttatttttatttttttaattttttttatttttttattttttttgagacggagtctctctgcgtcgcccaggctggagtgctgtggcacgatctcggctcactgcaagctccgcttcctgggttcacaccattctcctgcctcagcctcccgagtagctgggactacaggcgcccgccaccacgcccggctaattttttgtatttttagtagagacggggtttcactgtgttatccaggatggtatacagcctgtgagaaaaatacttcttttgtttaaaccacccagtctgtggtctttagtcacagtatatgtaacaaagaatatatcttgtaacaatatttatacaaaatttaaatgtttaatattaaaataaagcttatgtttataggtaattggttaattggttacccagttaattggtagatatattgttctctgaaatgactgattcatttgttttcatagactcacctggcaaacaacgagtcttgaagagagttaggaaaaataatttaaagtactatcatcagaccggtccagaaatgttaacatttttctttatcagcttctcttagtaaatgttaaaaagataagtaaaggaaagtgtggcctgatttcaataagatatataatataaatcaaagaagcaggtgcagcttttaggtaaagtagtcataaaatggttaaatagtaaaaccttgtctcctttgtctcgccctagtgtgtgacttcgggaccttccttaatcttttggcagctccctgtcttcatcttttgaaaggagatattatttatttttaacttgtaggttggttatgaggactatattaggtttataaatatcaataacttagaaaagtgtctggcccatgaaaaacatgtagtgcgtgattaaggatttggcaaacccagtgaaagaacgtccagatccaagaggagaatcctaggtataatattttgttctagaaaccacactacattatggagtgttcattaacttacattcaacacctacaatactgtgagtgactgctgatattgaaaatgatgtactctgagccttcgtagatccagagttataggagtaaaagtttaattttcttcaaaatagtaaggctaagatttgaagcaggaaactataataataaatataaataaaaggtaaaatatactatatatactacatacactaagaaatattttatgtaccaaaatatattcatatatgtatacacatcaagtagaaataaataaaatgactgtaggatttaggaattagttctccaataaccagaatacacaattgaccaaaatatttgccttctggtatacttataaaaatctctaaaatatagagttaatttggttttcttcaatgtaatcctacttaatttcatggtattgacttggatttcatattttgaatagaggatcctaatacagagaaaactggtatatgttaccattttaggtgtcataaagctctagaagctgaagaattctctggagacatgtaatattaggcaaataaaataaggagccatcctgctcctaattcagagtaagtaactgctttaaaatatactggatttatttagcctcatcagattaggatatagccaaaatcaataaataatcacttgtaaaatttgaggtagaatttagagaaatattttcaaataaatatatttttacacacctattattaatacataaactttgaatgagtttgtaaataatctctgaaatcttttgtacaaagttggaacaaaaatttatctggatagtaaatagaggtataattgcataacgttgtagtttacataaatataatatttgaaaccacaaaatatctgaatatcttctctttatgtaggccatttgcaaaatatgaaatcatttgagatgccacccaaaaaaatggttaatctgtgaataaagacaacaagatctttgtagcttaagtagctggccattgtttttgggtttaaaaatttcttttaagttcaaaatattgctctgataagctacaagtttgtagctgctccccaccaaatgatagcggccttggcattaccatgggaacaattgttacaatttgataatcctatttttcacaattcaatttgtgattagaaagattttcttcatccttgatcattttgatgtagaaaggatttgttaaaagacacaaaattacagttagagaggaggagtaagtgctagtgttttatactgcaggatagctaccgttaacaataaaatattatatagtttcaaataactagaaggaggatattgaacatttccaacagaaagaaatgataaatgtatgaaatcatagatatactcattaccctgatctgttcactgtacattatatattccaaaatgtgactatgtgccctatgaatatatacaattattgtcaattaaaataatattttaaatgatattgaataaactacttttttagaaaaatttaattacacaaaatgatatgagtacacactatttagctttttaagtgtttcccaatatgtttacctgctatgaacatgttatatgaatagtattgaaccatttttctgagctcaaaatttataaatgttccttcatctctaaaatttcatgtccaagtggctatttatggttctaatgtatttcattatttttgcttgtacacacattcacattaggctatgaaacggaatgcactatatattatagaacatttgtaaacatatgataattttcaaagtagaatatttatcacttatgatttatttataatcatttttaggtcaggattaaaatgagatttagtccattcccaaatattcttccagaaatgtaacttttctttaaaaatactaatatttcagaacttgttaaaacatactctttatagtacatggattgatgtgctaacaaaacgatattttaataagataactaggttcatctaaaattatagtaatactatatttctgtatttgtttcaaagttattaatatttgcctgtaactggcaaatctcgtattaagtattagtagagcagagttttatccagactgactttacaattagtcccttctgccttgcagaaacaatgtggtttattggcacttgaacaggtctaagagtaagaagatctggtctaggttggacttttattagctttgacattggatgtgtttctgtctctctctgtagatatcgattaagaaacctgtaaagaaagttctccaatctcctatagaatctattgaatatttttctattcaataataaaattgttaggacaaaatctctgtatctgctttgacttcttctctgctatgctttatgaagtaaatgacgttttgtgaaaacctctgctaacaaaaatacatgtattttttatagtcaatatctgtcttcttgtcagttcactctcctcagaccatactttgctctaaagcatcctctataatacctatacagttattgaaattctcttctctccagcaactctgacattgtttttcccttgttctattctcacctctgcaaatgctccttttccagcagtatataccatgccgaacttgaaaaactttttgatgtgggaacatttcaatatggatgttggaaagagcaatttcgataatacagtatttccacttctctcatcagctcatagttctcttcctaccctgtacacacaagcatttcataatacagtttccgacatttcatttttcttgtatttttttcttttttaaacataagatttctaaaactttaattatatgactccaaaatctgaatttatatgcatgtaatttttttttctgaattctggatatccatttcaacttttgaaaacattctttttctgtgtttcatgttgacattattagattctacccatattaaacttttgctcctcttctttgcataagttctcacacctgttttgctgctctttctgctcataacgttatctccaagtcaccaagacaggttcataaaaaacaggaaagctgtgcaactgaagagttctgggtttgaatctaggctccaccattaacagctaacagatttaggggaagttattgaaccccctcctaagcttcattttgtctcatctatagaattagtagatgatggcacctgcagcacagggttttcaaggataaaatgatgcaatgccagaaaggcccattaccttgaacataaaatggtcaatatgattatccaatgttagcttaaaacctcagagtcattttcaggtttttagttttctcaaaacaaatatcaatcgtttgtcaagtccttgtcctactcctaaaatatttctctcattcaaaaattagttcatttatttgcttattcaatgagtggattatgtggaactgtcctgggtgttgggtatcagtaatgagcaaaatgaacaagtcctcattacctgtcccttagataaccacagtaactctcagatccatctgcctccattcctcatctagcccatcctaaacactcttgccaaagcaatgtacttaaatctaattgttgcttaaatctcacgagtgatgagaaaaacttccattatattccaaaccatctacatggtcattccccactgttctaattttctactattgtctttatagcacccagagtgattctaggaaaaagtaaaacttgtcagtcttctgctcagatcccaggattgggctaaactcttcaacccttccccttcctccttctcccagtcattctctttacctctctcctctgaggacatacaagatactgtctaccttgggattctttactgctgtttcctttgccttgaatgatgtttcctgatgtatccatattcttttattcaaatagttcaccatgaagtcttcctctgacttgtctcatcctttgaggttttatttaagtatcacattttcagtgaagacttcccaggccattcattttgaaatcttcccctcctctcaacatacacaactgtgtcctctctctggcttccgtcattgcttctcctgaaaacataacactatgtaagaaaacacattttaacacttaattttgttttgttgtatatctctcccactggtatggaagctccctgaggagagatttcaagtcatagatttcaagtcatcattttcactgctgtaatagcaccttatagagtcactagtgcataacaggtgtttgataaatatgtgttgagttagtcaatgaaagatcaacttcatctctcactgcagctgcccagtgatgtccaaactcagttggaattttgggggttttatgcctttttccatatcatttcacctgctcggaatgtgctcatcctccttcttcctcctcatctattttcactagtcatagtagtcaaaattatacattttgacatagtagtcaaaattctacttatgtttaaatttcttccctaaatgccacctcctgactgctaattttttcctctggtttttgtactgggagtggcaactttcaatagcataaatcacattcaacacttttctctcatgtcccacatcaaatctataaaatcccgtggctctaccacccaaatggttttggaatctgttattttcttcctatttccaccaatgctatcctatccagactccatcctatgtcacaaaagtattacaataacctcccatcccacttcttagaccgtcactccttgctgtttctcttcagcacagcagcctgtgacctttttatgacatgattcagatcatgtcactcctctattcaaaccctttactaaatttccatttatctaaggataaaatccaaagtctctcttatgacctaaaaggacctaaatgaccttctactcaactacttctctgatgtaatgtttcatgacatcttgatcataatggtagtgccaagaaatggttttgtagaatgtaagggcttcataaacatttgttttatttagcaggtaacaactgtgtaagcacttactatcgatattatctattaagccactaagcaatcctgttagaaaggtgctattattatctccattttaaacatgatatacctgaggcttaacatactgcctggtatgaaataaaaacataaaaaaaaacataaaaacataaaaaaaaaataaaaacataaaaaaacttatttttattaaaatatagaatatatctcttgacgtgttatgcagatagatggcagatatattttacttttaaaaaagataatagtgaaaagaagtgaagtcaagtgtctaataaaattacagaaatatagaacatggtaaagtgtggaatactattggcaaagattttattccagtttagaagggcaaatttatcttagaaaaaagatagcagactcatttctcataaaattgtggctgggcacagtggctcacacctatattcccagcactttgggatgccaagacaggtggatttcttgaggtcaggaattcgagactagcctggccaacatggtgaaaccctctttctaccaaaaattacaaagattagcctggtgtggtggtgtgtgccttagtcccagctactggggaggctgaggggggagaatcgcttgaacctgggagacagaggttgcagtgagccaagatcatgccactgtactccagcctgggtgacagagcaagaccctgtctcaaaaaaataaaaataaaaaaataaatatgcaaagcagccaaatattcagttaccttttgtcaattatatttagtgaatttcaaaagagtaaaacagacttacactggtcataattgttatagcctcaaattagaagaaacagaaactccagcaagtgaaaaggaataataaatagacaaactttgaatttaaaatacatttatattattttataaggaaaacaaactagtatattccggtgacatttttggttaactcagctttgtcagcataataataatgaatgtttatttgctgcttcccaagtggcaaacacagttacaaccattttaaatggacaatctaattttgttcacaatatctctagaaaatgttattattatttttcccattttacagatgtgtaaattaaatcatactctattgaatctcttagttattaagtagtagagctaggtttcaaacacagggtcttttatctctacaggttagacccttaaatctaggctcctcaggatactcaacggataaaagattaaacatgtttctatgaagtattgttgctacccttgtgaagagaacagtagaaggggtctctgtagctttaaaattggtgctataaaacagcttacatttcagagaagtgctctcaaaaattacacttattttgttaaaaagtaaatttagctatctgaagatctgtaaaacttagcatatgttccatagtgacaccagttaatttcatttccgtcaccgggagtgctccgcaggtatattgtaaattgctatgaattactgtggctgtgacccattatcatagcaggaaattgcatgaatctcacaactgatatgaaatatactgctgtcactgttatgcattaatttctaagtagttggtcatttgtaataattctgtaaatgtccatcttagcacagttttcagtctagacaagttaagccaatgtgcatggaattttcctcattatcttcaagcagttatactgaattctaaaattacttttttattggacaatttcaccttgaatatctttccaagaattggaaacatgctagtctcattgtcctactctctaatacttaagggaaatttactctataaaaagtaaagccatttggctatatatgattagaaagacagagtgagaaaatctctgatgaatgtcaacagtgtatttttttctttctaacttgtattgaatatattaatgatttattagattattcttaaatcgtattgactcccactttactgaggtaattttcagataatggtatacttcatcacgatagttttaaaaagaacatttttgcaataagtgtcctttacattataagtaaacatatttcaccatttaaaaaccaaacctttacaatgcaaattatacttttcttctcttttctttgatattgacattattctcctcacaagaaagaaaattcaaatagcacacttcattgaaacttcttgacaatggtgaattatatgttgtctccctatgttatactttatattttagcataacatatatctgtttcgagtcaatgcttctggctagaaattctcttctttggtaaatctttgaatacttttaataatttttgaatttttttatttccaccccaccatatctcaggttttcagatgctttttcctttatcttccaaaactattttcaccctctatttcaaaaatctgaattataaatttactgacacatagtttctagaaatgtataccttcttcttttttcctgtaagtctgtcattggtcttatagttactcagttaaggatactctgacagataactgtctacattactgattttctaaatccaatgcctcatgtagccaaaagcacacttctgtctgtactttgtataattttgacatttggcacattgcatgccatttaattttagtaaattaaaatagggcgcttacttggttttaggcacagggctagatgcttgggaggggaagatgaacaaaaccagagaccatggagggcagcaagactaatgaatagagaaatgagtgagtgtgttttatataaaataacagtagatataactggtagatattatgttctataagaacagctatcctgtctatctgtgttataactgcattatcaatatagagcctgatacacaatattcaataaacaaaaatttgaatgttcttgaaaggagaaatggagtctacattggacattatttcacagagaaaaattaaagatatcaatttatttatatacacgtaccttgtctctttttgttgatgctgcatctttcagcagaaagaagaatcattctgaaatatgttttggtatatccaaaattctaagataagctgagttactatcttcacatgtagatattcactgtgtgcattcataagaaaaaagagcatctctttataatctttttgggaaatgttcagtatataattgttcaacagaagtcatcttaagaagtcttgcctgggtctttgccatggtcttgctaaagctcttctcttttttattctttattgtaccaactcccagtccagagctaaccatgcacctctcttcagtagtttctcactgtagcaaatgaggcagagacacattgcactgcccaaattgttcctggccttacatttctaagtatgccagggccttgaataaggtagttttgtccaatatctttcattgtaacactgatgagaaataaatgtaattcacagccagggacactgtctggagtgttcacatcgtccccatggctgcatgagttttccctgggtactctgtttttctcccatatcccaaagatgtgcccgttaggtgaactggcatgtctaagtgttcccagtctgagtgagtatggtctgtgtgagcgtgcccttcaataccatagcttcctgtccagggctggctcctgccttgtgccctgagctgctgggataggttccagccaccccagccctgaactggaataagcaggtgtattagtctgttttcacgttgctataaaaacactacctaagactgggtgatttaaaaagaaaagaagtttaattggctcatagttctgcaagctgtacaggaagcatggctgaggaggcctcaggaaacttacaatcatggcagaaggcaaaagggaagccagcatatcctacatggctggagcaggaggaagaaagagcaaagagggaaggtttgcacactttcaaacaagcagatctcatgagaactccctcaatatcatgaaaacagaaggggaaaatccacccccatggtccaatcacctcccaccaggtccctcccccaacattggggattaccattcaccgtgagagttaggtggggacacagagccaacggttagaaaaagaatgaatgaatgaatgaataaatgaatacaaattattttaaaataaaaatctgtcatgtgtacaataatcatacaaatacatggcattaaatgaggcagtactaaggcactccacaagccaccatatttgccatggtttttgaactacacagtgggaggaggtgctccttaaagtgtttactttgcaaatgttcattcctagatgtaacccactacccattctgaccactgtctcgcagctattcaccaaaaattgggttaataatcatcttgttttcatgaatttttcttaaatgaatctgtatcttacatttatttccatgtttaatattagaagtgcttcgagtgtttatttagaaatttggtgatgttttcataaccagaaatatgccatgggaagttaactcttgtttatatcaattagcccagggtaaaattggttttgttatacattgtttaaagtcacagtttccaagaatctatcgaggatgttaagtgtgaacttcaagtacttgtccacatatccacagcccgctgccctatattccaatcgtactggaacccagttacttaaacaggttttgtcctcacatttgctaagcctgctgacactttttctccctctctgtgtcctccttaattttcacttacagaagttccaataatctcatattttcatttccgtatccttttccaggaccttccttcacatgataatctttcctttctcaataactccttgcagtacctcaaatacagaacatattgtcatctactgtatgtgttatgcctcctccaccagcatcaatttctgataagaaaaatcacattttgtggccaagcgtggtgtctcacgcttgtaatctcagcactttgggaggccgaggcaggcggatcacttgacgccaggggttagagaccagcctggccaacatggcaaaacaccgtctctactgaaaataaaaaataaataaataaataaataaaaagtagctgggcatggcggtgcatgcctgtaatcccagctactccggtgactgaggcaggagaatcacttgaacccaggacgtggaggttgcagagaaccgagatcaccctgctgcactccaacctggatgactgagcgagactctgtctcaaaaaaaaaaaaaaaaaaaatatatatatatatatatatatatatgaaaaattacattttacttatctttttactatacacaatttctaatttaagctttgcacatataaatatttaatatgtccatgtaaaattgaataaaactgcaattataagggcgttttcaaaaatcacaaatcaccacagaaaatcacagtagaatgctatcaaactacagcaaactataaaaatagtagcatgtctaaaatcaattgtcttcttcataccagtataaatatgtgattgaaagttatttccccacacactgtttgcatgtttttgtaatacacctacctgttttgtcaggtgttctaccaccagatgtgaaatagaacactgtgaggatttacttggtttgttataatatcttatcattccttgtaggaggtagaagatgaggttattcaggtgagcttctgtgtaaggcatgcctaggccctggcaaatctggagtgaaaaaccagatgggataagggctgaacatgagaccatgctacagagacaggggaaggacgacattttagacgcagtttctaaggagactcagaattcacggaagctgatattggagcatcctatcagttcaggtagagtgcagacgttaaaagtccagttggccaagggatatatagcattagttctcagtgttgggggttagaatgttagaatcacctaggtttttttggttttgtttttgttgttgttgttttttttttatctgggaagcagtattttaaaaaagcttcctggttccctgcttagccggaattaaaaaaaaaacaaaacaaaacaaaacaaaaaaaaaattacataaaggaattaaacagacttaaaggtatgagacatttgtccaaaggtgcggtatcattgcaacagacctgagatctcagtacagtaaccctgaatcccagctgggagaaaaataacttaaagctccggctgggcgcggtggctcaagcctgtaaacctagcactttgggaggccgaggcgggcagatcacgcggtcaggagatcgagaccatcctggctagcacggtgaaaccccgtctctactaaaaaaaaatacaaaaaatcagccgggcgcagtggcgggcgcctgcagtcccagctactcgggaggctgaggcaggagaatggcgtgaacctgggaggcgcagcttgcagtgagccgagatcgcgccactgcactccagcctgggcaacagagcgagactctgtctcaaaaaaataaataaataaaataaaataaaaatattaagaaaaaaaccttaaagctcctagaagagtggagctgaggctacttcaggtcttctctcagtctaggggtattaaggaactagaagacagagaagaaaaacacagacatctatgagcccagctgcgaggttgctgggtaaagcggagacagaagggacaacatactcaaactttctggagacattgtgcctttaatagcctgtatcttgttaaaaccacagaaagtactgaggtatgcccaatattggtgagaattctaagcagggatcttacatgattctgttcctagctcttctcactctctaaaatactttgttggctttcctcataataattctgattcttttacatttgtctttgtttcccagatcttttcagtatactgtgccaaactgtggatattggcttttctatattccataaggcaattctaataccattaccaaatttctgctgaaaacttaggggctaaaggtggttgggtatgaatagtagccattataattaagataactgtccacatcttcccacatatgcccttttcggtcatatttgtcttcggatcctgtcccacatcttgttaatcatagggattttccaacatcaaatctccatcttctgtcttcctgactcctcggccacaaatgtaattctctgatttgacacaccacacacacacacacacacacacacaccccaaacaaaaaaacaattctattcctcatttgtctcaactatttgacattactctgatctttttataatatacctttagaaatatatatctgtgtgtaaatgtgtgtgtgtgtgtgtgtgtgtgtgtgtacttttgagaccagaatgggctaaggaaaactacttatgaataaatagaaatataatgatttttgtagatatatttgtgcgtgacacttgacagtgacagccttgctgtaagagattctgcatgcatgcttaaaatgctgctgcctggtaaatgcccaaatacttccaggacgaagactggattttgaaatggctatgagtgtacaaggggaaataaacataagaataaaaaacgtgagtggagaaaggaataacatgaaccgacttaatatcacttaaaattactgggtgcaagattaatcatcatcagcattttgtaaagcgcagaaattggtgtttcttataaaccattgaaatgcaaaaataatgtaaatgtaacaatattgctgatgcatttcccttatattgtcatccacaaatttcttagaaactggttttaagtcttaaaaggtaaatcatgactatcttgcaatcttaatattttccaaattatattagcttgtgcactaaatttattgcagcttctgtttctcttaaaggaagtgtaaacttcctcctcaccttactaccccttgttagcaaataaataaaaatgttttctatgaaagtaattaatatcaacaataaatataaattcttaattaccataatgatgatatactagcataatagttattaggtaaatgccagttaattattaaaatatatgtttccctcaaaaatatatgtttgattcagtgacaaggaactgtgctatctagaaaatataaactaagagcctccttagtatcttatactacctttgatgatggagaggtttggtgtggttattttcagaatggactgtccagtgggagaaagtttggatgcataggtttcttatacttgaaatgatccagagaaagatgaaaatacaaggaaccctatgtggtctaataattaaagcttaaagtcaaaatctggaagctaggctaaatatcagaattgtttattttaatgagttagaggttgaaaaagtattttgagctcctcttttgtttgtatccccttctgctgaagctgttactggtggataccaatcacagagatttcttgaaagcattaagaaaatgaagagaaagatgcttttcaccaccaaattctatgttaccattgctatgtctcccttttttttttcatctctgccttgagacaatttctttagcaggatagaatctctgataaaatataatgataatatataatgaatattatacattagttcttacagtagaaaaatgaatgaaacatgggcattctttacatttacaaagcatgagcattataacagcagctttaattaatgattttttcttgttgctgctgctatgagaaaatattcatttaagaattttatttctactgtctttagtcctcagcaaatgctagagttagagacttgttgttttcgcaagtggtctgagatggcacatcaccatcccttacaagcaatttggccttcattacaaattaatgaagtgataattgctccttgcaaccttttatgtgcaaagaatgctggttctgtttgcattatcttcttgcaatgtacacctctgttttcaaggacttgtggtatcttgccaaatgttaaactacactgagatctccataattaaaatcatattttacatcaagttatgaaaacctctacacaatatgttctgtttgatgtccagtaaaatgctgttcattgcagaataaatttgcaaatgattcatcaaagtaacaatctcatttattactaaaaggaaatcttgacttaagaaatttaaagtcaattggtttacattcaaataatattgtcatgatcgaactttctataagatggttatggaaagcatttgttctctagagtttttgctacatctgtactttaaaatgccattgtagaaccaaggtaatgttactagagaagactctataaaacactaacttttaacaccagagatttttggagcaccaagtctgttgactgtttttttatattcaacatatacattcattttgctttgaatgtgactgtattattataggcacctcaatgtaaaaccctaagaactgagacgctcagttgctcttatcttcttaaaaactcagtatattacatacatatagagtggatgcatgaaaattgtatattggcaattattacaaatataatgtgaatattttctttccttaaactgaggttagaatgtatcttgtatattacttctgagatcttctaaaatagtctcaacttgtttcgttgttgaatctcggatgtgacaatgaagctaggtcaattttgcctccagaaaatgagtgcctatcttgtattttagatcctgaacgatcaaggtttttaaaataaatagtgctgttaacttgttttgtttgtaagttaataggtgagctatgaagaactagaagtttttaaactgtgattgtcacaacagtaaagttcacaaattgttttttataatttaagaatttagtataaaaaaatttcccctaatgaggcttaaaggccaaataaatgtcatgttcctttgtttgtaattaccgacaatttaataaattaatattttattttattttgtgattagaaggtgtgaattaaaatttctgtgtctttaaagatggcaacaataaaaactagggactgctgaaggagaaaaggagggaggcaacaagaattgaaaaactaactgttgtgtactatgctcacaacctgggtgagaggatcaatcatactcaaaacttgacctcatgcgatggaccaatgtagcaaacctgtacatggcccaaactgggaaaatattcgtacagatgaattttaggcagtagtattttttattctttttttaaacaaacaaacaaagcaaaaaacacacaagaaaatcataacatagtgtcaatagaaatagaaaaaactgttaatgcattttatatgctgttgatttagttaaaagtgtttaatgtctattgttcttgatgaaaattattaatgctttattggagaaaaatgtaggaacacatttataatgggcttcacaagggttttattcataaatttaactacaatatttaaatatatttaaatattttctctaagaaaaacgttttgttgtattcccatgaataactcttacttataagaaaaataatatttgtgcatatgccaaaaggtgaagttttgtgctccatactacagtgaatatgaagagacctgcctaaaatttagcaaatgcctatgaaacaaaattaaactaactttagcatgtatcatgaattaaatttacaaatgaataggggattcaataagggttctataatacagaaattttcttaagattgtcagggttatggaaggcataaggcagaagaatgcacagtcccatggggttataccgtaagaaaggcatattccagatgggcacagtggctcatgcctataatcccagcactttgggaggccagggcaggtggatcacgaggccaggagttcaagatcactggccaacatggagaaaccccatctctactaaaaatatcaaaattagccagttgtggtgttgggggcctataatcccagctattcaggaggctgaggcaggagaattgctttaacccaggaggtgaagattgcagtgagctgagatcgtgccattgcactctagcctgggcgacaggagcaagactctgtgaaaaaaaaaaaaaaagaaaagaaagaaagaaaaggaaggaaggaaggaaggaaggaagaaagaaagaaagaaagaaagaaagaaagaaagaaagaaagaaagaaagaaagaaagagaaaaagaaaggagggagggagggaagaaaggaaggaagggaaagaaagaaagaaaaaaagaaagagaaagaaagaaagataaaaagaaagagaaagaaagaaagaaagggaaggaaggaaggaaagaaggaaggaaggaagggaagattccacaagttccacaagaaaagaataaaggacagaatatccaccacatctttcgtaaacaataaaagagtttacattgacaataatataatatgtggaaatattacttatctcgattcaaacacttagaaaaattaacatgtggtttaggaccagttttaagaggaacacaaatgtgaaattcaagagttagaaagtttttgcgtaagtaacagagatccctagaaaactttacattcaagaatggcatgacaaaagatgtagtttcctgcaagaagtaagcaaaatggggcataagaggaaagtatggacacagagataacagaaacaactggtctaatagttttaggatcataagtaacacacacttacgatgctaagttaaaagcttctcaaaatttgtcctaaggatcacagaaaatagtgcttcactgttctcaaaagtctgaatgcttttaaaggtttttacagtgataaaagttgttctaagataaccttaactgctataacaacaaaaccccaaatatctatctatttcttgactaagaaaagatccaatgtgggtgcaaaaggctttaagaatcgaatgtttgccatgtcttctgtttttcacacataacttggttttatatttggcgggaagctgtggggtgaggaacatttctatttttacttcaaatttttttttcatagttctgcaacacatgtccattgaaatgacagtacattaaaaaatgtcatgcatgatgatacatagtaaaaatatcatttatattcactttattttaccttatatcaattttaccaaaaacctggcacaaattgggaaaagattaataagcatgaattttaggcagtattattaattttttcttttttaaactgagaaaaacacccaaaaacatatgagaaaataatattatagtgtcattggagacaactgatttgaggttttgatcctggaatgtttgattaggctctattaactgctaagtgtctttttcctgaatattcaacaaactgtaacgcaattgaaatgtgttcatcaaaattataaattactttatgtccattaactcagagaaccttgcaaataaaaactacaaacaagaatgtttttaatgagtaaatgatgatttattatatagagatggctctgacacccttatgttgtattcgttattatcattaattctgcctcactctctgtttctctttgattcttcagtgggaagagatcagtggtgtggatgaacattacacacccatcaggacttaccaggtgtgcaatgtcatggaccacagtcaaaacaattggctgagaacaaactgggtccccaggaactcagctcagaagatttatgtggagctcaagttcactctacgagactgcaatagcattccattggttttaggaacttgcaaggagacattcaacctgtactacatggagtctgatgatgatcatggggtgaaatttcgagagcatcagtttacaaagattgacaccattgcagctgatgaaagtttcactcaaatggatcttggggaccgtattctgaagctcaacactgagattagagaagtaggtcctgtcaacaagaagggattttatttggcatttcaagatgttggtgcttgtgttgccttggtgtctgtgagagtatacttcaaaaagtgcccatttacagtgaagaatctggctatgtttccagacacggtacccatggactcccagtccctggtggaggttagagggtcttgtgtcaacaattctaaggaggaagatcctccaaggatgtactgcagtacagaaggcgaatggcttgtacccattggcaagtgttcctgcaatgctggctatgaagaaagaggttttatgtgccaaggtaagagccttctctatttttctttgagcaatatttctcacctatgagtttatcatagtgtcattaaatgaaatgcactcagtctcaactcacttggcaggaaaacatgcctcaaactgaccatagtctatttatggactaaaattaattccatttgatgtggtaattcatgctttgctgtagaaatattaatgtatttgattatacagtgctggcctgcaccctgtaataggtgttatacatgctatatttaagtttttctgctgtttaataactaaggtaatctaattctagaccacctggaagaaaaacattctatctcttttatgtagaaagttgagaaatctttagcactcagctaacctaattctaacagaattagatactgtggtggttatttatgctggtgctcatctatctcatagcaatatttacttcattgctataaagtacagtcttttcttcactgacatctgggtatcaaatacatgtttacttacaagagattagtgcttttagaagattatttgatttaaaaatccagagctgatgcttcagtgtttaatgtatacaggcatgatttttaagtgtcttttgcaccatgatttggctcgttttagtgctcaaaaattatttgtatcatccgttaggcttgaatgcatatttgatattaatataatatcacagaactagaactctttaatcaaattaatatttattaaaatcgctttatattttaagtggaatcaattaaaatatcattttatataaaattatgtatatcagctgtgctatatcatatcataatttcacttaatcccaaaatttacttagcattaggcaaggttttatgcttaagaacacactaaaattgttactcaaattttaaataaataaatatataggagaagttaagtatattgtccttgaaattttgtccattttaatgcccttgcttgctgttacactctgtcaagtctggtgttctactcctgatcgcataatcagtcacttttctcaaatgcaagtggaataaatgagactactttgcatataaattgtcctctttaaatctggacagaacataatattttgcttttgactgtagacatggttcacagaataaattcctcttcctcttcctcttcctcctcctcctcctctctctcctccccctccccctcttcctcttcctcttcttctttttcttcttcttcttctccttcttcttcttcttcttcttcttcttcttcttcttcttcttcttcttcttcttcttcttcttcttcttcttcttctccttctcctcctcctcctctttcttttggctaggtaggataggaaaaaagaaagctaagaatagtaaatggtaaatttttctctttcaatgactgtttagagagagaaaataaaggagggtagaaagaaatattggcgactaaagaacgatttaagaatcgcatgccaaacaaactccaagaagcaccaggaaggtaaagagtacttattacaataaatttggtgaaatagaaatgcatataaaaataactatgcaagcttaaactgataaggagtggtataaaaattagtaaggaaggtaagaaaatatgtgtcataccgtttactaggaatttatctaatatattttaaaatatgacttttatttaaatacattatctctcatatttgatgaaagagaaggatactgtaatatattttctttaatttaccatgtatataacttaaaatttatttggaccatgtttctgggatctgggcagacttgctggattttgacagcatggtcaaatggcaggtggggttgtttttttggggaggatgttcataaacctccttttaaaagggtaacactgaaaaattaaaattataaagtgacatactaaaactgagtcatctggcattcactttcaagcattgacaatattttacttgattttttcatttggatatttcatattttttagatcccagcataactcttcttactggttttctctttttaagattggaagtgtgggaaaattttgtattaataccaaggaaacatcatgattttttttttttgttctttttaatccagcctaatgaattatgttatctgttttggtttagtttggaggggagagatgaggacgctaatggctttttatatagtcagttaattacatttgagccagatagcagaaggttactataaatattccttctcatataaactttgtttagacttagtgtaccaaataccttattaatgtcactgaagaatttgttgctctgtgctttatctctgcacattcattgtggaatgctaactttattccttcttcttttacattagcagctaaatagaaaagtgtgtttgatgtgatgtatgaagacacctagactttttgatgactatccaaaattatatttgttttacttctgacttaggataccagttcttactctccactcatttctctgttaattcagaaactcttaaaacagctgccaaagtttcaataacaggataattttaagactctgcttgctctgacagaggcgctagagaaaattgaaaaccttagtatattcttcacacctactaagtctgtgtgcacaatcagaaggcaccctctggaactgcaaggtgctcatgagtgtgaatgaactcagaagcattcctttctagttgttttttgcctggaagttccttaaggggagacaccagaaatgtcttttcttagaaacatcttgcttagaacatagcagaatctaattgagtaggttctcaagtagatacctataggatgtgtaattactgtgagatttctatatttctataccaactatccattcttagaatagaggtcctgaagagaatagactttacattatttatctttgattccactacgcctttcagaatgcattgcaaataaagatgttaattttatctaatttgaaataaacatatttgattattaggtcacatacagttgcagccaggcaataatagattcatctgacttctcgttagaataacgaatagatgatgaagtaaaggaataacaaatatttttacggtaccaaagatcatacttttttcttttatgaatttatgatgcatattatctttctgctttaaaataatcaattgtttctagattaatacctgtaataaagcaaccgtctaaacaatttttgtagatgctgaaataaatgtggcatttttgtcccttaaatttactgatctagtgcttaaagcattggctcacctcgtaaagactaccctataattatcgagattcttaccttcggttatgaaaaatttcctttctctgaggttaaaatgacagctgtctatttcctctttgcctttagcagttatacatccattgtttttccaaccaatgaatttatttaaataaaaagtatggcactgataagtaataagataaataactttaatataacaaattaaacagatacattatagctttataatagctatcaagcctctgatttatacaagattctatgtcttctcatcaatttatgtacatgagcctaatgccaaaaaaatttctgcacttgtcttcaaattacagtttgcatttaattgttctatttagccaaaagctcttgtcactaacaagtgtttgagggcttgggcttaggagtcctaggaatgcagcttattaattttgtggctaaacattttgagccttagtttcttcatccacaaaagggatgggcttcaaaatggccagtggatgtattgcttagtccactgcacaatatacagcactagacacaaggtatttgaacgtcattattttcagtcatcagaatccctgaaatgtgttaccttccttgttttcttgtttcaatacattttagaacatttagatatgatgaaatcacccattcaacagcttaccttagaccttagacatattttaagagataaaacatgtatttaatgaatgtatatatttgtgtattcattatttattcattgattgcccaccttcttccaaacaaggatccaaaaggattgtgcttttctaaagagacattttttttgttcaattaaacctctagtctattaaaccatgggtgatatttcctccattatcttattgttaagtgttatttttcttccaaacagcagtcacgcttgatttttcccatctggtattggactcagtctcttttttttcatagtatgaatcttcccactgatttttccaaagtgccttgagtttataaatgcacatttttatattgtatattcagaaagacttttaggttttaactggtttgatttaagaaagcatgatttaggaaataagcaaacaactgcaatgcaaaaataaaattaaaatgctacatctcaaaaatgttaagcctaggttttgttcatattgtgtttgtgtcctaacattccttctataaaagacgagtttagttagttggaaaggatataccaataaataatgcccttgccttgaaagaatcatgtgaatcaaaaataagtaagcaactaagaaaaagaaaaatatatctgttgaaacatttcacctgactctggatagagctaacttatctatttactttgctttaggtagttattatgtatacttaagaatggcccaaatactataaaggcagtggagaagcagtataagttgtttgaagtatatgtcaaatgtgcttacacgaattattattatgtgatattactggaaatctgtgatcaaattatgtgagtgcactatctaaaaagtagttaaagtaaaaacttattttttaatatgaaaagtgagagaaagcaagggaatatatttggtttgtgacttcttaaatattgtagctcatttttgagtctctataaaaacaatataaatttaaaccatggatttgcaagtttaggaaaatagaaatgtgaattctttgttctgtatatactgcaaatcagattattttgaacactcagacacaatgtaattgcaaacatgtttaggagaaatatgtctgtggttaaatttagggagtagagcaaattcatatctaagcatttgaatacctcgtaatgaataagttaaatgatcagcaatgaaccactataacaggccttaaaaatcacaagaagttccataaatgttagtaacattcttacgcaggattacaattaaataagacttacagtgttttagtaaaatatgaactgttttaccttatgtgggttaactttagtaatataatctcaccaattctgttcagagggaaaaaatcttaaaacacattttctctttaaataggcatttcactctacttaatcccaacctaaaagatgattttataggtcattattaaagtatacttctaaagctctaatttaactcacaggcattccttatcaaatggctgtggggtatctgctttatagtatcaagttcttttcattaaattattattcttacactaagttctttgggcttttagatgctttgactggtctagtgtttcaaatgtgcaaatagtaatttaggtaatatctatatgccaagtgtataatctttgggaaacataaataatgtgtccattaagcagtttatttgtttgagagactatggtaatgtatgggttaatcttcccaggacagtattcactatgagcatctgaggcatcagaaaataattttggttgcagaaaaaaagtagctctcattttacttgaaaggggttgtttccatcatttcattttcagttttctgtccaaaggaagatagaacattgctttgtagacaactcactaaatatctattaaatgtaaacttacctgtaaagtgattgaaattgtccaagaaaaagacatatctaaacttcttttttctgtgaagggtgggatattggttattgtgaatatgtaaaaattatagttctcctatcatcttaatgaatattatcttgtcagctagctcgtgaatctgccatcataatttactgtcaaggctggttggaccctaaagaaagtcttgaaattccttttctttaacttaaggtgttttatatggatgaccttccttagctctgatttgctgcgtgccactttgttaaacaacttctgttaaagcatacatgttatataatttatggcttttgtaaagaacattcatcttcacttcaaacttatcctttttactctaactattcagatactataaaagcttctgtgttttcaactttcaagatgcaatgtaaccatgtttttcagaatacatgtaatgattccagagaatgattattgatatttcattaacttttccagctaatgtttcattttctttagtcaacttcttccagcgtaaggagaataaaaccctatgcaaaataaactgagaactagatctttttttccctcctgatggacttagattctgtgaaatatactggtaatagtttcacaaagattgctttgtcaatgcagattcattgaacactttccacctttttttcctgtgatttctccacccctttcacttctgtctgtgtttagagttttgacaatcccttattagttccagagtagaacttatgagagctaataagggtttacattacagctctgacagctggcactaaagtttaatagagagcaattgtaaagaagtataagtgttgataatatttgatgaaagtgctcttaaagaaagagccttttggaaataatcacataactagaaaagctgcatatatgctctttttttgtagcttctcatcttccagtatgcggacaaaacatcctgttggcagatgactctgtaattgcttatggatgccttttctaggaacagaatccagggtcgttaaaaaaacaaaaacaaaaacaaaaaaaaactctaaactttggtcatattcttaccgctatttctataaatctctgaaattcatgttaactgtcctttagaaacacaatcataacgtggacatctaatcgcagattcattctgtgagaagagaccccagggattccaaaggcgagtcattgagatcatgaaacccataaaccccacataatccaccacagactttttgtattattaaaaataaacaaataaaaagcaagaatggcttcaaatatagaaagaccctgagtgtaaaatatttctgaattctctattcaatggtcagttgcaatgccacaaaaggttaaaagaaaatgctgcaattgaaaacagctgtggcttttttaacatgaagactaactttcaacaaagagaaagtatatgctatgagatgaaggaatacctgaatttattgtgcaccaggaacatgtaaagttttatgaaactgagaagtgaatctgaatatataaataattggtaaggaacatttttgcttctctgatagttactggagaggaaaatttgtatttcagagatttagattcatttactgtttatctcatacttctacattgaatataaaatatttcaatccatctatcatcatgcataaatgttttatggcatacagaattgattcatgtattgaattggggggaaggaggatatagttctggctgtaaagcatcttggattttattattattattattattattatgctttaagttttagggtacatgtgcacaacgtgcaggtttgttacatatgtacacatgtgccatgttggtgtgctgcacccattatctcctcatttggcattaggtatatctcctaatgctatccctcccccctccccccaccccacaacagtccctggtgtgtgatgttccccttcctgtgtccatgtgttctcgttgttcaattcccacctatgagtgagaacatgtttggttttcttgtccttgcgatagtttgctgagaatgatggtttccagcttcatccatgtccttacaaaggacctgaactcaccattttttatggctgcatagtattccatggtgtatatgtgccacattttcttaatccagtctatcattgttggacatttgggttggttccaagtctttgctattgtgaatagtgccacaataaacatacgtttgcatgtgtctttatagcagcatgatttataatcctttgggtatataaccagtaacgggattgctgggtcaaatggtatttctagttctagaagaagacatttatgcagccaaaaaaatatgaaaaaatgctcatcatcattggccatcagagaaatgcaaatcaaaactgcaatgagataccatctctcaccagttagaatagcaatcattaaaaagtcaggaaacaacaggtgctggagaggatgtggagaaataggaacacttttacactgttggtgggactgtaaactagttcaaccattgtggaagtcggtgtggcgattcctcagggatctagaactagaagcatcttggattctaaaggagatatgaactgaatctatcttaaaaggaggcaagtatcctattcataaggaaaaacatggtctggtaagcatgaaagacaaatgttgtttagagactcataatctgcttctaaagtgtcatcaaagagttaaagagttaaggtttcaatctccatggagtttaatatttcatcatttacccattttttcacaacaacatttttttttttttcgagatggagttttgctcttgttgcccaggttaaagtgcagtggcaggatctcggctcaccgcaacctccacctcccaggttcaagtgattctcctgcctcagcctcctgagtagctgggattacaggcatgtgccaccctgctcagataattttgtgtttttagtagagatggggtttctccatgttggtcaggctggtctcaaactctccacctcaggtgatctgcctgccttggcctcccaaagtgctgggattacaggcatgagcctccgtgccctgccccccacaacaatttatgagtgtctgctataccaaatgtcaactggaaatgtggcactaaacaaaacagaaaaatgttcctgccctcaaggaacttagatttgagtggaaatattaagaaaccacatgttaatacagatcattccagggtattacctatagaattctggagtctacaccagtgttcctagcccaggtgatgttacctccaagaggcatttggcaatgttttttttttttttgttttttgttttttttttttttttgagacggagtctcgctctgtcgcccaggctggagtgcagtggcgggatctcggctcactgcaagctccacctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgggcaatgtttaaaaatatttttggttctcacagctgaagaaaggggttgcttactggcacctcctgtttagatgccacacatgttgctaaatatcctacaatgcacagggcaatgtttatagcaaagagttatgcagaccaacatataaatatgtagtggaagggttgagaaactctggtctagtttaatcattgtcctttacagatatgtctattaaggctaaaggttcgaattatacattagcagagctcgaattggtacttgacatcttgtgattgtgcttcaggacacattcgttcaggaattttctttaaaattagtgaatttttgaaggcatataaagtcttactaactacttagattattggaaagtgacacctctgcaagaaaaacaaaactaagatggatttttttctgggagaaagaagaaagatttcaggaatagtgacatgaagatggatattttaaaactgaaaaacaaaaagttacctgcaaagagctggttaaggtgactgacgttcagcgggtagagtttcgtagtctaagaactcagaatgcgaatggagtaataaaagagatatcaaatataaagcatttggaggttgagggtgtttccgtatggaaacagttcagacagctgttacagagttagtttcctttgaggatattctgacgtgctgacatgaaatcaaatctaacatttgactcccttttttctgtaatgtgatactaatacaaaaaatgacaggtagatgtggttctattccaggacatattgtgttaatagtctttgtataaaaagtttctatgctttagttttagtactggtcctttgacaattagagtggctcttcgatatcagctgtttcttttaaaaatagccatttctttcctttagcatgtgactgagcttggcacttcatttaatcctctcaacaacatatgagcttggtggaatcatgtctccattttgcgtgatagaaaactggaggcttagaaaaatcaggcaattgtccaaggtcacaattagtaagtggttcaactggaatttgaatggtaaaactggaatttgaaagtggaacagatcgcttgtgtgggaccactgtttcctatgcttcctggcagagagaggctgaggtacctgaagctcatcagcctgctttaccagaaatagtccctgaagcgcagagtatgtttactgtaaggatgcttctcaggatgttattcaatacttttcattgtgtcctctctctgggaccaatcacggacatttacttctgactccaagggtgggagtgattgtgttccttaagctattcacttgtttttgctttttggatattgattcacgtaatggtcatcgtatcttgtttgcattccctatagaagagcagaaaattacgtgtcttcctgtatctgaaaaacatacatagatacgctctcttaacatgccttctaaatagtaaactcactgttttatttattctctttatgtaccctttttggtctactcttcaccttctaaaatgtattttattgtaatctattccatcttgaattgtgggaatgctttctcaaatacgaaaagccatacatacatttaaattactatttattgattgcctactatgtacccagtgaggaatataccatttgatcctcaccaaagccttacgaggtaaatcttattatcgttattttatcagaacaggtctaagaaaatttactaatttgaccagtgtcacaatgccagaatgtaaattcaggtctggctgactctgaaacctgatgcttttcataatataatatgtcaataattttcatctgaaatgcttctgcaagtcaccataatgagaaaatttgcaagttcctgctgccaaggggatggttggagaaattggttataagagttgagaaaaaaaagattggcaatggtggtataaaaaggcaaaaacctcatattaattagcataacatctctttctttaacataggattaggtaagcctctaacacgcaaatcttttcacagggcatctctggcctttattttctaggcatgtggaactgagccacacctctaattgcttctgcttctgtttccattgctcctgctgttgctgaggacatgattgataggagatgatggctagtggagaaccagggctcagaaagacacttgctatgtgcccaatgtgtatgcttgcacaatatgcttcattattagcttgacagatctccaagtggcagattgggaatgaattttggacctggctagcatttctgttacagacattgggtttttaaaaagctcataaatacatatacatatatatatatatatatatatatatatgtatatgtatatgtatatacctatgtatacacacacatatatacatatatgtacacacacatgcatgtaaatatatatagatgtacatgcatacttgtgtgtgtatatgtatatagacataaaatgcaaaataatatatgtattatataaatatatataaatatatgtatgtatagatgtatagatatgtgcatgtctatacatgtccatacacatatatgcacttagcactatatacttagtacatatacatttttagtaaatgtgtacttataagtgtactttaaattctttgtttctaaaaaattgagaagggtgaaggctgtaataaaatatcacatcaatttctggtggtattggactgctgcacacattcctacatttcttttactgcttttagaatgaggcagcacacaaaatacgttaataaatataatatgtataacttccaaaacttgaagtggtaacacatactgatgaagctttacacttcattaagtaaatgaatgtgacttaaagttgcagacttcttaagtatctgacctggttgttctatacaaggatcatgtgtggaactaattttctttgaaaatgttattggtgttatagattacaaacttttgtgttgctgttaaatatttcttagtcttttaacctttacaaaatctaaaagcttatttaaagcaaccctttcattaacataatacaactctttaaaaacactgatagtcaagaacagaagtaattaccaggggctttcattgtttatacttgttatactttcatgacaacatgtatgctgctttaaaatctattttttctcctttttaaaaaactcctcttacgatcattcccagtaaatcaaaatctctgcaagatgatgggtggcatcatggtgttctatgagtgcttcagtgcggaactattaggaaagggaggctgaaaggaaatgctgactccatccttcatacggttgatggttgctcttattagagatgaaaagaaaatgagaaaatgcattggcttgctttttattaagcacagtaggtaaaacagatgaatgcttgaaggctcattgagctgccataaagaaatttaaacattgttcatattggctagtcgccaggctcatgctgtaaactccagatgagggtcatgattgcagaggaatcgtcagctctattggtagacagtttctgtacgttcctagactagtaataaacctgagatttacccagcagggttggtgggattatgtttgttgtacatgacttggtatccatcttaattcctacaaaataattaagatttcttagcataaaatgatggcgtgacttgactttatacatttggattttgtttgtatcattgtattataataccttatatgtgtgaataaatttagcttcctcatatgtagatctagaataatatctaagagtaagagtggagagaaaatcgtataataaagtactaaaatatggttagtaaatatggttctaaaatatagtaacgaattttttaagttaaaaaataaagctttgttatcattataatttgtaatctttctaagattaacagtgtgctttccacttctttttaaattctttcaatgcctggttcaaaatctgaacacagcttttgtgtgaataatgatgattattttatcgatcaatatttttgcttctttattaataaatgtactataacaatatctaacaaaaaatgtgaagcaataagaaaaggtggataactttcttgaacataggcacacatgggagatgtaaacctggacatttgttacactctcatttgtagtttatttcagagatttatagcatctctcctatctacacaaataatttaccatgaaatttattcaaaattaagcttcataaaatagagacataatccaaatatttggctgagtgatcatgcggttgactaaatctttaaatattgaggttgccagggcaaatgagttgggatagttaatttacaataaaatgataaaagaaattctgctgtattaggtaacaccaaatttgccttgtatcagtttaccttttttcaccttcattttatttttagaaagttacaaaagaaagtaataagaaggtaactgtttttatttctgaagaaggaagatggttagaaacagccattaatttctattaaaggtagagatactcttataaagcatacactttttggtcagacacggtggctcatacctgtaatctcagcactttgggaggccaaggcaggcacatcacttgaggtcaggagttcgggactagcctggcaatcatggtgaaacactatctctactaaaaatacaaaaattagctgggagtggtgtcatgcatctgtaatcccagctactcgggaggctgaggcaggaaaattgcttgaatcctggaggcggaggttgcagtgagacaagatcatgtcgctgcactccagcctggtcaacagagcaagactctgtctcaaaataataataataataatgataataaataataataaaaaaataaaaagcatacactttctaaatactctttgatgctgaaaaatatagacgggaaaggttaaagagtggctgtgattagtgagattagctttccagtttaaataaaaatttagcaatcaaattcagttaaaaagaaatggattactttaaggatgtaaaaatgtgaaagttatttggaaattatcaagttatttacaagtgaaattatccatcttggaatagctatgttaagatctaaagacgtgaaggtagtaatttgtaatcacattttatttgctattatttattcactggtcagtcatggctatgattatgtgctactgcttcgatgcctgtaatgatcagaaaaaaaatgcctttataatccagtggattctatgactggaaaagtcagtgaaaatattctatgaatcctcggaaaatactctttacttactccaaaagattttggtgtgttcgaaacaattttctaaaattacactagatacgaaagtaaaccttgtggaacctttacattttcaaccaactgtaccatgttatacatctcagcctgttgcatattgctacatttctcttagcttaatagctattgtgttctctaagatggtgccagtttataaagtttggtcatagtagcctaatgtattttcaaagaaagttgcattttttccccaaataattttacagaaaacgtctttggtaaaattgctaagtgaggaacacaggcttacaaatacatcccctaggtatgccataagttcatagtgaagttctttacactttcaggaacactgaggctgcagtcagagcctaccctattttaggtacatagttttaatatgctgagtaatttggtttcaaagctcataggagatgaaaatctgaaagttgaaaggggtaaagaagtacatagaatgagtatagtaaacatcacaattggcagcctgagaataggaaaagaacccaaggggctatgataacatacacacgtgttcaagttacatttgcctggggccactgtgggaccacagtcttctatgcctcagtaaactctgagtgttcacaggactgcaaagtacataaagcaaataaaaatattcgtagttgtggccttgagacatcaataaatgtttaaattatattcactccactctggtaaagaatcaaattgttatataatatattttatatttcctccatggaaaacaaagattagaaacatcattgctttaatcagtataaatggtatataaatcagaggtcctcagggtttagcttggctctatcccttatttgctatgggactgtggacaaactatgtaaccattctgggtcccagtttcctcacatataaattggagctaacaagagataacaatagcatctccttagtagtgtcattgagaggataaagtgacatcatgtttttaaaatgttcaacacaggtcctggcacctaacaagtactttataagtgttaggtttatcataagagggataaatccttactatggggaaacgttagctatctagaaagtctttttcctaaacgttccaggaatccagacaactgaaggtttattatacatcaagtaaaataccaaaataaacaaaataaaatttcactaaacagtgtacaatttgtcataacatacagtatttctgcactctaatttaagagctcttcaatttttaattatatttagaacttcaactgatccatgattggataggttttcagaattaaataactttacttggttcagtaattggttctgatggtctgtctaacatggttcaggattgtttcttttaaaacaaggcatgtcataccattctgaattccttataaattctgaattaccttgctgtgacagtattttttttatcatgtagaaaaccagtccttattcagcaccagataattagctactttgcaaatgtcatgacgtttgaagcttaggcatgattactgagacttaatcacactaaaatccttcatatacattccattgcataagattgttgagtataaagtggaggtgcagggatatagatggtgatgtgtctatgaataggtaggaaatcagaagacattttgaggcagacagagagcacatacaccttacacaataaatttggttaaacatagtcaaaagagaaaaaccagtgaagacttgttactcaggtgtccatcaatattatatgcaaacgttcagtcaggtatataatcagtaactgtcctgaatggcatgtgtattcatatttttatatgttaaacatatcatttctacatttactttttattttttcctctttttctgcaaatagaccaaagttctcacattgggaaacatattatggctacaaaatgtttaatcatttttaagtgaattatttcaaaatttctttgagaaacaaataacagctactctcttggaggttctgaaaattgacttcagacgtgggatgtagtcctgtttagatattgaggatctaagcccaagggatcacttgcaggtctctaatccctcatggatgaatcatgcatttcctgtgtatttcttgagtaaatattaaatcgaagtaaagaacttgtacgttacgagagactgaatatttaagtcggtgtttaacacattatggaaaacatgtataagtcatggtataaatgtaaatcctggaatgtggggcaaaatttctcaattaccttgtacatatccaggaacaactagtgagtcttctatttgtgcatagttaggtactggagggtgattgattcatagcttcacctgtgatttcagaaggctgagtattattatttttattaatttaaatacttcaggtaaattcactataataattcagagtaaggatatcctagaacatgatggctgttattttgggcagtttatttgtaacgttccatgtccaagaatgactcactcttatattaggttgtttaaattggaaaggtcaaatgacttaagcttccaaaaattggtttggcaaatttcacacttactttcagcattgtagttcctttcaccaaggtacatgcatgttagggctctatgtacagagaatttacaaggttaattaaagtgtattgtgcataacacagtcgtttagttggtagttcaatattatgtttggcatgtgtgataacattgcagagtagatctgctgtaactttgactttggtatccttagttagaaacgactactctggtagacacatgctccccagataaaatgcctactcagattcactgttaaacaataagaaaaatagtttctgctgaaaactgtttcatccatgggttgatagtcacggacagagtgtgtataattggcaatgtgtatttaagtgttctacaaaagcagaaaagaaaactgaatattgaagatgatatagtgttcctttgaaaaaattggacaaaataacaatgagaaagcctgccagcacagttataaaggattaatttcctggtattcacatacagggctgataaatatagtctatctacaacttcattatgcatagtgctcttgtcattcaacgtgttagggaatgaatatggagaagcataatgacaatgtcatattgatttacataaaaattttgtgtgtagaataattatatacactatcatatggtataaatttggaaagataaatgctatatgcagtcacgattttaggaattattaattttatatatacatactgattaaccattaaggcattatacaaaatactgtgtaagatgtaacacctatgaaaaatgtgccgtgttctctagatatgttaaatctagtggatgagtaacccataaacataccagagaagtatgtaaggacgtatgaatggaaacatacacttgatattgataaccaggaacgtaaacatttttttaaaagttttctgaagcccagagagcagcagttttcaggctgaagtacatataaactaaagattcacagagacttcccaaggcagtacatgagcttttgtggtttaatggaaattaatgtttatatcctcaactttcatatgtagtgaagttaacatgtgtgagaatttgactatgtttaagccgaagctcttaagctagttctccttcctcacttcccttttcactatttctctttccctattttctacagaaaagcattcttctcatttttctgaaatcttgctaagatgctttgttcgtaggatgtaagtgctaaacaaaaggaaattttaaaatgtgttaagagtgtgaatgaatgtgaatcaaattacatttcaggtcaagtggtatcagttcttggctctgattcaaattgaagaaagacttactaaaattgtcagtgaataaagaagtaaaaatcactttagtgataaattactctgtaatttagcatataactcaagtttgaagaacttccactactatagaaaaactatttttattcctgcctaattatttatgtaaataagattttctggtgcttgcatttataacaatgaaaactagaaaatgaattgattttcagtgcataaaaataagttatatctatcttaaatgggaaaaaagcctagctcatctcagtatgacatcaatttctaataaaaattttattttaattaaaatagtttaaaaatatatatatttaattaggtttcatgagttatttactaaaaataattataataagaaaatttaggaagacaatttgcaggcttaaagcatcaaaatttaaataaataaactattaagttcaatttcaatatttgattactgcaatatatgatagattcatcaatatgagatgttcaaacataaaaaatataaatccttagcataatattttaaatggcgagttaattggaaatatgaacccaagggacagaaagcaaacaacataaaagttctgactattaaagaagaacttgatcgtttatttttacatggatgacattgagttacaaagccttggagtatttagattccattgggtgcatttaggaatagtgtaactgttttattttaaaatgtcaattttagaatatgttagaaatggcataattttcaattgtttacactcgaggaaacattttacataccaccttgaaatatataagtcagtatgtatgagctttaaaaattattttagagtgtatatgagtaataaaagttagaaatttacagatctaggctcatcactttatattaccagtgaagagaggaagacccagagcaattaagtaaactcaccaaggtcattccagctctttgtagcagatcccaactagaaggaagggactatggagaatagaaaggtttcaagaagtgggtaatacttaaggtaaaatttttctgggtgaaaatggcctctagataggaggagtttttgcctaggtgtatcatctccatcaccaccaaaccacagaaaatttcacgttgcctaaattatgaatttttgttggaatgtattggaatgcaagagtgcaaagttatgttggaagtacatggttcaggccaaagattttaaatgctcttcagacattgtatgtggagtgagctgtggaatgtttttaagtagagtgaaggagaaaagtagtatgaagctactataaaacttatggatgaacactatggtaacatggttttgatcatctatccaaattcttctttctatagtattatgattatactaaataaaaacaatatttttagatgttgttgtttagttgtttgtgtttcgggcagtatcagggaaagaattttgatcaaggtgctatttttataaaatcaatcagttattactttacttcgctttatcttccttcagattttatagtacatctagatccactggtatggttccacttcccaatatacatatttctctctctctctctctccctctctctctctctctctcacacacacacacacacacacacacacacacacctttgcttttatctgctccccagaagagctttatttcagactatgggctttgttttgatgtacaggcatggtcgtgcccatcattggctttctccatggctaagtatctatgaatctgtaatattttttaataatattatgtttattctgaataaaagcaatatattaatcacacacaaaactcatttgttgtacattacccatcaaattttaaaataattgaatttatgtaatgggggaatagacagtaattaattcttttaataatttgcaatgaaatgaataggataagtttattgacacaattaattttctgtcatttaattggagaaactatttacctgccatttctcttaatatatgacattagtaagttatttattatacaaaacattaatgaccctattagaccaaactcaattaatgatcacattttaggcatgttgttatattatctagtgctttctatattgtttgaatacacatctaaatatgtatgtatctaaatatgtatgtacctaaatgaaaacaacctagattttaggtaaaaccactattttctattaaatacctaatttagagagaaagcaatttgtttgctatttgcctttttccttcttgcttccttccctcatctagctcctaattgtgttgtcactgctcttgtgtgtgtatgtttgtttgcgttttggacaatatagaatagtgcttttcaaacatcatgcagatggataacctggtgatcccgttagaagtgcagtccttaggtttggggcagggcctgagattctgcctttctaacaagctctcaggtgatatgaactttagaagggaaaaaataatatcctttccccacccattataaagtttatggctgacatgctgtagcaaaaacagattaacaagaggaaataatacatctatttaaacaaagttttatgtgacatgggagtcttcagaaatgatgacccaaagatccagggaaaagtgtatatttgtatgcttcagtttgatgaagaatggacagtcatgtagaaatgggattagaaaggttatgatctaataataatggtttacttaacaaggctgttaatggacagttctttttcgtcttccttctttcctccaagtgcagggcaggacacctgtcacacgaagatctgaagggcagaagggaggagagattctttatgtaactcacaggagaaagacaggagaaggtcagaaggtgccctttctgcttgtgccaagatgttatattttggggtgtcgtgttctgagccccaatgggaccacagtttagtaaggcttgagagactaaaataacacatatttccatttgcttataaaaaattccttaaggaattttaattcacatgtatatatttaaagaatgaagagcaaaaaaattggtggttgggcaaggaagactcatttctggccaggctgatagattagaggaagctttattgctgggaggatctggaggccaggctggcggaggcgggagcagcaggtcttaaggtgtgtcttgtcaggtggaacaaactgggtgggaaaggacagactggtgaaaggccttgacaaaccaattatgttggaaacagaaaggtgtcagagtcttcaaataatttttaggagaatagcatgcttgctatacataggttccatgtaaaacaatataaccataccttcttttggagatatctttctattttaggttaatggggaaatttaaatactagtggggcaaggtgaagtttgtaacaattcaatttaggcaaaaatgccacttcttaattttatgccagattaaataatgaaaggcaattaattttacaatgtgttatacaaaatggcctctcaaacttggtaatattcaaatagccaagaagaaattgaagtgctctataattaatcctaaactttgtattcctatactctaagctagaagagacttagctatttgcctatcattcattgaggtcatttcttgtaccaaaattagaaagataacaggcaatgaactttcaattttattgaaccgtagctgttagctctcttttctccctgtacctgaattcatgaataagcagtttccttttcatggtgtcagaaaatgaactcctactttatatccaaaaatagtcaagttgaggctttactaaaatatggtaattttatttcagtatgcaagaccacagagatctcatgtctaaatacttacgttacaaggtacagagacatctcagataacaaaaaggttagaatttaggagaatagctttttgtccagagtatttgaaatatatatatatacacgcacatatatattttagcctatgtctgaagatgaattatttagaaaatcaaagaaatattaaaaagaaaaagtggaaagccttgttcatgggtaactattttttagtgtggaatagatgcaataataatgccatgaactgcaatgcttcccccaagacctacattgtccccccacttttctgcctttggcattgaactagtgtgcgtaaatgaggttgctctttttgtccagttgttaaggcatgagcagcggggcttgcctttggtactgaggctattcatcaaagcttttaaaaatgttttcattgttattgttgttgacatgactttttgcttctacctcccctgctgagccagaccctaagaactttgcaccggctgttgttttttctcatgtactgaattgctgttggtttgaagactgcaaggggagagtgaaaattatatcggttcctcaattggtgttggctataggtcttgcacaatttctaaccaaaggctggagtatagtactagccctctttaagggaaacggtggaaggcataactgagataaatggatgcattttggagtttgtcagctggagtgtatgttttacacatatattcttatggaaaagctctgtggtatgtgatacttttgtaggtctatataatgatgatttgctattttccaagcatctgtatcaggtgcttataaaccaaattactagtgtcatagttaagtgactgagatttttctattctcttatcctttgtgaaggcaggaagtatgaccattttgggcttgcagttaaagtgggtttagtgtgaaagtagaatgattgaagaaaaacagcacaaatctgagtggtaagtcttcatagttacaccttttagagtttcacttcttgtaaacaaaaggcaaataacatagagtaggaatttaacaaattatgccatgaaagagaaaaatgccactttgaagtgattgtaaataaaagatcaatttaattatacagagcagtaaggatgaaatatataaacaagaatataaaatagaatagaaattgcattattgaagtaattctacaaaatcataatatcaacagaaaggagaacttactgtttactggaaccaaacattctggtgttactcattttccatgtgacagctgttttcatgtattttaatcaataaaatctcataaagctctgcaaaactgtttggaaaactaattatttgaactacacagtcatgtaccacaattaatctatgtgaatgttttttatttatatttcactgtttattttggccaattttgtaactgggtaattttgatgggttaaaatttgaaatccacatggaccaatcaaatgtgctggtgtcttccttagtaatggggaatatcaattacatctagaggtgaatttcagtagtgtacttgagttaggagattatgaggctttccatcatgctacagtgtttggaggggatttatttcttcctttcttcctttcctcctttcctcctttccttccttctttcccccttcccttcccttttctttccttccttccttctttccttcccttccctcccttccttcctccctctctccctccctccctccttccttccttccctcctcctttctttccttcctttcctttcctttctttccttccttccttcctcccttctttccttctcttccttcctgccttcctcccttctttccttctcttccttcctgccttccttccctcccttccttcctccctctctccctccctctttcccttcctccttccttccttccctcctcctttcttttttctcttttcttttcttttccctccccttccctccctccctccctccctctctccctctttctttctttctttatttctcttttttgtctcaatatttgtagttttagtagagatggggtttctccatgttggccagtctggtctcgaactcctgacctcaggtgatccacccacctcgacgtcccaaagtgctgggattacaggtgtgagccaccctgcccagcctggattttcttgacaataaatgtaatcctgacactcactgatagatttgtagattttaaaaattttcattaaaagtgcattcttttctttaatactgtttcgacattcaaatagatgaaacaaaatgatttctaataacaatctagagatgtgagcctaagatcagatatattttacataaatatatcaacccatgtgccaattctttactttcttagtatagcgtcgtaataaatcttgatatctgaaacagaaaaactctcattcctgactttaatattatagataattcttgcctttcatttcttcatatgcatgtaagagtgatgttattaaatgccatgaaaatctgtattgagatttttcttagaattctacaatgtgtagataaatttagaaaaaaaagagtatattttcaatataccataatttttcatgaacatggtgtatctataaacctattaaaactaccctattttttcatatgttttatcatttctcttttaggaaacttgctgaattcttaacaccacaatttttatttatattaaaataaaaaatcagtttacatattttatacattttaagaaagtaaaaaaagttacaaactgagagaaattattctcacacatataattgaaaatatataaagaatttctatgtattaataaataaataataaaaagtggagtaaaagttataaagtagaattccccccacaaagcaaacatatatattcaataaacatgggaagaaatgttccatatcattagtggtcagtgacataccagtcaagtcaagaaagcaatgaattacaattttaaactgtttcattgtgaatatatacatttgtttattttagatatttcaaggattgaagaagatgtgatttttacatcttccatctaaatttaatataaattgtaggaatataaatgttttaactactttaggaatctgtttgacattatcatcttgagtaaactaagcctttcttctcctaaatatataccccccaaaaaacccttgcatatgtttagcaaggtatattttcataaagcactattaaaactatataagatctcaaaataatacaaatattattaaaaagagagtaaatgaataaaaggtggtatgttaatacaatgaattactacactacaatcaagattaataacaaatgacattaaaactgtgtacgaaatttagcaatatagtattaagtaaaacaatcaagattaataacaaatgacattaaaactgtgtacgaaatttagcaatatagtattaagtaaagagtaagtccttatgagaacacatggacacaggaaggggaacatcacactctggggactgttgtggggtggggggaggggggagggatagcattgggagatatacctaatgctagaggacgagttagtgggtgcagcgcaccagcatggcacatgtatacatatgtaactaacctgcgcattgtgcacatgtaccctaaaacttaaagtataattgaaaaaaaagagtaagtccttaaattcacatctataatagtaatttttttaaataaaattaaagaaagctacatttttttatatctaaaagcaaaattaccatgtaaacgtgacttagaatatcaatagcccagtgtgtagggagacagggatgaagtgaggaagacaatatgattagatgcatgtagttgttatcaagtgtacattctgcatgatagatttacagatacttattgcagtactgaatgaatgtaattatgaatcaatgaatcaatgcatggatcgaatggataaatgaatgcatggattgataattgaacaaatatgtaaacaaatacataaatataagccagacatggtgactcatgcctgtaatcccagcactttgggaggccaaggcggttggatcacttgaggccacgagttcaagaccagcctggccaacaggccaacagggcaaaaccctgtctctactaaaaatacacaaaaatcaacctggtgtgatggtgcgtgcctgtaatcccaggtgctcaggaggctgaggcatgagaatcgctcgaaccaagaggcagaggctgcaatgagccgagatggtgccactgcacctcagcctgggtgacaaagcgagattctgactcaaaacaaaacaaaacataaatatataaataacggccatacatgagccaatttcacaaaccaaggattatgattaatgtagttctgtgaatttagtttcaatagaaatagagatatccataattgtcacaaaatgttactttttgttgacttttcattttttcctaagagtttctgccctatgatttcaactgacttgtataaaaagttagttggtggtggatgtgtactgttgatatccaagaataacttttatctgttttgttaagtcgtggccaatttttcagtttgtaatgttatgttagatgaggaatgggctgggtgccatggctcacacctataattccagctcttttggaggccaaggcaggaggattgcttgaagccaggaattcaagggcagcctgggcaacaaagcaagatcctttctctacaaaaaataaaacaaaatttaaaaaaaattagctgggcatggtggtaaattcctgtagccctagctacttgcaagactgaggtgggaggattgctagagctcagaagtttcaggatgaagttagctatgattgcaccactgcactccagcctgggctacagagtgagaccatgtctcaggaaaaaaaaaaaaaaagaggatatgacttttacacttaaaaccctacatgaagagaaaagatcaattggctctcagtatattaatgtcgaattccaaggcagaatttttcttgctgggacattttagagaacagcaatgataacatgcaggacaatctttaaataacgggtattcactattcaccagtatgttgattattttctcaaacattaagaaaagtatatttttaaggggaggtaattacgcagtatggggtagccagatggatatgtgaaaataatttctattcactttggtagttggttcaacatgctctgccaaaaaccaacacaaaaatattatataatcatctcatcaagtaacaatagagaatttggagacttaaaaaattttattttgctagtagcttgaaatctcatagaggtatgtgagcccaattttgaatctgataattgaatttttttctaaagatttcaatattgtattttatgcctctgctgttagaaccacagttaagtcagttccagcatgaagaaactattcttctttaaccacagttctaaactcaattcttgagtttaacatctcttactttaggaaagtatttcattttactgtttttaaaatgtggataattgtcatttatgacgatttacctgtaaccaatgtaggtttcgggaaacactgttgcccaggaaaatatgttaaatagtggcctaaaatatggaattgatcttattttctttagagtgttgttaaccttaacaaatcacttacttcatttccataactttaaatgccaaatacttgtaaaacaatagcaaatatttaaaattaaactactcatagtgtttataataaactatactgtggacttgattatattttagggggaaagaaagctttctaagagttatttggtatccatgaatctaccctttattaatctcagaaacagaaacctattgtattctgtctcaaacagctaggtttatattaggttaaaaaagtcatactcagcatggtataaatacatcttaaatttggccacattcccatgctcaagaatatgacgtaagaagtcacacagtatgcgagagtgattaaacatctttaatctttggtccttctaggctttgtagctcaaagtcaaaaagaaagcccatatgatctatctctaactgtatacactgcactatggaatatcaaaagcagtcagtcctcactcaaagaagattgcactgctcaaagtaaatgctgtcttaccatgagttttattgctgaaagcaattcatgtaaataaaatgaggataaagcaacacaggaatatttcaccagtgatttcatttctttccacatttcaaaataacagttgtataatttggataattcctctaattcctactgatttaaggaaatagcccagccaagccaacagaataataatgacaataataataataataataaatcttacatcttagggatattatatcttgctgctggtgctgtaaattttaaaaccaaagccactatttgtgcagtatatattttaacatgacaataaaatattaagttttgaatgaagtaaatgggaattcatagtagcattttaaaaaatcaactaggctttctgaacttgtaactcaggattacagatataaacacatcacagacatttatcaccactattcttctcttttatgaccttttgaaaagaacataatttctcaaaaaaatatttttcagtaatctctgcacaagataatttgccctttttctaatcttcaaagtgacagattgcataggttgagcctttctgacttacatcacagagagtttcatgtttcagtatgctttcctgtctcactggctgacttgattgataatagttgaggtagtgcaaaattaaaaattaattaatttgagtgaattggtaataaagaggactgagcagttgtattgagatgctaataggtctattccagacctattctagccatctgatcctctggaatagccaacagctgtggtaggcaaaactgacaactgagcacattcaagggtaagggtcaagagtttgtcatctaaccccagtggggccaaagcaggggctgttcttcccaagactctagttctgggacaaaagcaggtcgcatggttgaaataatacatttgtatggcattactagaaaatatttttataaaataataatatagtctcagatgatgattttctgttttgttttttgtgtttgcttgtgaattagaactttctgagcaaatttctgtaagtcctccagtaactataatgcctgcttcattcactattttatcgggaaaaagcataattaatgcaattaagactagtagaaaaatacttgactggtattttgctatacatatagtgttatgcacatatttataccagcctaaaatgcaatacatttgtattattttaaaggatgaaaggcagttaattaagaaaattacatttcatgacacatataataaagaatattctttattttatgatagtcaaatatttcaactatccagtaaaccagtaaagtaggaggtttttatatctatcacaaaactaatatatagtgtgtatattttttataattatgcagatagtacccattcatttatgagatttttaataaaaattcagaatatttttagaaaataaaaaccattcgcattctagttaaaattatgatttttttgtctatctaactaaactatagaaaaataatattaaagcagaagaaattatggacaatttgttaccaataaaaataacagaaagcacaactgatttaggttatgaagatggataagctgatttgagacaattgagttcaataattattatagagtaaactctgagaaacaaaattttaaattgaaatgttaaattcagagatgaataaaataacacagtacatcttgaaaattaaggacatggattaaaataatcaaatgaaatgtttaatttttactttataaacgtataatttatcttttaaaaaaattttttttttcatttacctgaagaacacattatataccttgtagcttcctagagatagtgtcaccagcctgttaatttgaagcagtcaaatatctaatataaacattaaaaaaacaccagtcattgcataataatatactttttaatgtctctcctatttgatttctttttgtttttccttaggaagaataagaaaaagatgattagctattttactcgaaacccaattacctccacgtgtctggtgggaattttcacaccacacaccaatcagtaaatcagccaatcagtgttgacctactgtagctaaatattaggtatttgaaaactgattggcatttgccactgactgaatgcattcagctaaaatttactatagtggtggtgatgattttcttatattttagcaatcttgaaataactatttctattacatctactaacaacgccaataatgataacatttctactattgtgtatattaagactattatacctgcttattaattccactaccattactaatacatagcatttattgggctctttgtgacaggcattgttcatttgtatagtagtgtatttaatcctcataacaactctcattgacaaataccattattttctccattttaaaaatgagaaaatctagatggtttatcagtcagtttcttttatcacccccctgcatgattttaagagaatgcaacgtacattctttgtttctcatctgaatagtctattatttcttggaacacaactaaattaaaatacagtatatttcaggtttttgaaacagaagattaaaagaaaacatattttaagaaataaactaattgttttttccaatgatagtttaactttatccccctctcagccccgagattaagggatcatcaagcagatttataaaacctcaagccttaagcttatattgataggaaggtaaataaaattatacttctctgcatcagaaaacaagattaaattgtcctttagtgcaataaaatgctgatctcaaacctaggttgattcttttaaggtgctttctaatcaatgaggatatgaaaggaaatacacggttggcagagttgggaatccaactcaaaatctaaagaagacgatctttgtctaattgctacaaatgattgtaatatgagctgctgagttttaaagtgattcaagtcaagaactgtaattctacagagacaatcattcccactgcaggttaaaatccatagaccatttccattaaaaataattagcaatcatgtcttgggagatacacattgataagaatgtttcaaataactttagaatgactgtaagtttcagtgtgaatacaatgtccaagtgtgcactgcaacataatgttttagtattttcttttttgttgttgtttttgttttgtgtttgtttgtttgtttgttttttgagacggagtctcactctgtcgcccaggctgcagtgcagtggcatgatctcggctcactgcaagctccgcctcccgggttcacaccattctcctgcctcagcctccccagcagctgggactacgggcgcccaccaccacacctggctaattttttgtatttttagtagagatggggtttcaccatgttagccaggatggtctcgatctcctgaccttgtgatctgcctgcctcagcctcccaaagtgctgggattacaggcttgagccactgtgcctggcctagtattttctttctttcttttatttttttattatactttaagttttagggtacatgtgcacaacgtgcaggttagttacatatgtatacatgtgccatgttggtgtgctgcacccattaactcgtcatttaacgtttggtatatctcctattgctatccctcccccctccccccaccccacaacaggccccggtgtgtgatgttccccttcctgtgtccatgtgttctcattgttcaattcccacctataagtaagaacatgcggtgtttggttttctgtctttgtgataatttgctgagaatgatggtttccagcttcatccatgtccctacaaaggacatgaactcatcattttttatggctgcatagtattccatggtgtatatgtgccatattttcttaatccattctatcattgatggacatttgggttggttccaagtctttgctattgtgaatagtgccgcgataaacatatgtgtgcatgtttctttatagcagcatgatatataatcctctgggtatatacgcagtaatgggattgctgggtcaaatggtatttctagttctagatccctgaggaatctccacactgacttccacaatggttgaactagtttacagtcccaccaacagtgtaaaagtgttcctatttctccacatcctctctagcacctgttgtttcctgactttttaatgatcgccattctaactggtgtgagatggtatctcattgtggttttgatttgcatttctctgatggccagtgatgatgagcattttttcatgtgtcttttggctgcataaatatcttcttttgagaagtgtctgttcatatcgtttgcccactttttgatggggttgttggtttttttcttgtaaatttgtttgtgttcattgtagccctttgtcagaggagtagcccttcgtcagatgagtagattgcaaaaattttctcccattctgtaggttgcgtgttcactctgagagtagtttcttttgctgtgcagaagctctttagcctagtattttctttataatttttgtcttctttagttaatgcttaaaacacttgaactggtggagttcttaaagccatttggtgagacattatgtaaacgttatcccactgccaggactcatttatcttaccacttgttcttttacaccatcctatacactttatttagtgaagtacaaaaatatttccactcaggaaaaaaataaagcccctcactttgatattgtctcccctattacttctgacaatacttatatttataatttacaaatatggtgctgtgacttgtcttaggaatttgattatttaaaaatatgaaaatatggcccttacacatcattttacatttgtgtaatactaattttatgtgacattattgatacacaaactgtaattctgaaaaaatattattgggggaaattggctcataataaaatatttttatgaaaatcaaacagatttttaagccaataaaatagctaggttaccaggaatattaatttttagaaaatctgaatgaaagtatctttgttatattttgtttatgttgcttatgtgtttaaacttttatcacactgaaatatatgctaatatctaaaaattttaagtagtaagatttctaaaatgatatgagctaatagtattcacatggttacatatttctgtacatccaacatatttaaattttttccagttaaaaaaagatgagtaccttaaaaaatgttttatactatccattaaatttttgaagccaatgtatttatattatttttctgtatttctgtaattcataccaaagtatgaatttagtaattataaactttgaatagtagtattttcatgaatatgaatatgagaaaagaagtattatagaaaatacaaagaaatattttaaattagctctacttcctatattaaaatattatttcagccactgtggtagtaataccagtaatagcgatgtggatatgcagctttatcagtggctataatgtgaacatttcttcagctatatgccacacagttgaatgatccaattgcaggtctgggcttttcaattttgccaaattctggctattgtattaagcattggtttcggaaatgaagtgacacattttcctatgaaaatgcaattgagcagattgttctgggcaaagttcaattgcagttaaccctgcagatgaacagttacgctctcattattcagtgtcactcaggtcaatctgaattattaaagtgtattgcagaaagggtaagtattgttggccattcttgaagaaacatttaaaaaaattaccaaaccagcggtttgtttgcaatggttttgattcactttcattttattgtttcttaaagataaatagcacagatcatgcctatccagaaataattagtacatacatggtcttttttgaacaactttgagttactttaaagatttatgtactctttatgtccttattttaaaagataaatttaaggctagtatagaatattgttaaattctagaattctagaatatccagttatatagttatttgaagaatacttgaaggaacaagagtagaaaatagtaagatatatcagtgatttgtttttcttttaatgcatttcacagttaataatcttcaaaaagcattacgctattttcatgtctgtatactaatcaaaccttatgatatggttttatataacttgtaattgatgaatattataaacatgaaaaacaatattatgccttgccaaataagttattttcagcttgatttcataaaaagagaaagagaaatttaaagattccttatgttgattgttctggtgagatagagcaaatatagaaatctgttggactcccatcattgtgaaaaatcctactgcaatgggcaagattaatttgtaacactttctctgaagtgcgaattaaatctgatgtttcatgatgatctgtagtccatgtggatgcctgtgtacattatagacctggccatccagctggcatctactgttatcagagtgctagccctggctggttaaatggattttgcctcaggttaaaagcctttagggaagtgggtcaaattgtacaaggacagcttttctaattccttgcttgtgatgtaaaggtaagaggataataaggttacgtaaagccctgcaatatacaagctcatttagaaatactcacatggagaatctcaagagaataaattagatccacagttgggttttgcaaaaagtcatttactgaaatggtagacaagttcctctttaatttttttttcatattgtatgactctcttacgctcaatttaaacaataggaatgctgactattcaaagggaaatccactgagatagtgacttatatttcacatatgatatgtgatagttaaaattatgccaccttctgcattttagattatgtgattctgaagattgcagcatgtgtgataaatatcacacttccagtgcagtatggaaacttgaagtttatattttatttataacagaatttagtgttttaggcactcaaaggctgagagaaatcctcccaggaaagaataaataaacacttagaaatcactgaatcccacagttaattgtttatttgatatgtttccattttgagaaaaagtaagtttaaaaagttatttatttggaagatagaataacattttgatgggtctcacaacactttaacatgacataggacacagctgtctgtaccaggatcctctactgaataggtctggccccctgctggcctaactctttgaccctcccactaggttgtgtcaaagagcttgcaagggacacaatgaagttgccatcattcccatgggcaatggcagttcaattattttacatgtgaatatatcgaatatcaattgctactctgccctttatatgatacagtggacatactttcaataacttttctttgatagaaatatgtataatagctaagggaatgaaatatgagttgttgtaagaagaattccaggcttttcagatattcattgctaacatttacattatttaaatctttttttttattttgctccttattactgttgaaataatctggaagtaaggttggtttaatgtcctttggagcagtagattttcctgctggacaatttcaaattgaagttcttgtccttgagttcttactgatgctttatacagaacaagagcaaatgttagcatatagcatgtagcatgtagtgcctgtggtctttactgactcagtctcctgataagagtcttcagtaccattcaacgagtacttcttgagcatctactctttgtccatgtttttctagataccgggaataattagaaagataagtaaatcccagtcatcattaccaaaaagtcctagtttgggagataaagaatagggagaagacaaataaagtaaatcatttcagggcaatactgtagagatatacagactccatcctctgagactgggaaagatccagctcaagttgaggggatggggaataattctaaaaagcagataaacttaaggccatacttaaataattaatagaaaataatcaggcacataaaaggtgaaaatggataaatgaatcttaaataatatcatggcaaagttctgaaggtaataataaggtttaagcaagggaagtatttggtattgctgaaacataaattgtgagggattcaagaacagaaaatgttatctggagctttaactttatttatgtgttgtcagttcaagaaattgtgatgggtttatctagactagttttataaacctgtaaagaaagaagcagaacccaaaagtacataggatttgaagaccatggaaacaggttacttggaaaaagaagtctaggtaatgctgttttctgatcataggaaatatgaggcaaaaactagattgtgaaaaaagtgatgagttcagttttgggtattttgtggccaaagtcattgtgggacatccaagtataataattcagcaaacgaaatttgagtctaaattttattgtaaaagatatgattgacatgcagatttatgatcttcattgataacatagacactgctaaaaatctagagagtggatgaaattgtctatagagactaaaaaaagtagagacagtgctgatgtaaggaccttgggcaatgcagatgcttaaaagaattttcacttccttgatgttctttgtctattgtttatgatacatatatttaatttaccctttctacttgtccctctgttaatgaatacacctgcattctcccaattaaaaacaaaaccccaaatattttctcaatatatcaagtcaccttactatttatctcatttccttaatctagactaataaggcaatcaatctaatcatttccttaaatgcgctgcaacatctactgcctgcactttttcaccatgaaatccatgcccatttttctttctggcactgtatgaaaatgttgttcctggagtttatagcatgagacctccacgttaccagacagatgatgatttttctcaactcatctttcctgagctatctgcagcaagtgctctgttgatcactagactcattctaaaacgtctgacttcctgcaactcagggatttatcactcttggttgccttttaatccccacaatttgggtcaacctagctattttctccagttgaagacataagtgcccagttgccagaactttgtcttcatttttatttctcttcggctaatatttaatatcgtgaattctttaaaatatctttagcagctgaaatgcatttcggtgtagtaatagatacacttagttgaactggcataaacactgtatataatgaatataacattacatctcaggaagtccaaatgatagaagtgtttatacgatagtcaaccagattattcctgttatgctataatccctgcagcttcatcattggtgactggcaggaatttggttgtggcaattccaggcattatatccagaaaaagggagattgtctttctaggtaatcctactaatgaatgtgcagatttggaaaagaatcactttgcttctacataaattcatgttctttaaaggacaaaatgaaaaaccatgtgcacaggtccataacacacagcatacttcaaattcttctgaacagagagaataaggaagtcttgttcttacatgaaattaagtactttttaatcctatgtgtcagtcctcatgtggcagagattttaatctgcaccaaaaatctatttgcaatctccttttcccagtatcccttgcagttatatttgggtccagagggtagttcttaccaatgagctgtgagtaaaagtgactaatgccacttttgggtggaagaagttaagaattgtgttgcttcttcatttgcctattgcctttgccatggagagcttttgttcttgaaacaatcttcctcattcattaattcttcaaaggccctggttttgtctccttcctcattattttataagagcacatgggatatgagtggtcctggcattgagaagctttgacatctcacttcctcttgtttcctgtttgggctttaatttctttacatattgaacggcggtgacattttaatttttgctaaattcatggtttctttgttagtacagtttcattcatcgttattagcttctgatcaagcagttgtttagatttattttttattttttattagtattagtagtgattttgagacagggtctggctctggcacccaggcttgaatgcagtggcacaatctctgctcactgcaacctccacctcctgggctcgagcaattcccccgcctcagcctccctagtagctgggactacagtcgtatgccaccatgccctgctaatttttgtattttttgtagagacgaggtttcaccacattgccctcactggcctcaaactcctgagtacaagcaatctgcctgcctcagcctcccgaagttctgggattacaggcagttgtagcctttaaactaagcatttcttatagtgataagtttttgctgtttctatatctcaggataataacatctgttttgacataattcaaataaaaaataattgtttcctggccaacatgttgccatttcttactataacaaccacaagattcacccaacattcactctaatgctacaattctgatagatacacaattaatatctttatatattatggaaaatgccagagccgaatgcttgtaaaaaatgttacatcaccagacttactagcttcctaaccaaaaaatgtggggtcctcctgttttgtgatggatcttttcacctggacaatttccagttttaaagttcttttaattgaagttccacatttctagtatacattcctgaataaggacggtcacttttgatttaaatccaggaaggttaactgatgtcatacaaaaatcaaagtcaacattctccttatcaaatcagcttctctgagccactttcctctattagcaaagcttctttatttcttgagtggaatcatggaaactttatcaacaaatatgcctatgcatttactcagttgcttctttccatcatatttattgcccttttcccatatcttccatcctgtttcaggatttcagtaattttatcatgtaacatcaaggtattgctattttgttttctgtctcatgtcatcgtacctttatctaccctattatcacctgcaaaattaatcttcctaatttgttgttctagtcatgttactttcttaattaagtcttcattctataatataccaaattcttaaacttggttatccagaatccaatcttggttactttctgttcttatccccactgctaccctgtgctgacctaatacctaaaccaaactggaaatgcctgagttcaacaaactggatgtaataactacatcagaatttccttaaaaggctcaaacttatggcatcactgcccattagcaagatccttttctactaatctctttcttgaaatggcttctggatgtaaaatcctgccatatatttttaaagtattttatgtctaatagcatttacatacgaagccccaactgatcactgtaactaggtaaaatttatttccccttaatgaatgcttggtgatatctttctataagactgtaaacttcacaagcagcattagtcatgtgtgtccaagtaagctctgcagcccttctcaagaggctgtgtaattagaaaggattaacatctttcatggaactgctagaaacattagatatggaattatttctctgagactatgaaataaaaggtttagccttagatcaaagcagtcaggcatatagaataatgtataatgattttgcccttgaaaatttagaagtcttgacaggtttaataaccaatgttcttctggagatacttttatcaaactactagggttttttggtttgtttttttaaaatcagaatcttccagaataaaaaacaaactagaaaaacaagataagagaaaaacaaataaaccctcttgaatataaatctgtgggaaatcacctacctgggggattttttaaatctttccaatagattataatttttttaaaagaggagattaatataataacttatagaaagtgataaatgtatcaatcacagtaacaattctgggccaaataaatttatcatatataaattgaaaatgatatgtgggaaagatcactcaaatttatgaaagcatagtatgtgttagatatgttttgcataatattgcaaccctgaaggaagtggctattaatctaattaatagagatagaaaccacagtcagtaaaagctacaactctaatttaaatatgaatcaatctgattactaagcccctgctctttcaactatcatatgattataaagataaaatatattaagtaatcaagtgcaattcacaataatattcaaatatcatttttatttcataacaatttaaatttttgttaatttttctaatccattggcatgtcttgctttactcctaggatgtgttccaagaaattgtgtgtagaaaaaaaaatcagattgattagcatcacagccatacattcgatttaatagaaaaatataatgaggcattttaccattccaagtatttcaggccatctctattttaaagtatgttttgtatgtttattgttaattgctgtattttgttttattttactttttaaatggaacaagcatggataaaagtaattatggtatatacaacctaagagaaataaaattatgaattattactacgagtcttagtttctatagatcttctactcaggaataataaattataaaggaaaaacatgtcacagttataggaacatttcttttaaaaagaaatatgaaatattttcagagtaaatgtgattccatacacttcttatactgcaaaccatttccaaatttccacatatgcttgccaaaaccaatgataattaatgtttcattgaattctttgagaaatgttgaattccacgactggtttggaccatatttaaacatatattatgctggactaaattccagaatcagagagaatattttatattttttggctatttgtgttaagaaaaattctcaagtggagtacggacgtaaaatagatttggtataaaaacaatccatattctatttactagttgcttcttcagcatttaagaaactatttggggccagatacagtggctcatgcctgtaatcccaacactttaggaggatgaggatctcttaccccaggggttcaaaactggcctgggcaacacagggagattccatctctacaaaaatttaaaaaattagtcaggcatggtggtgcatgcctgtagtcccagctactgtggaggttgaggtgggaggatctcttgagcccaggaagtcaaaggggcagttcactgtgattatgccactgtactccattgaaacattaacctttttctccattcatatttttaaaatattattcaagtttttcatgctcttatcttaagagatgtcaacatcagatacaatatgatttgcagggagtttattgttcattaagatttttaatttatatatataatttttatatacattatacttaatataatatatgatatttcttatttaatggaatagtataaaagatcaaaatagtttaggcaaaacattgtctgaatttaggttctttaattggtttactttaaacttgctttacttctctctgcccccaacttagtcattctccattgccagaggctgtttagttattccgagcaatagagaaagatttatgcattgacaagtggggaggtgaaacgctggttaaaagagttctgcaaatgatacttctgatcccagcaggagttataggcttacagtttttcaaaaaaagcaaagttttccctgttaataactgtaaattatatactataatattttataccttttttctttttccaatgactaactatacctcactttagggataaaatccctcaagtgcatgacagagatgaatacaatatgtttatatttgggaaactcttgagattttctttgaaaagaatggatttatgagattgaaagacacacacaattcatactcacaccatgccctcctcccacctcaaagttacatgttcttttacaataaaagaacaaaagttctcaaaaacatacatggcttaaggcagtctttaagcattagagcacttctctgttccctgagcctctattaagacatgtatatagcttgaacttgaaagtatatgcatatatttattagaaagaaatatccacaggtggaggtcagttgtctaattcttgcaaaaatgtaaactttaaagatattgttttaaagaaatagcaatttaggaagacatccttgtttataaattttattaactgtcatcttcgtttcattttagcttacacactgagtttagtcagttaataaggaagtttctgactaataacaaagctcaaaattaagaaaaaaatctgatttgaaattatagtttgtggttagtttatatgaaatagaaaaaataagaggagttttttttttaagtagcaaaagcatgtattatgggaagctcatgatcttgcattttgatcattataggagttgaaatacctgcttccttttcatattttaaatatactgtaagttttagggcataaaaaaatcagaaaactatgtttaaccttcttaattagaagcctcataaatatatcaatataaatatagccatttccttgtccaacaatgtctacaattaaatacaaaatgatagtagaaaatgataaacaatattttcactgccctttcagccctccgagtttatatgttattctatagtaaaataatctgcttaattcatatttagactcttatacttagtaacaatataaatctctatagcttatattaaaatattttgaaaacatagcttggaatttgcattgtttagttaaaaaatttatgttggcagacctaatacatgcctgaaatcactttactctgcactgatcaaatagtcaataatccttgtacatttacttctgtgattagcattatttccttcagtgatacatttactctgaataatgggaggagccatcgaatggataaatctgtttataattgcatgtctaataaatcctggaattattttctcaggccaaaatgcttcaggcacctctgcctcatctctttctcttaaactccacatcctatctgtgtaaaactctatcttgataacattaaaaaatccaaccacttcccactctgtcgaattgtactcagctaatccagtcacatttaggtctggtcaagattgcaatggcttcctaactcctctccttgcttccaccccactcccttatccttataacggtttaacatttcctatctatatgaataaagcaagttcttttgaatgaccaacacattgatagcatttaatagatttagaccatctttcaatgtgtgactaccactttcttgatgaatgtcctaaattactaatgttcaagagagctggaagcttcagtgcccatcagaactggcaagacatctcatttctgaactctaaagggcttcctatagggaaggcttgttttaaatagcattcagtaacttcagttgaactaaattgctctgttgcctgaataatatagcaaagagaaggagacttctgttataatattgtgtcagtagaaaaatgctttctgagattcaaacaattaattcataaaaagttttcagatcagaaatttaacaaataacttcctttcataaaaaaagtttatgtaaaataactttcataaataatgtttacttaaaagaacttttataaaatattcagatattagaaaattcttatatatagcatatacttaaaaatttatttttagaaatattttacctcaagacggaagtctatggtagcattttattacacgtatgaccacacatttcattgtcagcaatagacctttttttaacatttgggattctgatattcttgctttaactctggtttcctatatcatggccaaagagagagagagctgcccttagtctgttcatttgggacttcccttaaattagggcttggtaaactatggcctagcaggccaaattctgcctgccacttgtttttgtaaatacaattttattgaaacaccgacatgttaatttgtttagatattttccatggctgctttcacatgacaacatcagtagttatgacaggggccatatggcctgtaaagcctgaaatatttactatctggctctttactgaaaaactgtgtccaaccctgcccaaataaaattccatggtctgactgggtgaggtggctcatgcctgtaatcctaacactttgggaggccaaggcaggtggattgcctgaggtgaggggttcaagaccagcctggccaacatggcaaaaccccatccctagtaaaaatacaaaaattagccaggcatggtggcacatccctgtagtcccagctacttaggaggctaagataggagaatcgcttgaacccaggagatggaggatgcagtgagccaagatcgtaccactgcactccagcctgggtgacagagtgagactccatctcaaaaaataaataaataaataaataaataaaaataaaaaataggccgggtgcggtggcttacacctgtctgtatacccagcattttgggaggccaaagccagcagatcacaaggtcaggagttcgagaccagtctgtccaaggagttcaagaccagtctatccaacatggtgaaaccacttctctatttaaaaatacaaaaagtagccaggcacagtggagcgtacctgtagtcccagctactcgggaggctgaggcaggagaatcacttgaacccaggaggcagaggttgcagttagccgagattgcaccactgcactcctgcctgggcagtagagtgagactctctctcaaaaaataaaaaataggccaggcatggtggctcacgcctgtaattcccagcactttgggaagctgaggcaggcagatcacaaggtcaggaattcaagaccagtgtggacaaggagttcgagaccagcctggccaacatggtgaaaccctgtctctactaaaaacaaaaaaattagctggccgtgttggagtgcgcctgtagtcccagctactcgggaacctgaggcaggagaatcgcttggactcagaggttgcattgagccgagatcgtgccattgcactccagcctggcgacagagtgagattctgtctcaaaaataaggaaataaataaataaataaataaataaataaataaataaataaaattctatggtctagtcctctaagtatatccctagatatgtcccatgaaggctaaaggaatttcttgtcaatgcatgaatttcaagcccagagtcttgctgaatatgcaaaaaatattttcattcaatagcaaatgttaagcaattacattgctctatcatttgtctgtcttttatgaagaaatccatgggtaacatagtgaaaatacccagggaaaaatcactttataccatacggtaatgaatctgaatctataggaatcttaatacatatgagcacatgtccttagaggaaaaataaggatgttgctaaaggagaatctctttcacaatctaatggtatttttttgctgatacagattgtaaatattaaagtaacagttcactgtactaagtatgtatgtacacacatgtaatactgaagataataaaactggatgtttcaatggctaaattatttcaccatgtttgaacaacttcaaatggctggaaaagcaaataattcacaacactgaacttttgaactatcgatccttctcttattgcacctccttccccaaattcccttcttctagcagctcagaccaaaacacttgaggcatctctgcctcatctctttctcttaaactccacatcctatctgtgtggaactctaccttgataacgttaaaaaatccaaacacttcctactctgttgaattgtacttggctaattcagtcacgtttaggtctggtgaagattgcaatggcttcctaactcctctccttgctttcaccccactcccttttccttatcccactcccttctcaaaacaacaaggtgatctttgccacttccccacacaaagggaccagggacttttggagaaatagttgattcctcatttgaagcagagaaagtttgaggtgattcttgagtatcttattatttgaaagccagaaagtgtttgaagactaacgggaatatagcaaagtcacaggggcttgaagtagcttccattggccaaacagcttaacttgacaattaaaagaaaaaaaatacaacatgttaggaaataataaaaataacaactggaatgacagtagtaatacaaatatcaacattatcaaaaactcttaagtccacactgatcctaaataaaaggtggtaggagtgagatgagagaaagaacatcttcacagagtgttagtggacaaatgcattatatttcaccaaccaatgtaataattaacttagataagcattatcaatggatgctaaaaccactggccaacatggatgctaagttaaagatgctgagaaacagaatattcacgtgaactctgtgtcactccataaatttttaaaaattaattacaaagagaataaactatctttaaaagcgaaagatttaatgaacactaacctattcaacaaatttagcaggactcatgagataaactgctgctctatgcctcatgctatgatgcagtaggaagtacacaattacttatctcatgttcttgctgaaatgtccagtcaaaatttgatcaggaggaaataatcagacaaatccatccagattgtaggacattcaataagtaactagcttatgtcctgaaagacaaaaacagggggccatgggggagacatggagctatttgtccaggatagggatgacgagagaaacgacaagcaagtgtgatatgtgatcttgactggatttttgatttaaaatttttaaagaatattttaagacaatgagagaaatttgtggcctatatactagaagacattgtatcaaagttaatcttggaaggtgtgataatgttgtgcttatgagacaaatttccctattgttagatgactcgtgtatttagtagtaattgccattgtacatgacaaatttctttcaaatggctcaccacatagagtaggaaaaacaacatgaaattgaaataatatatatggaaaaataaaacaaatcaagtaaagtgccagtatttgaaaatacagacataaagaaatacagcggttcattttattcttttaacattctatagatttgaattaagtacgaaaacaaaagaaatacatacattacatataatatagcagattatgccacttatttgctcaaaatcttccaaaggatccccacctcagtcaaagataaagtcaattccactaaaaccaatgacaggtggttgatagaggtggggtgaacatgtgacaacaaaaggaggacattttggggagcaatggaacagttttgcaccctgagtgttgtggtatctccataaacctgtacatgccacaaaatccaaacaagtttacaccaaacaacaatgaaaagtcaatgtatgggaaatctcttggcgcctgaataaggtctgtatcttagtttattgaattgtaccaattccatttttctggtcttaatatatatggttacatatatattatcattgagggaagctgagtgaagagtatgtggggatgctgtacagttttacaaattctgtagtctaaatttatttcaaaatattattttttaaattacttgcaagagtttgcatgatctgccctagttacctctctgacctttgctactctcaagctcaccagttcttcttcacctgtggccaccttgctgctgcttgcagggacaggccatccttggggctctgtgttccctaaccctgaccacctcctatcacatcacagtctttttagccattatgtccatcatctgtctttttggctaaaatgaattttgtaataaaacaagaatctttattttgttgaaggatgatattgcctgaaatatgcttggaacatgctaggcgttcactaaataagtgttgaattaactaacaaatcttgaaatgtctgcactggaagtttttgtgtgaaaagtggggcatgccatatttcaagagaatactgttttttaaaaaaggtaaattgtattgtgtatatttgaggtttaccatatgatgttatgggatacatgtagatagtaaaatggttgctctactgaagcagattaacatatctgtcatctcacttagttacattttttaaacacagaagctaacatctacttatttaacaaaaatttctaatacaatataattttagtcactgtagtccttgtgtcttacattagatctttagatttgttcatattacctaatctgttactttgtattatttgacctacatctccccatttcctttctccccattccacccatgaaaactgctgttttattttctgtctattttttcagatgccactataagtgagatcatacaatatttttctttctgtgttttgcttatttcatgtagcataatgtccaccagctccttccacattgtcacaaatagcagcatcttctttttcaaaggctaagtaatgttcctgcctctggatgtgtgtgtgtgtttgtttataattttctttatcctttcttctgtcaacagacacttaggttgtttccattatcttggctattgtgagtaatgctgaaatgaacatgagagtacagatatctttacaaggctgtgattccatctccttttggtatatacccagaggagagattgttggatatgtatggaagttctattgttaatttctgtggaacctccatgctcttttccacaatggcttttccacagtgtacattttcacccacagtatactggggttctcttttctccccaccctagccaacatttattatctcttgtttttttgataatagccaatctattgggtatgaagtgatatctcatagtggttttaatttgcatttccctgatgattactgatgttgagcaccttttcatatatatgttagccatttttatgtcttctttggagatatgcctgttttggtcttttgcccatttttaaatcaggttatttatttttctgctattgagttgtagggttttttaatataaattttggatattaaccccttatcagttgtgtgatatatttttccagtctgcaggctgccctttgtttgcatttggttgcattttgtcagtggttttcttttctatgccaaagcttttagggtgtaagatttacctaaagctttaacaacaaaatttaacaatattcttcagcttgctctattgacagaacataatattactcctttctttgccttttgttttgcacacagtcaaaatcaccctctgtgctgacttccacaccagactgattcatgaatggctgctttttcccattgtttcctgttaggactctatggtcctccacagcatttccactgaaatctttgaggccgtcctgctatttctcaatacatagcagctgctaagctatcctgctgtcttccattatctgcacatttccttctgtggagttatattccaacaaaggttcctgacatgctggctgagcttgctcttcttacaatgccatttgattttcagtaaggtttgctagcagatgatgagatggcagaggaagccagttatggtatttgctattagactcagtcttcaagaggctgtaaggacttccttgtttgaaaatctgctaaaaattattttatattcttcagaattatttgattttattgtgacacttgtatattctttcttcttgatgctcttagaaaagtcactcgtgcctcagactgtctttatacctgcatttttttcccatcagaatgctgacctcctgccttgttctttgtatgttcagctcctttgaatacttcagccttcagttaaaagtcatctgcactgagagctgtttccttacccctggattgaaaatacacttttacttgttcttctccatgcggaccttgcttagaacttgttatttttcatgtatttttaagttgtgtgcattgtctcttttccaatggcatgcatgctctataagagcaaggggatctttgactccccactgtagcctgtcacccagcacagggtttgtatataataagtgctcaaaataaatatatcttaaataaatggatatttgacaaaagtaatttctggatgctattagagcatgtacccagaaaataattatttgaacccaaagtggccacaagtatcagatacgcactcatttataactctagtatattgtccttaacattgctctttgaaagccattttcagtcattttatattttcaagtagttttttaaaaagtgatactattagtttggtgcaaaagtcattgcggtttttgccatacttttaatggcaaaaaccgcaatgaattttgcaccaacctaatacctttgaccaacacacagacacccacacatacatatgaacacacacatttattttatagcattattagtaaaatattgatattatttaattggtttaccttttcgaatgcctacatccaaagataacacaaaatatgcaatagtttaagtcacaattttagttttcactggaaagaacccaaataatattataactactatcaaaaggaactctcgtattcatatctacatggcctatgtaatatcaactccaactgttcacagatcactgtcatcagtattgatagtaataaaaataaaaatatatcagaatatttactctcatgagaaactgtattagtttcccagggctgctataacaatttactacaaactggatgacttaaaacaacagaatatatttttaattgttctggaggctagaagtctggaatcaaaatattggtggggccatactccctctgaggattctagggaaaatgtttcctttgcctctttctagcttcagacagtggctggaaatccttggcattccctggcttgtagctatgtcactctcatttttgtctcagtcttcacaaggccttattcacagtgtgtgagcattttcctgaccactttatgaggacactaatcattagatttacagtctaccctaatcaatatgtcctcatcttaatgtaactaattatatctgcaaagacctttttgaagcacggtatttccccgacccggtcgcatgatgcgtgacaggggtgccttgtttactcagcccacctctctcaactcctaacaggagggagtgcgtaagtgaacacagcggtaactggagtcagaagcactggaaccggctggctgtttcggtgcctgcaggatcaaactctattcactcgcacccactgcgttccacccaccgtgagagggagtgcgcaggtgagtgggtgcaggagccacagcaagcccttttgggcgcctgcaggagctaactccgttcaggcccctcagcagcatccaagcaggatgcatgcaacttccgaagtccccgagggcatgttacagcgctctttttttttttttttttttttttttttaattatactttaagttctcggatacatgtgcagaaggtgcaggtttgttacataggtatacacgtgccatggtggtttgctgcacccatcaacccgtcatcttcattaggtatttctcctaatgctacctctcccctagtcccctgacaggccccatgcgtgatgattccctccctgtgtccatgtgttctctcacatgtgagagcatgtggtgtttggttttctgttcctgtgttagtttgctgagaatgataatttccagcttcatccatgtccctacattgctcttttcgctctgctgtctgcggatggcttaagtgttaacagctcagtaggccctttgcctttttgcgtgaggaggctgccctccaccagcaagggcaaaaggccagtgtgataggcttttgtatccacacttgtggctcccaagctcttgtacagcatccatgaaaaatgaggttgcacgaacgaattgaaggatggtaaatgcgggggattttatcgctggcgaaagtggctctcagcagtaacgggagctgaaaaggagatggggcaggtaggtaatcttcccctgaagtctggccatctcgggccagattcatttctgaagttacgccgtcaagctgtctctctgaagtcaatctgcttctctctgaagtccagccatagtccccaatgtccagttgcttctctctgccagctgagtgtggggtctttctaggcacaggatgggagtggggtgggccatgggtagtttaggaaaagacagcattcaagcaggaaaacagggatagaagttctaattttgggccgtggtttcaggctttttggcttgatggtggggtttcattgtggaccctcccttttcttcctagaattgctctgccctctgtccctatcactatttccaagtaaggttacattccgaagttttaggtggacatgaatttctatttcaggggaggggatgcattactcaacccagtagagtctgccctctggcctcaaaaatccacgtccatcccatgtgcaacacagcccaacattcccaaaagtcttaacccattcacgcatcaactctaagtccaaaatctcatttaaatatgtttggttcaaaaagcttcaaatcttatcatctgaatcaaggatggccaagactctgggtgtgatctatcctggggcaaaatgtcttttcatctgtaaatctgtgaaactcttaaatgagctatctgcttcctaaacacaatgctgggataagtataggataggcattctcattctcatagcgggaaactggaaggaataaaggagctgcttgtcacaagcaagtgtgaaacccagtagggaaaattccactgggtttcaaggcctgagaataatcctctgtggcttgatgttcagtcctatgaatctgcagattcctggtcagccctgtcctacgttctcttccccaccaactcctacctccctcgtaccccttgctcagtgaaatcgtactcatttttcagtcttagtttgactgttagttacgtattctaatgtagatgagttctctttttataaattatcatataaacgttcattcttatctttgcttactagaaattataaagttgagtaatttcacaaataaattaatccttgttcccccaagcaggattcaaaggagaacaggagaagcatatgtcttatttgctgttacatccccaaagcataggtctatgcttgccacatcctaggctctcaggaaatatttattgaatcaataaataagatggaattctgtcttaaaagaaaacagtaggagttttgtgccttttgagttaaaataatgtcatgggcaaaatacctgatttcatattgaagttccaaagagtcattaagaatattaatgaaatgaaaatgtactcttatgctttaaatatttttcattaatttttgtgggtatatagtaggtgaatatatttataggggatattagatgttttgatataactcttatgcttttaatgtagtaattttaagattccagacagaattgcagacatttaaaaattttaacatatcctttggaaattgattaaaaattaaaaattatgttcagcaacaatatagagagactctcccataggtgttttggcctaatataatttttgttattatcatcattttctactgtaagtgcatctctgacttataattgtaataaataaaaaatgcaacaaatcttctttccaaagctacatttcccaaaactggtgtcatagagcatagcatttatttagagatgcatcaagaaaaatggggaatccctgaccacataattttgggaaatgtcatattcaatatcctccttcaacaattaattttcatgaagttcgttaggtgatataaatagctctgcgtagttctacagaaaaaaagttattttctaaaaaatgttgctccttcaaaaacttttattttaatattttttgtaaatatcttgatacaccattattttataaaataattttggcaaaatatgtaatgcaaaatgtgatatggcttttattatttaaattaatttatattctcatttaggataaagcagtttaacaatgccttctttcaaataaatataatctgatttcttgttatttctgtttatttgctgaaattataatttcagagaaaagtatagcagaaccaattgcttaatttctgacccaagtgcagacatcaaggagtaagcaatgcatcactccttttgtcatgtggacattatgaaatttagtacattctcggtaactgtcaagtcctgagaatgagcactggttagatacctgggcaaccttctttttgtaccctcttcctccatgtcaagtttctctgcctttggggaatgtgatactaggaaaaaatttctgtaagatatacacaaggtaatttctatttctcatttctactttaaaaagttttaggatttgattgaaaatttgcttaggaacttgttgttactcaggattttccagtctggcggacactaccagaagatatataaacacaattaaattcctagcttagctctgagctctgtcttctggacttcaagataatccagagagacgcaatcctaccaagacactctaaactcattgaataataaaaatagcataaagtatgaacccatttaatattcataaaaattctatgaagtgggcatttgtattgatttcattttatagataaagaaactgaaacctacagttcaagtcactagtcctaggtcacacagttactaagtgaaacagatgagatttgaaaccaggtcagctggttccttactcttaattactacaccttacagccatcatgttcattggaaactattgttttattgaagccagcttagttcccaggtagctgaatttatcttcacattattagactttaaagagttctgtttcacattttagtgtgtcagtgttgaattgaggatttaaattcaattttagcataacacataaatcagtgaacttcaattactacagattttgactaaaagtcttctgatttttttaaagtaaatatttataaattaactctcaatttttctccaaccctaagaatataacttttcttacataagtagcatattcggtcatcattggtaattttaatgctttctttatgtttctttatcctttatgctgtatatttttatgttctcctttgatctctataattcttctgatatttctgttcggactgtaaacaattggttttattaaaaaataatcatttacaaaaacaattcaataacaaatgagtagacacacaaattagcagtgaaaaatatgatcacataccaaatacaaaataacattctcaaaacccattttaacgtgttcaaatacaattttcttcagaaatagaaattcaccaattcaaccttgaaagggctaaaacctctgaaagtcaatgacttaaaaaaaatttcaaatagtatttcattaaaaaaatgaaattgtctaatgttttctaccacttctcatattatgcttggatgcatttttcctcagagagcataagacaatttgcagagtataagcaaactgaatgaatagaaatcagattctttctaaggcagagctagaaaggaaataggataaaacatgtaacagaaggtgagtgaaaacaaatcaggagcagtgggtaaagtaagcttaccttgccaaatgttccattataaaagttatagtatcaatgatagaaactttaggaaatttaagatggcggacatccttacaattttctttgtaagtacatttaaaaaagatgtctgtgtacttcaattggaagggaatgagggttgactcaaagcatataattaattatccttggctattttacactgtggctaattcagatgttactctctcaggaagacagggagaaacttgatttattttgtctggaatcctattcttattaaaaaagaaaggcttaggcatctactgactgacacaagtcacagccctgccattccccctggaagccaggaagcagaatagcaaagaaagggtgtttctaaatgaacattaaaagcccttcaccatggaggaagctacattaaaggtaacgtcttggcaaggaaatattgctgtttagctatttttttttaaattaactttatgaaggctgtcctggtatgttcaaataacacaaagtcaatctttggtttatttctgtttaagctttggcttgcttttttaatcaaaaattttaaaacaataaaaaattaaaagcttagaataaatgaaggccaaactgacttaacgttttatactagaatattaacagttgctgaggtgatgctgagctcaattttgagaaaagaacaacagataaactgacaggataacattttattttaaaacagtgtgattccattaggctacaagtatgttttgttagtaattttaactgatttgaagctctctttgctattgctctcatttcacattgaccttcagtaaagtatgcaaattgttacaatgatgcaaaagataacgtgcagttcctaatagctaggatgggcttactgatataggttaagaaaaattatgaagttaattacttgtggtaggttgatgtaactcaatccatttttcctagggatgcatttaaatgccaaaagaaacaattcacttgccccagcccacacaagtcagtagtagcacagggtggtgtttgagagggattaaaattcacaaattctgacacttagtctactaaaccacatcagtttcaaactgccctcagtagatcaactttcttctttctggaaacatgtgcttcctaatgctattgctgatgaaagatatgtctgttcatgtggctaatcttcattgcttagaaacaataagaaaggttcgctcatcttaaagaagttcagtgcattctcagaaatttaaagggatacttcaagtttctaaaaactccaaattttattttcctttttcttatttcttgatatgtgtggtctatctggttttcatgtttctgtttttttttaagccaccaacaattttatcatataattaatgtgtttgaaatcaagaaaattgaattcacttttagtagtgtagacagttaccctattataaattatatctatgacatatttaaaaagaaaacttaactgctgattttttaggaaaaagaaatcttgtctatagcactttagctatagcagtaaatcagctgaggtattagaattttacaatgttctctgaggaaagtgaaatttattattggcttttatatactccattattttcacaaagtgctataaaataattttacaagtttttttaaaccttcctgtgttgtgataaatgatataatttttcttatttataagttaagaaaaaaaaaacaacctcaggtcaaagcaaggttgtgtattttatacaaggtcgtgtgtcttatacaaggtcataggataaacccatgggcattagttagaattttaaaagtaatatggtattatggcattactacttttacttttctattcttttaaacatcacaatctacttcgagtgttgcttttgtaaatctactgaccaataagatcttttaagcatttaatgtatatcatgtgcaagacccagttttaagtgccttacgtggggtaaactattgaaacctcaaaacaacttatgaagaatactgtttacacattttacagagagactgaggcacagagactttattatgacatgtccatatccaagaaagagtatagagcagtgacttggaacattagtttccaaaatgtgaattccagaccaatagcattgatatcatctgagaatatattaaaaatgcaaatccttggttcctaccccagactgagttaaaagcttgatgtacagggcatagagaatagttttttttataatttattattattattgtagacacagggtactgctttgttgctcaggctggtctcaaactcctggctttacgtgatcctcagtgatcctcctaccttggactcccagaatgctgtggttataggcatgagccacccagccagagtgacaacaatttttttttctttcttttttttttttatactttaagttttagggtacatgtgcacattgtgcaggttagttacacatgtatacatgtgccatgctggtgcgctgcacccactaacttgtcatctagcattaggtatatctcccaatgctatccctcccccctccccccaccccacaacagtccccagagtgtgatgttccccttcctgtgtccatgtgatctcattgttcaattcccacctatgacaaaaatttttttaacaaatgattttgatgcatgcccttgtctgagaactactagttcagaagatagagtctaaattctctgcctttgactcacaagattttcatttacagggtgtgtggcttcaaatcactggtctttcagggtctgagttgggttatctttagaataacactgggaatactagtagctcttcgatggggctgccaaaaggaccaaatgtgaaagcctacttcaggcaggtagtatatcttctgtgaataccaaatccaaaactcaattttattatttataagattgaaactaattattatataaaagattcattaatttaatgtattaaggcattctgcatggtacctgacacttagtaaatggttagaaactgatatcatgttattatttttattactactactatgattcatcattatcactgtcagtcattatttgagttgtggaaaactaggctattggtttacctatgacctttatactcagaaatccctttccagcctccttctgccaggacttccacgcactgtctactcatttgtgtctgtctgtctttggccagctgttagtccacctgttttagtcatgtagacagcttctcctgatctacagccagcctgatcctcacttctgtcttatttccttaaggagagatgcaataatgttttaaattgtgtagcctgagtatgaattcagtccaccataaataattaaatgcatgacctctcttattgagtgtttcttttcattgatgttcataaaacttaaacaaatacatgtgatcaatcttgtctgtgccccagagttgtaactttttgaatgaattcaatgtcaacttgcaaatattatttcttcaaaatttcctctgtatgttattttttcttctatttatttctgataaaaattgtctgtgctttttgattaaaaagcaaacaaaacacactgggctcctctagcaaattatttctcaagctacatataaagtaaactagagaaaagaaaaagttattaagaaaatcataaggaagaaaaaatatatttgctgtttattaaatcagagtagatcatcatagcggtcatcctcattgtattcacattaagtaagctgaaaaggaggaaggggagggattggtcttaataatacttttctttaatcaagttaaaaaaactgatatggaaagaataagccctccctactatttgtagctattgtacaaacaaaatatagattatactcaacatgttcttccttattaatattgttatatgttctgcttcagcattgagacaaaacatctgtgtattcttattcttcaggaaatgttaggtccaataatgttgaggaaggcataattttacctataaagtcactgtattaccttttgtataagcaagaaaccacaagaaaagccgaaaaaaagaaaacaaagcttagctagaaatggcaatgtaaagtggggtttgttaaaatgtgaagaaagtattataattcccttgcagagtacagcaaagttaggtatatttctgaatggtgttcatgataaatgtatttttctaatgtttttttaatggctgaaattcctaaggtttgctatgacatggaggcgtcaagaaacctgcagcaacttggctttctctcacctttagtgttcttgaaactgatcatgtctaatatgctttcgatctctggctttatattcaagtcttccatttaactggtagtatgtaaaacaaaacgtatactgtttttacctgcctctatttatctccatccataccgatagctgatggttgattgtaatatgttgaaatagaagaatagcaatagaaacagaaaaaggaggaggatgagaaggggaaggaaaagcagaaaagaagaaggaaaaagaaaaataccaggaagaaaaagaaattactagaaattaaaaatagaaaatgccatcaagcgagtcacttttatactgggccctcgaacaacatgggtttgaacttcacggtttcacttatacatagattttcttccaccactgtcacccttgagacagtaagaccaacccttccccttcctctttttcagcttacttaatgtgaatacaatgaggatgaccactatgatgatccactcccatttaataaatagcaaatatattttttcttccttatgattttcttaataactttgtcttttctctagtttactttattgtaataatatagtatataatacctataacatacaaatacgcattaatcgactctttaagttgtcagtaaggcttttggtcaacagtaggctattagtaaagtttttgaaaagtcaaaagttatgcatggattttcagctgcatggggaatcagtgaccctaattcctgcattcattgttcaagggtcaaccgtactaccattttttttgtaccaaatgtattaccatttttttttggctatgatccttaaaaatgaaaataaattctattctttttaaaaatttaaataaaaatattttataagtcatataatttggctaatatgtcacacagctgtggttgtattgatagattacaaaaaatttcatcagctttaaaccaaagccctctcttaaaaatgatgcagtgtatttcaactttgccttgttaaagtgtcaagaaattttaatccattaagagttgttaaaatgtggaaaataaggcatgtgctatgccagatttttaagtgcccatgtgtttgctcttagacaaagagttgtgttaagtagaatcgtatttctcatttttctagttgtatgtgataattgcactttaaactcctcaaattcacttctgtctgacgtggctttgatcttttacttggtccacattttacttactctttttctctttgtccatgttcatactcataaccaatcatgtttaaaagtaactatggaacacatggaaagttggaatattattgggataatgaaagaacttattttttacaacttgatgacataggatttaaagtaaacgtaaatctgggaggtgcttaatagaattaatgttctctgatggtcactgtaaaacacttaagaaaccatgtatctctggcttaaaataaattctgactacattatttattacaaaattataatctacttacattggttaagtgactattaaaggaagtgaatatttttcttatctaagcaagtagcttgtaggccaaaaatacatttggtttgatgggaagataaattttcaacattttaaagtaattttttaacgtttgtatgcattgtgagccaaaatatttgatttcttattccaactgctttaactctagccatgttcttttgaagacattactttctctgagaatcactttgcttatttgttaatggaatatggaaatgcttgtaaatacctaaaaaggaggtacaagtgacataaagtaaaaaaccttaaaaggcagtaggaatgtaagtcattgttattttctttgttgccatttctgtattctatctattcatgttatatctctcactgtttataccttagtttaaactttatattaatagaacagtagccaacttttctttttgcccatttccatcagtcttatttgcacaatctaacttcgaagagagtttttaataaatataattgatgtgaatggatgcttgtgaagtggaaactggagtagcaaaaaatatgccaagagtgagaagatactcagttgtagtgtttacagtaagttttctttatccatggtagttatattgtataaagttgctgtgactattgaattgctgctcctaggggaaatacaagtttagcttcctgagggcacctggttacaacattgtcatcaaatgatcaatacatagtcttattttatgtatgtttctgttttaaggcaccttatttaatatacagttgattcattaacattaaaatcatggccaatagcatgcaactactgccagaaaggatattttctaacatgtattttctctgtaaggcatattacagccttcttgcatttaggaacactggctgacattttaccactgtgctttcgggccattttatacagcaaaatcactaacaaaaagcacagaaatgtgaaaaatgaggcactaaatagacagttatttacagtgtgagagttgaaataagaaggcagagagttgccttatttgacctcagctgagaacatgcatgtcaggcaactcaagtttttgccattctgtcatgtctacaaatgactagaaagtgccacaagtattgacttttgggtcacaaataagttttagcaaatatgtgaatttgcaaatacaaagtccccaagtaaaagatcaactttgttattttctatttacccaccaccctcccactttgtaccagcctcaacaataattgatgttttgtatgctgtgctttaaatttattttcattttaaagattcaaaaaaaatcattccatctctgttatgtcagtactctagtattttttgtttttagcattatttaatactttatgaatattgcaaacactcaaacattaactgactgaactaagtaatttctaagcaataagcagtatatttagggaggagaagagtaagggaaatttatttaagtgtaatcattagactttgtctaatgatctgtgttaaattcttacattttctaatgagtaaggaataataccctcatctgaaagccatagatttatgtgaattaatagagaacagacaaatatgtttaaaagagatatcggttgtatcataattaaaatgacttatctagaagtgaaaatcaacactcttgatagagccatcagtttaatatagtaaattgaatgcctgccttgtaccttgggctgtcaaagttttccgcacttttggagaatggacagcgatttagaatcgtaaccaaggagggaagaaaaggcagattaaccaaaaaattttaagaagattggagcccaataatcatgcataatcttcaccaagccactcctcccagtacaaagataatataagtgaaattgtcatctttcctgtccatatgtatcaacaaatttcatattgtcatttcactagcatgacagatatgtcaggcatgtcatttttactttataattctagtgctgttaacatcctgctccatagacattaatactttcagaactttgctaatgatgaaactgaagctttgagtggttgtgacttgttcaaggtcaaatagatagtaagtagtttaattaaaattgaagttcaaggctgagtgattccaaagtccataatttttccgctacatcaggttttatatatatcaacccaaaattcctactattggatatgctatgagacagtccttgcgggagcaatgtcaattctacacactcctttccctggagattcatgttcttcagaaatcactgacagctcctaaaatcaagaagctatggtggaagaaagaaaactgtcggcaccagagccccgtgattttcctaatatcagcatcttcatgactcaggaaactggatttccctctacaactatacgttccctaaaccttcaaagtgtgtagctgggaaaatgtggattcgtagtcatactaataaagttcttaatttgtgagagctccaaaccctcacctataataagtgaggattaggtatcttatctctgtcttggacactaagaggttcaaatgagatattgtaagtgaaaatgcctttcaaaatgcaagtccataacccatttacaaatgtgctcactgccaccagattcttttccaacaccaaattttctcagaaatatgaaaattcttcaatattttccacaagtgatagcagacagggtgaaatagaaagtttgtgcattttatgtgcagctttcatatttggtttaagttttctgactctgtatcacggaaaaatcttggtttattttattcattgactcaatatttattgaaggcatactaaaagctacgaactttgctgagagctggtactataataatgaataaagcaaatctcttccctcagttaaagggaatgcaatgcaatgcaatacaatataaaccatatttttcataacccaggaaatatacttggccaaattttggggagttgcagaaggtgtctgaactagaaccagcagggtgaatagcagtcagtgaggcatagtacgggggagaaaaagcagaggtagaaacactcaggaaatagaaaaatggctgtgcttgcatttttaaaatagatgctctcaaggataggcatcttctaaaaatgtccatactctcaaatcatatacaggtaatttctcccccagaacatactctgattgctttatcaatgtcacaggatgtcatccataaaaatatgtcaaccttttaaagaagtggaagtatgaaaaggctcataacactttctcttaatccccttccctctcagataggatgtctatcaagcattgtactgtacagaatgaggatgcctctgcctgggtacttaaattattgatcaaacctgtcactagcaaattctttaaactggatacattttgattgagtaggaaggaatgtttaaatggatgcctgactgtgaagagaatggttttgcaaatgtctccacagtgctcctaattgaagttctgataatatagcattgcaagataacttgttctcctctatttttaatatggcaatttaaaatgtgcatatatattaaaaaacacaggagtagaaagcatcagagattgataatactcctttcctctcctcttagatgttatttgggaaaaaatatgaaatatgtttgactgagtgagaaaataagttttaccatgccttctgtattcaggagaaagatttattattctaatccgaatagccttctcaggaagtctaggttcccatagaagacaggaaattaagtgtttttctatagcactaaaagacacataatgtattaaagagaatatctaaaagtccgtctgttttgaagctatccagctgcagtattctcttgaaaagatcatagcaacttttctcttatagtttccaaagtgatgttatggatcaatttaacagttttcaatgagtatatcccttttaaaatgtcatcttataaagttcatgattaattgcatgaatatccatatgaaacagcattgcctctccttaatccacctccccaatgaaaagctaaatgcatatggactagccaaaactttagaagacatggtatcttcgtgtgtttgctactgaattaccaacttgcatgtcctaggaatagtttaatatgaaggcatacaatttctctgaaaactactttttcttatctctaaataatggtttcttcatctcaatgcaaataatattaaattaaaaatgcatactgtaattctgaattttaaagtgggagaaatatacgtttaaagaagtaatgatacctaaagtccaactataaagtaacagtatgagaaatcctttaagctcttgaatatatttctagctaacattaaaatggatatttcattcagtacaatattcactatatagccatatcatagacgactagatttgatatttgaaattttaaagtctaaattggcaattcaaagataaatcttctccacaaaactttagttcagaactagatagcaatagtaaaattgttctagaccactgaaaacatgattgttttaaataaagtgtttttatttatgcatttaaagatatgtcactggggtagcatactctggcctgcttttgttttataggtttataattcaaactctaaagcacccagtttaatcagaaaaatgatcccagtatattatatttttttgtcataatatgatgccctagtgttctattgctcttttctcaaaaatttccggaaactttattttccagtgactattccttttcccatttatgaaaattccctatgcattagctaatatgatttaaagcaattttgttctgttttctcctttttaaacatctttcacacaatgattctcttttggaccctccatggatggtgaatataatttcaatggggtgtttaactcttacttctcataccagagtcaggaggttgccttcagctgccttttcaaggaaagttcctgaggtttgtctcaaatgtatttgattttttttgacaaagatctgtgcttttacaagctttatgatgggtttatactttctgcaagttgcctttctaaaaacatgtgtaattccccagcagtcctttaaaatagagtcaaaatacttttcttttggagaagttttaccccaaaggctagtatgttatatatatttcctgctttacttttcattttaaaagatttattcttaatcccaggcatattgaaacattattcagacagggtatcatgtttgctgggtctctgtggcatactggcagcctgcatcttgccacaagggtagctagaagcaggtctctgccctgtaggtggctgaagccagagaagcttggctcttccaggtaggaaatcaacctgtcaagaagagtcatggaaacacgattagtttactaacttcattaaatgaaaacgtttgcaacacagggctccctttgctctcagtgtctgccgttgctaaacaatccagtgtttcatggggcgaatggaatgccatgtgtactcccagcaggaggacattccagaaggccatgggcttcctttacctggtgatcttgtggacttcatgcgcaatggcctattttgtgacgctttctcttctgtatttctcaataacccataaccacaggtacacaaattaggaataaaatgaaatagaggtcgctctgctattttcagatcttgataaacctgatttaagatttgtatatataagctatcaacttcttgagtaaagcatttctgacgactaggcccattgccccagaggtttgccttaatttcccaaaagaaatgtgctaaaatgagtgcaaattaacttccaaaaagaggatagatttcattactctaagtgcctcatgctgggagaaaggtgctgttgagctcatatttaagggtgattagaactgcatctttttaactcgaggattctcaagtatgcattcaacttacttgctggtagtttaaactgtggaaaatttgaaccaaatgtgtatatagtgtttttttcccctcacatttttaaatagcagactgtggaagtgtggatcatttaaattctaagagtagtcttttattttaaatttaaaattgttttgcaagtaaatagctaagtcaagtgaattaaaaattgttttgcaaacacatagctatgtcactgttccttagagttttttttaattaacatacatacacacccaggaaacctcatttaggtaggcagaaatatgttctcttaagtaatgagtttgaaagaaagtcttttcttttaatggaattgacacactctgtttaccattctagaaaaagttagagaaaaggtcggtggcctgtacttgttctacactttaatatttataatcattgaatacattatattcataataacttatgtttgccatcattaattaattttaaatttttgggtttttcaaacaaaatatatagctacctattgtgttattagctaagaaatatgtctaagaaatgttaaaaaatacatgatactaaaagttataagaaattacacattggtattcagtgatgtgagctagtctgcaagtttatttttaatgtaaaactttggctaattgattttttttctcataccagataaatatttcttcataaggccatctttttctagagtgggtcctgcaacacttatttggtgcaattctaaagtaaaggtagtacaaacatattatatatttgactactaatttatcttctcattaatttggttacagtcctccttgctaagtagtgaacaagccttaaagaaaaataacaataaataatatcaaagggttcagtattattatatgctgcattgggaaaagccactctaaatataacacaaaaagaaggtaattacttcaataataagaaatgatctttattaaacacattaagttgtgaactatattttattcattcagcttatgaactcaggggaaaatatatagagttattgatcacaatgtttcaacaattcttgtgtgcacctgtgtgtgtgtgtgtgtgtgtgtgtgtgtgtgtgcattcatgcacatgtcagagatgggaacacggtataatattacatcaaaatagctagctacagaattgatgtaatggcataaatattaaaattacagatatttatttcctgcaaaaatagatttattcagtaagggccatatttcataataacttttgaataccatttcatagaaaatactgatattttgagtggaagttggatggacttttcaataggattcaagaagtgagtaggtatagacagtctgtttacaaatctgtgcttcaggtatatatagagagtatctcagagttaatagtaatcaataaaaagcctccagaggttgaagtaaaaaaatggggttggggttaggcaaagtgtggcacagtcgtcacatctcctctgtctattatacagcttatacaaatcagagcacttggtttgtgacaagggatgtttctattctcattgattagtgctgagtgaactattctggagggaatgattgttttcagagagtcacgtgtggtataattgggttttagttgcattgagcaatgcatcaatgtagttacaagacatgcatttggtactcaaaggcatctgcactgtatttatgcatgtttcatgtatgtacacatccataaaatatatcaaggatgtaccacctaggaataaatatggcacaatcatacctattatgtgagaacacattaacaatactgactatattacaactatatcttgctatctatgagtagggtagattttgagttattttccaagaatttgaaacaaattattgtaaaacagctaaagtctgtgacgtaatcatgattctcgtgattagaattgtatattttgcttagaatagtagcttataataatactaggtattatttactaaataccatccatggtgttcacatattatctaaccatatgaatcttacaagatttttattatttatttatttatttatttatttatttatttattatgacagagtctcactctgtcacccaggctggagcgcagtggtgcgatcttggatcagtgcaacctctgcctcccaggttcaagtaattatcctgcctcagcctcttgagtagctgggactacaggcccacgccgccacgcccggctaatttcttttgtgttttagtagagacgggtttcactgtgttgcccaggctggtctcgaactcctgagctcaggcaaaccacctgccttggcctcctaaagtgctaggattacaggcatgggccaccacaccgggcctctcacaacatattatagctgttttacatatgagaaaatcagagagggtaagtatcttgcccaagaccaaaaaccactagcagatttctgagccaagatatgaatgcagctccctttgaaatggaaacctgctctaattctgctgcaggaggttttctccattattgatactgtgccctaaaatattaaccaaagatgcattatgtacaaatgtacagccagatactgtctgtagtccatccttcctttcaacaaatatttactgtttaatattcgtataaataatatatgcaatgcaaatattaaaataagtaattttatttaaaaagtaatgttttcaagatgttccactggagatacagctttgttctatagtacatgggcttcaaggagaaatttagaacatatttacattttacattttgcctttctgcaacaaatcttgtgtcccctgaaactctccagtgggaatagtgaacagggaaggtgccacactaaacatctctctcgattttatgcgcactgtaaaaaagcatacacatggctaattccaatcattgtacatatgtgttagaaaatggtaatatagttctttcaacacctatttttaacagtgtctagttattgggctgatgtgtcagtttcaatttatctgataaaattatgattatcaaagatgcagattatgtcaattatatattaaataattcactgatttacctgtgaaagtttattcgtgcagtttcattcagtagttttattaaacatctactatgagtcagacatacatctagagtcagataaaatggtgggtaaatataggcactatcttggcttttctgacatttctcatgcttgaactaaaacaaccacaaagtatccaactaataatttattcagagttatgatgaatgctataataatctactttctaaggtcactgagaagtgacatttaagctgatatcctacaaatatgtactgagcacatactatatgccagactttgttttgagtattgaggaaatagcagatatttattctccaatatagaatttatcatacttgttgattaatcataagtacttttttgggagaaatatgtaaaaagcataggtcatctgctatatacttttcatttgggagtttcttttcccaccttttttttgtagtttccacttccatcatcttcctacacatggaagagcaaacctccattatctattttcatggaaatttatagttcattgcctttaataacaggccataattttatttgattgcataccatgttttcccccgtatttttatttactttattgatattcttaaaagatttacaatcaattataagtaccaatttggggatttaaatgtaaaaagtgaataaatgtgaaaaatgaactgggttattgaatcatgcgtgatctgtagccaatagagtgtcttttctttatgagaaataaacagtctcctgcaccaaaactgaaatgtgttatgactttttcaatataataatttaaattactgtgagccatgatgattattttgatcatgttaactgaaacatgaataataggagccactgaaaggctttgcctttatttcgttgtattaatccttgtgttgtacaatctttgttgtactaatctttgtataaatatcactttaaaagttgacagtttctgtactttatttgatacaggagaagccaggcaaaataattatcatggatccaatcaatacaaataactactcttggaagtgcaggtttaaggagtttgcttttaggtgcagtaacagggcatgaacaagttttaactatcattatgggtaatggaaagaatttattgttgatgaattagaatcaacagcaaagtgaaaaaagtttaaactgattagtggtattaggttttttgaagattcaagcccttgtgtaactgaaacgtcatggaattctaagtaggtagcttcctgaaacagaggaaaaacataatgtttcattctttctgacatttatctggtgggggctggtgagggaatatggtgggaaatagagcacctgaacatagaaagtaacaaaatggagtaaactactaataatattataagggaagaaaaactgaattacgtatttttacttcgtagaaaacttctggctaattttctgacagaagaataaacaaccaattctaaaatgcgacaactcttttaatctcaatatgcatttcccaaccaatgatgacattttacatatgcattgccacatagtgaaatgagagcagaagcaaagtaactgaaggacaggccaaattaggtcaaaaagagaacccacttctatccagttttattttatcatattataactcttcagatacaaatcttattgcacagcacggtgaaacacaagagagaattgatgttctataaacatggaggtgctcactttgctgtttgtgtaaacttgaaaattcattctttcccttgtaaaaatgctctaaaatcaaacaaagaaaataattataattaaacaaatggaatatgttttgtcttctctttattttttaaaaacagaagttttccatatcaggtttataatcaacagtttttagttatgtattttagtggaatactaaacatgaatacagagacatttgtgcagtcacaaatgtttaaattcctactgccacaccataaaagactaggattttattaataaaatttactttatacacatgtataaaataatgatcagaaactgttatcaaagtaattccaaataaatgaagttagatttatatctaaagcccacatttgttgttataggaatgtgttctggattatgtaacacctattttcactttttaaagtccatactcatttacattaattaactacacatttggggtagttctgtaaattcatcttgctacgtttatgatagttttttaatagactcaggtagagtgactggagtgattagtgaattggaagctattgaaaaaaataaaccatttctggtgatgagactgcggataaaccaatctagaacattcagaaatatctaacttttttacaaagtcagttcaaacagtgaaatttttatctaccatcacctttttttttatcagttatataatcttaagtacttaactttataattttcatgttactgattttaaaaccttgagtttgatttctcctgattatttcctctatgtagaaaataacaatttcctgccatacaaatgattatttagaataaaatcaaaacgatattttaaaacaaaataaaattatattatttcccgtaatctatgcctccatcagaccccttcaatggcactttcttttgcatctaaagtgaaattcaacttattaccatagcctaaaaggccccaaatgaattgtcctctccttccttctcagaacttggctcctttgtctctcctctttacttaacttactccaaccacgttcttccactttaacatagaattagaacaattattaaaatgtgttagccgatgcggtggctcacgcctgtaattccagcactttgggaggctgaggagggtggatcacttgaggtcaggagtttgaaaccagcctggccaacagggtgaaacccatttctactaaaaatactaaaattagctgggcacggtggtgggagcctgtaatcctggctactcaggggctgaggcacgggaatcactaaacccagggggcagaggtgcagtgagccgagatcatgccactgcactccagcttgggcaacagagcgaaactctgtctcaaataaataaatacaataaaaaaataaaaatatgtcacatcactcctctttttgtttaatggctgacagttttaaaggtcattacatctgcctagaatagtctgtgcctcaagtgtctaatgatccatctctctcaatattttgggctcagagaagtcttcctggtttaccttcatttactctttcatttactcagtaaatattgggaaaacacttaggtgctaggcaattttctatgcaattggaatatagcattgaatgacagacaaaaatatctacactggtattatttataccctaacagaaaagagataataatacaacaaaataaatctattaggaggtaatcattactatgaagcaaagaaatgtatagaaagttctagggtttggggatgcaattttaaagaggaccctactaaaaaggtgacatttgattaaagtcctgaaagaattgagtgggcaaaccatgctgataaagggtgagcatgtcagctatttacaaatgagcaaaggccctggccggaagagttgttggtatatttcacgaatattaatgtttccaaaacaccaaagattctgtctaggtcctgttgctcaatgcacagaaagtcaatcactgagacaacaagtattgccagggaagtagtcattattttattatactcctggtgatgtcagcagaagacaattcctaaatctgttcctacctcccaactaaagttaggagtttatatagcaggaaaggaatgtagctaagtgtggggaattaaggaattaaggaggggtaaggaagaagcgttggtcaactggaagcaggtgatcaggcaatcatgatagatgaggtctctgctgccttaattgtctgcatatggtgatcttgttagttcagtcccttgatactgtctgggaggcctgagagtcagtttcctgaggaaggaactcagataaggcaaatgtaagtttcaaactttaaactaggaggatcaatttctacgtgtgtgtgtgtgtgtgtgtgtgtgtgtgtgtgtgtgtgtgtttccataaacatcagttctatgggacccttgggctggttccattaagaaagctagttttcctggtgctacgtgaagtagggagagaggagtagagcgtgggacaagtgagtaagagaagtgaggcagatcaggtagggccaagcagaagtacatggtgagacttctgataatgttctgtgtgaaatcagagccgttgtagcctttgaactgaggaggtccatcatctgattaatgtttcctctggctctgtgttggaattaaacggtacattggcaaaggcgaaagcagggagaccaattaggaaggttctccagtagttaattgagagattatggagtcttggactatcatggcagcagtgaaagtgatgagaatgggtaaaatactgagtatgttttgaaagtagagttgacatgttttctgctggtttagctataaaatgacacagaggagtcagaatagttccagaggttgtgttcttggcaatggaaaaatgtcatttactgtaaaaggaaaagactgctagtgtaacaggttttaggaagataaccaaattatatggtatgtttgaaagtcatttttaatccctgggcttgggtgaggaaatgaagaagtgtacataaacaaaacagaaataatgtgttgattcacttcaacatcaagaggtatgcatatcagcaagtaaaagcacttttccccccactcccactctcctacactcttattctctgcaacatgtccttgttttgttttcttagttgttcttatttctacctgaaaataccttattttttagactcactttatatcatctttttgcctccactggaatgtaagctttatgaaaacaggaacatgttctatcttttcatagaacctgactactggcaagtcctccaaaacacttttcaaatggattacttaattttccaacctatttttggttttaacaggaaaaacatttcaagctgcagaacaattacgaacagaaaaataataattagcatttattgaacgtcaagcacagttcttagtctttacatgtaataaatctaagccacagaacaaccctgattggttagcattatcattatcctgattttacggatgggagaattttacagatgggatcataggaatactaaataccttgccaaagtttatgtgaagaatggtcagagaattgaaattataaaccaaatcagtgtccttttggcattcaagtgagtgtccttttaccatcatgttgataattctcaatgaaaagaaatgataatgatggggtcaataaaagcgtgacatctacgaggtttggagattttcatgggctgactcagttaagggaaggtgtgttgtcagctaagaaaaagaaagaagcattaccatccagagtaactctagtattctgggaatatatattatacaggcaagaagttaattaaacctcccaccaaaatacccagggacaaaagaaagaaaataaggaagagtgagccaacatatttaaatacacttaatttagtattacattttttagaagaaaattttaacaaaaatcactgaggtcaacactcttatctacagatagagaaattgtggaaattagttcatgttacacaagtagatattgacccaaataagtgctgaattttacctcaactctcccttcttcccactcaagattctcccgtggtatgacattgaccttgtgttttctttagaagtagaagaaaacacatcaactgtccatcttttattttttctgacagctaaaaatatgtctgtatgtgttaatataagtcagattactgtttcagctacatagggttatgcctacctgacaggaaaacataccagaatttattttttttggaataaaaaaactagaaaataacctaatatgtgcatgctttctgataaaagatgattactcatcatcttttgtaagattctacaaaagaatgcaattacaaatttaaaaaaaacacctggtgaatgcttgcatataatagttaccatcatgcaaaacaatgtcacgtagtcaatgttggatattcaggctagagtacatatgaatttttaaagtacagtgctctctgtgagcaaaccatctttctaaatggatgtgtcacaccattacttggtaggacatgaatgattatagccttaaactggtaatatgccttcctgacacaaatatagagctatgatgctgtataatgttgacatttatagccacttctatagacttcacctcaaatctttgagtggatacagaatgtactgtatatctattttaaggtgcctgtatgtggacaagcacagcaaccattaagtgattaaaagtgttataggcttgagtattctattactgcatggttttcaggagccaatagagataccgacttgaaccaatacttctatgtgagtggaaaagggttgctatcacccagtaatgttctcagatgaaaaatccaagtaaatattcccatcattagtttcatagtaaatactgtttgtgtgagcctttgaacattattaggcatattaaactcaaaagcaccataatggttgcataaatgatattgcatttcttcagtgttacaagaaaaggaggcattgtggttgagaaaatggtcaggtaattaaagtgtaagcttaaaaatagaaagcatgtttatttaacctgagattgattaaaatgcttctaaacagttttaaaagttctttggccttaataaagaattctgaagatactttcaattcatatggataacaaaatatcatttatgtatacattaaatatactttgacaattaccatcgtaacagcttatattaacatggcacctactatgtgtcaaatttctatgtctttacctatactaatccaggtagtcgtcagaagaaccctatgaggtaaacactgttacctggattttacaagctaaggaactacaacagagagataagtgggcatgctcatggtcacagagctagaaagcaatctctatctaccattggtgataactgaaacgtacaggacttaacttttctgtatctgatttccttcagcgtggaggatctcagctagcagagagaagctgaggcttggttctgccttttactctttattcccactgacagtacaggatgctcattaagttgccttatggctggctaaatttgatattaaagttggtactcaacattggtactaaaaattaatggtttcagaattaactcctgggggtgttctatgaaaatgaaaaaaaattatatgtagtatattaaagtaattcatcctgtataatgggatcctggagtagacaggctgtgctaagcacatttatctgagagccttgagccaactgttaaatttctgtatctgaggtatatataatatctttatatatatcctgtctgtacacacatatattaataggtactgtattgttagaaattaaaattttatctaattttataagttcttcccagtgacaggtaataactcagaggttcaatatgtgcgtgcgtgtgtgcatgtgttcatgcaaggggtgacagagagagttgagactcacagagacacgcacaacaggaaagaaatgtgtggaggagctaaaaggctgcgattcctaccccttgccactctgccattcttcctttgtttccactcaggtttgattaatagaaagtggatccctttatactgcattttagtcagaggcctttctgttgagtgaagccattgtgggtaaagtttaggtttctgggttgtgaacatcaaagaaagcacagcctcagaggtacctaatgtaacagaccatgctgttttgccttcagtttaggatttatcctctgaatactcacctgtgttttatcaaagataatgtcaaataatacaaactgtgaggctgccaacagcttcttgttggacggttcttctgttgtggttctaagagttcctttctggaggttttatcaccttttcttcttatcattctaactacacacttctctctgaggttttatataagtgcagataagcaaaaattatatgttcctttacaaacgtatcaaagtaatggatgtttaattattttaaccaatttcatcatgaattcaataatcttttgagaatttctgccaaacttactctgatatattcctcgctcctctctgatgaatcaacgaatgaaaatactgttgaacatgtggtctcatcagaattgtgtggggaggaaaacatgcttttacacatgtagcatacatcatatggaaagaatgggtaccctctcctccaccaaaacacttgaaaacaatacaatagtaagttatgaaaaaggaattgtgacaagtgttaattaaaaattccttattaattattactttgtttttcatttttagcacaatttaaagctaagtgtcattatgtgtttggttaacagtaaaactgtatcttattgcaaaggaggttgaggcatatctataaataaggatcacaatctctagttaattttaggccctgattttcaaagctttagcactgctgatgaatttgtttttattgtcactgtgtgagttttcaggcacataaagttcagttaaagtcattgagcaggcagctctcttttgagcactcaactcttttttacagttgggtgtcttttataattgaaataaattattaaatccacaagccaagttgttagatgtaaggttattaatattttgtttgttatgtatttttaatgacagatttatttaagaaaagaacaatgaataccaagggtatattgagttgagtgacagatagctcggtttcttccctgccaggctcaaatcacttggatgactggattggtgccatttttctttatataccctttgtagtcagcataatgtttgactcatcactggaactctctaattaatgaatgaatgcagaaagggattcaggttcagttaaagcatttactcactctgtgaccttgagtaagtcactaaatctctttctcctctaatatcatcatatatattatggggttggtctagtttatctttggagttcctccaacttctcatgcagtttattggattttatgagtcagattatatatctaagaaataattatggaggctagaaaactactgtacatattttcatttttgtgttgtattatagagaaaaatgagtgtgtactatggtatgttatgcagtatacaaaattttcagtattttggatttcaaagtattatctagaaattatgtaatgtgacaaagaaaaagatagagacagatatatagagatatagataaagaacatttgcttatgttttaagaattaatggttggtttaggaaaaccttccataatcataaaaagatgaaaaaagataagagttatttacaggattcttgagtagtaaaatcaataagagagggcagatgtaagataacttatggtcaattgtaggcacttaaaactgaagacttactattaaattgctaactgagggccttgaagtgtgatgttgcatgagattgtgtgtaaggatcatttgctccactttatgagtctgtcactttaaagatcagaactgttaccctgtgatgctcacatttggtctggtttataggacatgtgccagctggctaggctaaatgaaaatgtctacttcttcaacaaacttgtaatctatgatccttactctacttttctaagaaagattactgtggatgtatggtagcatcaatgtctaggaaacagaggtgatgtacattacctggcaattaaattataataatataaagttgacaaattcacatgctccagtgcccaatgaaactttagtctctctgagaatagtaagaccaattattctatagttctaagaaaaatggaacaaagacactataattccttccagaaatctctgtagtaaagataaagatcattttactggaaagtaaggagggataattcacttataagaattacagttagcgccctgtatccatgggttctgcatccacagattcaaccaaccatgaatcaaaaaagatttttaaaaagaacaacagtaataatacagcaataaaaataacacaaattttaatatacagtataactactatttccatatcatttacattgtattaggtattttaagcaatctagagatgatttaaagtatacaagagaatgtgcggaggttgtatgcaaatactatggcattttatataagggactggacatccacgaattttggcatccacaggggtcctggaacgagttccctgtggaacccatcccttgcggatgactataatttagtaaaacttttacatggaatgtagaaagcatacctttattgaataaaatgccctccttgaaaagactttattaatccaaattttgattttccaatttgtaaatatgtaaagaataaaattcttaactctatttgatctatagaaagcattagcatatcaattcagaaccctatcttccccagtaaactctgcaaatcccccaatatttcatttattcgtttaactttgttcttttcctcttacacacacacatagaaaatgactactgaagtttattacaaatttcaaaagtctttgatttgtgtacatatttatgcacaaggccttatttataaaggtatgtttcatttcttttggataattatggaagactgggctggctaaatcatgtgacttttacacttctaacaaaatgtcgacatgttttccatagcatttgaaacattttgtatctctgcctgctgtgtatgagaactctagtttctttatatcttcaccacccctttgtattgtcagtctttttaattttttgccattctgataggtatgtaatggtatcccattgtggctttaatttgcatttccataaagctaatgatgttgagtgtcatttcgtgtgcttatattccatatgcatattttctttggtgaagagtctatttaaaggttttgtcctttttgagcggggagattatttttttaaactatggaattttgaaagttctttgtattttctaaacacaagtactttatcagattataaatcaaatgatttataaatacttttttcccagtctgtattttgcttttcattctcatattagaatcttttgaaaagcagaattttgaatgttgatgaggtccaacttatcaatttaacaaaaattattgtgcttttgctgttatacctttgcctattcaaagagtcggggaactttcttttaaggggccagataataaatagtttagactttgtgctccatacaccctctgtgatatagtttgtatctgtgtccccactcaaatctcatctcaaatcgtaatccccatgtgtcaggggacgaacttggtgggaggtgattgggtcatggggacaatttccccatgcgtttctcatgataatgagtgagttctcataagatctgatgatttaaaagagtgtggcacttccctccttgctctttctctcttttctgctgccatataagatgtgccttgcttttccttcgtctactgccacgattgtaagtttcctgaggcctccccagccttgtggaaatgtgagtcagttaaacctcttttctttataaattacccagtcttaggtagttctttatagcagtgtgaaaacagactaataccgtctgcctcaactaatcatctctgtagttgtagtgtgaaagcaatcacaaaaatatatttaaatgaatgagtatggctatgttctaataattaaaatttgaattttacataattttcatgtaatgaagtagtatactttttccattccactaatcacttaaagatctaaaaaaagattcttagttcatacataatagaaatacaggtagagggtaagatttgtcccattggccatgggtaggttgccaacttttctcctaacccaaagtgacaatgattttgtcttatgttttcttctacaaattttatagttttaggttttaacattgtctataatttatttttattaattttgttatgtgttccaaagtacgagtcttagttcatttttgcaaatgactatctaattgtttcaataccatctgttgaaataaccatcctttctctattaaattacctttgcacttttggagaaaatcatttgttcaaatattctcccccaataccattgagaattacagttaaaaatgcattactaaattgaagtagcccaatgctcttcacattttaaaatgctttttctctgtgttcttcatttttggtagtttcatttattccttgaactttgttcttttcctcttacacacacacacagaagatgactactgaagtttattataataatacacatagatgattgctatcctttctcaagctcatgaaaattttcctgtataatatttaatctgccaccatccaattcaatgtatttttcatatcaggcattttagtttttatctctagttttatttgggcctcctaaaatatattccttatttgtatttcagtatttggacatatagagcacagttatattcactgttctatgtccatgcctactaatgctaacatctatggcagttctgagttgattttgactgattggtttctctctctattatgagttgtatttccttgcatgccatgtaattatttttttggctgccaaacattgtgaattttatcttttgcatgcttcatatttttgtattcttattaatattcttgaacttttctatgggacacagttaaattattgaaaaacagtttgatccttgtgagttctgttttttacatttgttacatggattcagagaagtgtttaatcaaggtctgatcattcctcactcacacttgtatgtatacacataccttggaaatattgtggatttattccagactatagcaataaagctaatatagcaataaaatgagtcacacaaatgttttgctctcccagtgcatatgaaggttatgtttactctctaccatagtctattaagtgtgcaatagtggtatgtctaaaaaacagtgtacataccttagttaaaaatactttattactaaaaaatgctgatgatcatctcagccttagtgagttataatctttttgttcgtggaggatcttgcctcaatgttgatggctgctgactgatcaggatggtggttgctgaagggtggcacccttcagctgtggcaatttctcaaaagacaataaggttcactgcatctttcacgaaagatttctctgtagcatataatgccatttaacaacattttctccaccatagaacttctttcaaaattgtggtgaattctctcaaaccctgcttctggtttatcaactaagtttgtgtaatattctaaatcctttgttattatttcctttttttcctatattttgagacagactctctctttctctgtcactcaggttggagtgccgtggtgcaatctcagctcgctgcaacctctgccaccgggttcaagagattctcatgcctcagcctgtcaagtagctgggattgtaggcatgcaccaccacacccggctaatttttgtatttttagtagagatgagtttccctatgttggccaggctggtctcgaactcccaacctcaggtgatctgcctgcctctgcctcccaaagtgctgggattacaggcatgacccaccacacccgacctctttgttgtcatttcaacaacattcatagcatgttcaccaggagtagatttcatctcaaggaataatgttctttgctcatccataagaagcaactcctcatccactgaagttttatcataagattgtagcacttcagacacacattcatgctccacttcaaattctagttctgttgccatttccacaacataggcagttagttcttcctctgaagtcttaaatccctctatgtcatccataaggattggaatcaacttcttccaaactcttgttactgatgatattttgacatcttctcctgaatcacaaatgtttttaagggaatctagaatggtgaattttttccagaaggttttcccttttctttagccagatttgtcagaggaatcactatttatagcatctatagccttacaaaatatatttcttagacaataagacaggaaagtcaaaattactccttgattcatgggcttcagaatgaatgttatgttaacacgcatggaaaatctttgtatgtacatcttcctcagagttcttgggtgactaggtgcattgtcaatgagaagtaatattctgaaagaaatctttttttgagcaataggtctcaatagtgggcttgaaatattaagtaacccatgctgtaaacagatgtgctgtcatccaggctttgttgttccatttgtagagcacaggcagagtatatttagcaaaattattaagggcccttggattttcagaatggcaaatgtgtgttggtttcagcttaaagtcaccagctgttgcattagcttctactaagggagtcagcctgccctttgaaacttcaaagctaggtattgacttctcctctttagctgtgaaagtctcagatggtattttcttcaaatataagactattttgtctacattgaaaatttcttgttacgtgtagccatctttatcaattatcttagctagatctcctggataacttgcttcagtttttctatcatcagtacttgctgcttcaccttgcagttttatattatgcagatagcttctttctttaagtgtcatgaaccaacctctgctagctgtcaacatttcttctgcagctttctcacttctccaactttcatagaattgaagaatgttaggacactgctcaggattgggctttggctaaaaagaatgttgtgaatggtttgatcttctctgcagaccactacaacttctttcatatcagcaataaggttgttttatttttctatcattagtttgttcaatagattagtaccttcaatttccttcaagaactccttttcattcacaacttggctgtttgtcattaagaggcctatcttttagcttctgtgggcttttacactcttcctcactgagcttaatcattctagtttttgatttaaagtaagaggcatgcaatactttctttcacttgaacacttacaggccattgcagggttatgaattgggttaatttcaataatgtgtctcaggggatagggaggccagaggagaagcagagagataggaatactgctagtgaatggagcagacaatatttatcaattaaggttgccatcttttatgggcatggttcatgctatcccaaaacaattacaaaaaggaacatcaaagatctcggatcatagatcaccataaaaggtataatagtaatgaaatcatttataatattgtgagaattaccaaaatgtgacacagaaacatgaagtgagcagatgctgttggaaaaagtggtgcagataggcttatttgatgcaaggttgccacaaacctttggtttgcaaaaaactcagtatctgtacaataagctaagcacaataaaatgaaatatgttggccaggcatggtggctcacgcctgtaatcccagcactttgggaggccgaggtgggcagatcacttgaggtcaggggtttgagaccagcctggccaacatggcaaaaccccgtctctactaaaaatacagaaactagctgggcatgatggtgcatgcctgtaatcccggctactcaggaggttgaggcaagaggatcacttgaacctgggaggcggaggttgcagtgagatgagatcatgccactgtactccagcctggacaacaaagcaagacttcctctcaaaaaacaaaacaaacaaacaaacaaaaacatccacctaacgccccatgaatcttgaggttttctaatttggctggtgggaacaagcatttttccatgtcatgtgcgagcaccaaatcccatgcctctactacatttggatagttctttccctgacctcaggagatttggtcacacatgggttgattggcactctgctaaaaactgaaggggaacttttgcaaatggcctttctctctctctgtgcagctttcttctccctggtgttctctgcaaaaaaactctagtcatcttggtctccctggactttcatcttcatttcctaaaacccaagaattttctgagctctactttggttttctgtcctcctgtttcagcctagaaattcttacagcagtaaaatattgcaccatagggtcatccatttcccttttgttaaggatctctgttctttgttgcctgatatccagtgacttgaaaactgttgttttagatggagtttttatttcattttgtttcttattttttgttttggttgtttcttgtgagatggtaaattcagtctctgttactttttcctgaccaggattcaaggattaagttttgttatgtattaattcaattaaaggtattttttgtgtttttaaaaattatacattggagatgccaagacataaaatcctataaaatagttaagtgtgctgaaaattattttaacatggagtacatatatgggatatgtaaattaaatattataaaacaggttaaagtaatatatgattaactgtcaaattaaagatggtaaggaaaagaactcaaaataagaataatttattgataattatatgtttagagaccccttcatgggtctctactatcatcatgaagatgataatacaggaaaactcttgatagctggtatggaatattttcataaagtccttttatgcaggtaaatgacattatataaagatgtgttgtacaaaatgattaatgaagagattattttatgtcagaggacaataaaggattaaatgtttgaagacatatgtaaatatcagattttagaaactttaagtttgtctttttatataaaggcaatagtaaaccattaaaatttttggcattcatttgtaataagatggtgaatgccactttgaacaagaataatcaggaggaagtgacaaggaagcaaatactagacagactagaaagaaaactattatacttaatcaaggtggattaaatcattgtaacaaagatgaaaagaaaagacagagcagcattacattatataaatttccagtagttggtgactaattatatgcaagaatgagaatatgggaaatttttaagatgaatgaaattttaatagaaagagcataatgaaactatcaacagaaaaatgtaacatccatagcctataaaactaaaataaaagaacccaggaaaaagtaacggcatcatcataaaatataaaaaataaaaaaattatgaagtgtgcaataagtgccagcactattaagtctttacatggaatacttcatttaatcactacagcattattatcagcttatgtgattgtctttctgtaatttaaaagtaagaaaataagtattctatccaagatgataggaagtgatgggggcaggatttgaatttcaatatatccaacttcagaatccagtctcttattacagataattactaaaacgttataggcatagttttaaagaaaatgtattgggcaggagtttgtctaacactgtatatgaaataggaaaatatagttgatttgtgtgatatccagccttaaggaaaatttttgatagccgtaagtaacgactactctcacagttctgcctatcaacaatctaagatagtattgcaatgttctacatatttaagtgtcgattatattaatttttcatttgggcataataatattattttattttatttatcatgatttggccactaagccaaataaacaacaacaaaagaatttaaaaatattaatgctagtacttaccaggacttgattcacagtacatttatgtcttcgataattgggattacttaactttctttattatttagctactcagtaaatctaattgacaagaaactactaaagtctcaaatctcataatgcattttctttacacaatggattattatttttttaatcaggaagatagtattactccagttatatttgttttctgtaataaaagagttatagttagtgtcactataaactactcttacagcctatttagaattgtcaaaatatcaaacttatatgtaaagttatatattaatatgtaaagtatatgtttcaaacttatatacgtaaagtttgatatattgacaatgctacacacacagagacatacaacacacagacattcacaacacagacatacaaataaacacacaaacacacacacaaactaataagcagagagaaaatggggggactgaattacttagtacatgctatgttacagacaccatgctaaacatttttatttagattatctcatttattactttaaacaattatctttattgtctgaaatctgcccaatgttactcaggtaataagctttggagccagatttcagcctttgatgtctgacttcagagttcaagttcttaaccacaatgtcatacggctctgtactccaagatatactgagtcactatagtgtctgccatttattttaataaaggatatcctgtgtggtgaggccaatttttaaaaagggaacctctcaaataaaatgcacgcctgtttctccttaccatacagccatacctgttctctagagatctctgagtttctctttcctcaccttcatttctgagttacctgatttgtgagacatggttataaagcaaggtagctgatgtttccatgaaagtaccacagatgtcttcagcacttttgtctccctgaccactctaaattaaatgcaatagcaacaaattctgatttttgcttaaggtgatttcacttttcatagtgcttgtcaatgatctagagtcaaacctggtggctaaaagaaatgaccaaataagaaataccatttagggttaaaaatacatgagtcatggattttaagcaccaaggaagtattctcatgtggctcataaaatgtctctcatggcgatgcagaaaagaattttcaaaaatattttgagtgtagcaacattgtaggacgaatgtacagccttctcaatctttcattttaaagctgccacaataatttggatttatatataatgggaaaatttttgagaggaaaagctgataatgtcactttttagtaataaaatatatgtctactcctaaaagagagggcattttgtgagctcactctgagactaaacagagactagtacattactagacacagggggttaataaatgtctttcagtaataaaattggatttcatattaattgaactgaatcacatgacccctcaatttacatatttaagtattttcactcctcatgttggtggatgtttatgatgatttcagcaactattttcacagaataattttagttatctaaatcttaaatataaaatgttaggtcactggaaagtagtgtaaattgagagttaagcatacaatatcagaggatacttatttggagttgcaatcctgacctctttcacaaaattgcatgaatggaaatgtattctaattttttattctctaggaagctccacagaatagaacctgccattaaatgatagtccggaatattatgatatgggtgttgataaactctgtaaaagtcagtggatgatgtttaagaaaaaatggcagggacataggaaactgaaaccaatgtgatatggctattttttgaatactaaccttttaaactttgagtgtactcaagtaaagaagggaaaataaaataaaatgtggctacctcactgccttagaaaagttataaattcttcataccacggaaggaatcttgtcctatgcggacaatttatttcatggataaataaataaaataatgttttaaaatgtaaaacaaatttttatgttagaggatggcatagtgtcatcttaataattttatgtttaaatctatgaaattcaaaaaaagttgtcatctgtcattgaaatagcaacctccttcatattctaaaggcaatcatattcatattgtatcataattttacatttttagtagtaactaagatctatttatatggtgacatggttttccctacttacagttcctttcccttcattcataacctttttttgtgtgttttatacagtctgtctttatactttattctggttgatataaaagaccaaaaggtgttctaacattcaacttgctctgtgggaggtagaaaattcttttattttctatccatttgaggagtttgactctatcctaagtcagtagaagctgagagtaaggaactgaggaggtggaaatgattacagaattacagtcaggggcaaagtggtgaaagatattgtatgtgaatgaagaataccatatggtattgatttcatttgtatgtcatgactgcttatttttctaatacccttctctccacatgttttaagatatctttaaaaaatcttcaaaatgtctatattttctgaatttagaatccatagaatccttgcttgctaatactcttctaaagtttagctctatacaattgttattttatgtctcaagttctgaataacactagcattataaaacatcagtattatatggtccagtagcaatattcatttattgtattacaggattatgcatagtaacatagtaacacttgaacttattctttttttattttatttaatttttttgagacagggtctcactctgttgcccaggctggagtagagtggcataatcagggctcacagcaaccttgacgccctgagctcaagtgatccttctacttcagcttcccgggtacctgggattactggtatctgctaccacccctggctaagttttttctatttttttgtagagacagggtttcaccatgttgcccatgttggtcttgagctcctaggctcaagcagtccacccaccttggcctcccaatgtgctgggattacagacttgagctactgcacccagcctcttggctttagtttaaactgtatttcttgcgttttaaaataattttaattgatggtatttgccctccatactccttattgctttttctatttgctatttccataattattattttctgtctattgttcactgtcttcttcaaaagcttctatcccagcaccagttataaatataaatattatttatatattttctctttaattcaaaagaaagatcttaaaatgcaaaacctgatatctataaaaaggcaaaaaaaaaaaagaagaggaagaaaataaaggaggaaggaggatataaaatgagggaagaagagaaaaggaagggatagattattaaattagaataggttgtcacatatagttttattattcctacacatgagtcaaaaagatcgatttcttatacaaaaatatgaaagaggcaatttagtccacattaaaaaattgatttttttctatatcaattatccaggagcattttaaagaaataaccatgtcatgctgctttgattagtctctacaacatatttagaattttttaaaataaagcaactattttttatgacatgaagaaatggaattctcacaccagaaagaaagcaagtgactttagtacagagaacttcctccatacatacaaatagttcagatgactctttgtgcacctctgtgtttttatgtccaaagtgactaaggggagtttaaactggctatcccttcatgtatttctgccaaataatagtatgagctcattctgtgtgggttttgaaccagacttacttttcttttccttgctgattttcaaactattgaacatctttagaccattttcttctacactggcaaactgttgaaatctgtaactaagagaactcttagtctctgttgtatccccagcccccacttcgctactcacttggtgtggaaatttaaaggtccttgaatctttggaaccaactgtggttttccctccaacttttatcaccagcactttcaccagacagcatttcagcaacaaactccccacttcttttctagtccagtatgaactgtatttcagcctcgatttcagccattcttaccctctaccatttattcccaacgtagacatggtgatattatttgttaaaattagtcaattgttgtttctctccacttccctccaatggttttcccatttattcagaattaaagccaaaatccttacaggactttgactaccatatacaatttgacttttgagactcgttactcaccccatcagtcctaccactcgaggcacactagaccccttgatgttcctcaaatatatcctcacctttgggatttgccctggctgttcactaggccaggaacagtcttttccaggtgtctgtatgactaatatcctcagctcccttaaatgtttgatcagatcagtggtgagctgacttttattcaaaatattccattcacatatcccttctttatcttcccagtgtatttttcatttttcatgttaattattatatcatacaaacaatgtaatatgcatatttattatgttcatgatagtttgtctatttccttttcctctctcccttttcctgttttctgctcactgcatactacaacataaactccaaaagggagaggttctttcttctacttactgattaatcctaagcaccttgaaaagatcatggaccacaattgccattcaatacatatttaaggaatttataaatgcaagtatttccagaggtgtcattaggttaataagcattttattttgatgttggccttctttagccatgcaattaaaagattgttcatttcatggattatttttcaattttatttctgattatttaagactgtgttggcatagcaatttttatgtgatccatgaatatctcctgcattcggaattgttcctattgttaaggaattctccatagatacttgcaatactttccatattctcacaagttttttctttttgttttttaacctctttctattaaaatcatcttcctattctgaatacatatttcagtcttatagttttatacttttcaacatgatgagttatttatcatagcaaataaaaattatcatttaatgaaaaatgtaacggccaagaaaaatattattttgcatggcaaatcatgccatctgttagcaaaatacagaattgacaagctttcactctagttttattctgtgaagacttgcacatttaaagtttacaaatacaggcacttttttgcatccacctgtaaggtagaagaagttacattggattgatatttagaaaatcttaaattaaagttgcttagtgttactatattcttattatgtaatatgaatatgtcatacctccaaaaggtattctttaatatctcctttacctctaaaattcagtcattctatatttgggtttcttgattgtaaggggaaaaaacctataatatgttttctgaactagtgtgtgccaccaattttagtgttgaccccattaaccccttggctgcttccactttcacattatcgctttcccatgtttgactccagtctcccgactatgtgcgttcaaccagactacttggccctattttataatacagagaataaaattttgtgttaatcaacttccttgaatgttttccttatttttctaacatgttatcgatgaaacaccagcttaaatatcataccgaagtaatttttatggaaagttctatttcctagagtaggagaagtaaacagaaaagaaaaggactacatattatgtgcaatgatcataaatggagtcaataggtaagccttcccagatgtggctataaacgtctcatcgtcattgtcgtcatcatcatcatcattactgtccttatcattgccagtgctttctgattgcttactacattccaggcactgttctcagtaccttaaatttaataatgattagtttctaccacggtggtactggggagttaatatttcagtccattacacaaaagataaacctgaggcacaaagagattaggtaatttttgaaaacgtatatagcttgtaaataataacaccagaattctaactgaagtgtctggcttgaagcccatgttcttaattactacgcccatttttatttcatcttagagcaggaaatttaagtcacctcaagacaagataattaactctattgaaatcatcatgaaagaccaaagtagaaagcattagatgatgctatgaatattctgtggctacagtagaattaatgttaacagtggctttcagaaaatttaattttctattttaaccatcttaacaaactttctctaaaagtattaaaataaaattttgaataacaagttatagttgaatgtggcccaaccttctagaaacaaaggaatgggctgtacaatggcagtaaaattaatgatagaaatctcagctctgatacattaccagactctctggcttctccaggctggcttacctaagctcagtctagccatccattcatagcaaattgtgaataatgctgagaaaagccctgtggatttggatctgtttggtcagaaccgtgctgtggtttggctagcttgaaagcaaagagcagaattctgtctttcaatacttgtgaagtggatacttgccaactatgaagttggtccttcgaattggatataattctttgtagatgaagcacctttcatggtttctttggttagggataaagaaaaatgtctcagaattgaaaacacacattaacatagttctctgttattctcacatttcaaaaatcagacataaaattatcaaatttaaaagaacactaatttgacattaaaacatagatgaatatatgcataatgatataagttattactttttgctaggtttcaggaagtttgataaattcctattcctcatgtgcattgactatggtataggttttcaaagctagttctctaaaacaaaaatgttgaaaataaaatctagcataaccatggaaaccaagaaagcctaaaattgtcttgaatgttttcaagaaggaaacataaacttctttgtagccagcatccataactagttttggggaagccttaagattttcaagcgcagagtcttggctaaaaggattgagttgctaaacctaataaggaccaaataaatcaaaacccatgaaataaattaataaaaaaagacgaagtctgaagaaatacaaagtttaaaggcttaattattcagctggtagcattattcaactggttaagtgtgtggaaaaagtcaagaggctaaccacatacaaatattgtctaaatggtatatatatggttaccagaatagtaacagtgctaatgtttgttggattaggatcatctctctctcattttataatttgagacaaggtctctgctgctcaggctgaagtgcagtggcgcaatcacagctcactgcagcctcaacatcccaggcttctacctccacctcccaagtagctgggacagcaggcatgcaccaccatacctggctaatttttgtatttttttgcagagacagggtctgttcatgttgcccaggttggtcttgaactcctgggctcgaatgatctgcccacctgggcctcccaaagtgcttggattacagacatgagtcactgttccaggcctagatcatctcttttggattgtttaccttttttccatgtacttccaaagtttggtttaatatggtaagtttaaccatataagtggaataaaatgtagctgacagttgtgatttacgatagcatctagaaattattgctattgaaaattgactctttagagtgtaatcattaaacgcatagtgattgcctgaatcatctaatgaggtcttggtgattttttaatgttctttgccaattaagcaaccattaagtaatggttgagtgtgcattatatacttggctttgtgataagttgtgtgaaatatttaaaagaaggataaaatggtattaagtctcccttttcaaagaacaaactgtagaagagtacgaaaaaatcctacacatgaaaagtagtacataactgtgtataagtaaagctaagttgcatgatacaaacagtttgattatatgacattaattaatacatgtaaaataacacaaagataagagcaaaatagtttgagaagggttagcaaggtcaactgggaccatcagagatgaaaacataacaagaaattaaaaagggaagctggctataatagtgtgtgggtgggtggtagaggcaggagtgcaagaagaacatcaggaaccctggcataggaagcagctgattatgctgaagtgacggttatgctaagaattctgcttgcacaagttaggtagaaacaactaaaaaggggacacattatttatggactacagccaagggaatttttttttttttttagttttccaataatttgcaactacagattttgagtagagaaatgacattcaactcagcaaacattataaatcctcacctgggttatagttggttatagtcagtataagtggggtgttgagattttgaaatagtggaaaggtttgtgtaaaggaatctgggaataacaattttaatgaaactcggtaatcttttgtagataacattgaattaacgaagaagattcatactgaatgcatatataaaatggattagatgacaaaggcaatggattcaggaagatattcagtcttttcttagactacttttccattatgattgatcacttcttcctaactacagcatctgggaggcaaacagaggaagattctgagaagtgttctagaagttggacagtaaaatgagagagtggtgtcttagaagccaggattaggaaagctttaaagatgaagaaagtagtgaaagtatcaaatgttgcacagcagatcaagtaggctgagtgaagaaaaagagcctttggatttagcaactgggagattatttttgacagtatccaaatggtttcattgaattggtaggagttagagaatgaatgggtataagaaagtagaaagagaaagaataggatactctttccacaaatattttcaagacgaaaacttaattgttacatcagcattttgatacggagaaggggaataggagagaatattgttttgtttgcttcgtttaggaaagttgtatcttgagcctatttagaaacctctggaaaagagattaacaaatgtgagagacatcaccttttatggtgtctaacatgtgagaagtagagagggtatgggagagggaaggaataattctgagttttagcctctcaaagtcatgagatgttctattatttctgccttgcactttcaacttcctgccatgtacccacacaggcacacacgctcacatctaacagtacttttactagcctatcccatattggggcaccagagcactaagcgtagctagattaatctactttactgttgttattattattctaattcatttatttgataggcttcaaatagaaatatttttggtttcaggccaaacctatgttccctaggtcaatagtaatatgtcgaatttctaaacattcaagaaaaaaatgtttttagtaaataattaaatacaaatttaaagaagaccttaagagatctttgggcccattccttctttcttctcttttcacaataaaatgccaccccccaccccccacacacaaacattccatttcataatgccattctcatatcctgtggtttttattactacaagttacaaatcttgtgaattaaaacttggaagcaaactaaatgcatcacctcagaattaagattcttataccaagtcaggtctctgatggaaaactcacagggtgagctccacatgcctttaaactctctgttctctatagaaaacagtacaattgttaaaatgttcactgacttctctcagcagagtttttaatgagctggtacctgtatagccctttgagcagttcaggccagggttctttatatataaagcagacatataaaagtaaaaggcaagtgagtaaaaagcataatagtccatgtgagtactaattgtaagggataggaaaaagatacaatataatagctttaaaggaaaaatagaaattgaagaccttatcacaattatccttataatgcacagaataatgtcagactgctttggaaaattcattaattttttttaaagttagtattgatacgaatttttggggtatatcttctcaatgataagtaggttaactgaaaagcactttgatttaggagatgaagtctaatttaaattatgttaaccccttcctttcttattgtatacttagtttttacattttttcatagcctgggtcttacatcctccaaataccttacctattcacctctccaaaaaacagggacacagtctgttaagtaagtctaacagaatatagatattatatataccatgcaatttaatagatactctatatagatgtctatatagatattcataatatatattaattagaagtaaactcctaaaggtcaataaacaaagtgaattccctgataattcatcacctcatgacttgtcatctgtttaactataagagctagataatttaattggaatgcggatgttttatgacaaatatatgaagtatcagcaatagtaaaaaagcaaattttagtcttctgaagctgtcttagcctgtatttttttgaagcacagtgatttgttgcacagtctttgaagccaaaatgcctaggttcttatcctgactctgccatttcctaactagttactccacctttctgctatttggttttcttatctgtataatagtgttcatagtggtactgctataaaggtctgtaatgaagattaaataaaatgctggagcgatacctggcaaacagtaagcattttacaaatggttgcagttattatttaagaaattattttaaggacaaaaagtgtatacatatatgatgcccctccctatgttataaaattaaataaaatgcatttcagattatggattacaaagagaagaaatataaaatgaaagcatttaacgtcaacacatttccctttgttctcctaactatgaaacttgataaaagagtgctgacattttgaagaaatggactttttggtgaatattacaatttctttgttcttgcttttgacatttactatttcaaccaacaatctaagtgaaaccatgcaaactttggtgcctaaaatagggacaaaaggtggtggtgtgatttgagtaacagaggaggattttaaaattctgcattttgtttccatatatatcatgtacttagcctggaaagaaataaattataatcataattgagtcaagatattttcagaattttgagacatgctcaagtttaacattctctccagtgctagccaaaggacccaatggatttagaagattcatggtccaagccatcaactgtctcttaaaattcatgtttattattctggcttagtgaatagggattgtctttcttcagcaaatgccagctctggaattgtttattgagtgtctacatcattaaaacttccaagggactctttgacctcaagcgtatgtttccttggcacagacacttgtattttcaacacttcggagctggcaatataacttggaatattttgtatttaatgtctgaataatatcctgggatttgttgtccaatgtgaaatggccaagaatattgaagagtggctttgaggatgacacaagtaggtatgattttgttgaaaaggtgagaaaagaggggcacagaaaacaaaaacaaaatccttaaagaaaattaaataacaaataaaagacatagaggtagaagtatagaacctatatagtttatcaaatctttgcacctcagttttctatggtcagcacattactccctatgtatttcctggtttcacttctttcaggacttttggtcacatatatttataacctctgataataatataatcaaaatgtaatgtaaacaatattgctgaaggacttagtgcacttaaagattataataatgtttgtctttgatttttatttattaattccatgcatttcaagaaaactctgaagttggggaagacgttttttagagaaagcttaaaatgtgagagttcattcgcagttacgcaattctggttttttttttttgtagatttattaagattttctacatacacagtcatggtttatgaaataaagacagttttaattattcctttctgatcttatctttcttctttaaattgtgtgcattttgcctcagttttttccgtttttagcttgatatatttataagtattattttttcttattatattgatattttcattatacccgttatagtttcttttcttttcaatttttattttaagttcaaggatacatgtgcaggtttgttacataagtaaacttctatcatgggagtttgttgaacagattatttcatcacccaggtattaaccctaatatccattagttattttttctgatgccctccctcctcccacctaccatgctccagaaggccccagtgtgtgtggttcctcaccatgtgtccataccttctcatcattcagctcccacttataagtgagaatatgcggtgtttggttttctgttcctgtgttcgtttgctgaggataatggcttccagttccctccatgtccctgtaaaggacataatcttgttattttttatggctgcataatattccctggtatatatgtaccacatcttctttatctggtctgtaattaatgggcatttaggttgattccgggtctttgctattgtgaattgtgttgcagtgaacgtatgtgtgcatgtgtctttataataatattatttgtattcctttgggtatatacccagatattattattttccttgaatccgttttgtgcaataatagagttatgccaattattttattttacaatatgcatagtaatcttctttaatctttccactttcaaattatttttgtttctaaatttaaagtatctatcatttcttacagatagcatataattggatcttgatttttaaatttaatctgacaaattctgctatatgtttgaaaagtttcattccctcacatttaatttaaacagtacatttggctttaggtttgccatttgctatttgttttctgcttctctcaatgatgtttcgttcttctgtttttcctttaatcttttgtttttgttacactgttagtttaacaaaatgattagtaaatatgtaattttcaatcctccattgaccttcttgcattatctgttcatattttctctagtgatttcaatgtttatctgtaacttattacaatatacttcaagtgggcactaaattacttctggttaaatataggaaattttcataagtctatgtcctctgtaggttccatgctgttgtttccatatgtattatatcatatattttataaagccaaatatacagtcttatgtttactttaaagtagtcatgtgacttttaaacaatttgaaaagagatatattagtgaatggtaacaaaaagtgaataaaagcaaaaattatcacttccccattacacctgtcattccagcctctaagtactacatattgttgtttaaaactgtcagcagtaaaataaaaagaaatattctcttgttatcatggcaggtatatattttttataaagtaaactattcttttaagaatttaaaatttgatttttttagtgggaataacttagaagtaagttaattttaatattaatttgatgctgtatgtacacacacacatgaagaattaatgttgtgtaatacttttcatttgactaggcatctcaacatgcccttgtccatttggttatatttgaggtagctgctatcatggaatttttcacagaagtcaaatatgttttgagaggtcaatttcactatctcaaatcatatagtcaaatttcaaattttgtcaaatttagttgctatcttcaccataaaataatcagcacaaggtcaaattaatgtttgcccctatataaaagctacttttctattttctaaagtttctgatcagtattttaggttttgtttcttctcatagtgatgttagaggtatgtgactaacttttttatataaattatgaggatcacatgggggcaaataagatttttttttcaaacaaagatctttaatagtgtgggaatcaatgctaatgtgatacaaagcaatctatactgtattaatcaaagatccaaagcaccctgattataaagagtgaaagctcatgcaaataaattatgaaagaatacaaatgaagacacacttacatgactgcctcatttccagagcctggtgacagtcctgctgttctcagcatgctgcttcatgatgacctcatcagtaacataagatgcattcagctatctggcacctagatggcagcctacaaaatctaaacacagtgatttcaaatggaccataaagcctggctaaaatcttacaaattagtaatagaaatacctgttacatcatgacatcatttgggtacactcagcaaattattccctgatggaaattatttgaaaaaaatatatatgcagttatgcgttacttaacaacgggagtacattctaagaaatgcatccctgggtgattttgtcgttgtgcaaatatcatagaatgtacttacacaaacctagatagtatagcttaccacatactttggctttatggtgtagccttttgctcctaggctacaaatctgtacagcatgttatggcactgattagtgttaaggaaataataacacactggtattgtgtatctaaacatatctaaacatagaaaaggtatagtaaaaatatggcattataatcttatgggtccactgtcatgcacgctgtccatcattgactgaaacattgttatgtggtatgtgactgtatatattacatatatgtcatatatattttttatatatatggtttgtgtgtatacaatgtgtgtgaatgtgtgtatgcaaaatacttattccatttgttaaaatataatatcttataatgacagtgtatgcctacaaagatgaaggtgaatagaacagcagttaaggagcacggtttgtttctgaatcaactatagtatgtgatgagacgtggtgtaagtgctacagttcagagctcagggaacatgaacacttcagggcaccttcagggattaatgaaagctctttttgtcctgtggatgatagcgattcatacaaatgtgttaccattgatttggcttaaaaatcacatttaatcattttttaggagaatcttccctaaagctaaataaatatcactatcccttttgatttaggatgcttgaaatctgtgaagagaaatttcctttttaataaaaaaaaaaaaaaagcaatcttgtccacttaaccatctcagcttagcagttctgaaagggttctttttcttcaggcctcatgctggatttgccttgcagttagtttcatggagaaaaagcaacaatgctaaaattataggtgccagtaagtctaattgtgatagatgatgcatggtttcagaaaagggatttattcttatttcagaatgtcaaatttagttgacattattccttgagaatggaaagttaggacctggatcccctgaatcatctctaaagtattataagaaaaatctgttccctgaggtacttatcagtcaagggacagcctgagtgtggtgacccacatgtagagtcagggagaatggatgaatcataaaaaggtccacttgaaatgcctttttaaatacttaatataaatgtaaaaggcactccttgaaaaaataacgcaaaaaataagttgccataacccacagcttgcctgggacagaatatgaaaaagaaagcgttcatcagtgctgtttcaaatactatagctggcacgaaagtaggcacaggaggagaaaatcaccctgaattataaatgttgtgtgctattttcatggcaccaggtgggaatgttaacacttaatcagtctctctggcactatttcccatccatattgccagctttatcaccatgaaagatgctttgatcctcttctgtggtgtcaaaaacaacaggccacagcatcaatgacattccaatcagtggggcatcactgcgcattagtttctatcagatatgacgtttcactaacgcattttgacaacatctggtacaatacagaggtctttcagagtatacactgtatatatatgtgtgtgtgtgtgtgtgtgtgtgtgtaatatatatatatatatatatatatatatatatatagaaaagggtatatacctttttcctatgccctaaaaaggagattaatcacaaagcacttctcttttactgttgtagattttgaaagcaggaggaaaagttctcttttaaatatgctacagttttctctttggtgatacttaatgctctcttatggaaaatgaaattcttagatttctaacatactggagagttaccttatgttaaaacaatgcctttgaaaataggcattgttaagatttgcacggaagtatcagttgtgaaatataactgttgtgtaatggcaaaatctttcttttagtaagtacctcctttgtatcagacactttatgaatggtcatttcaatgttcacaaccactctttgagggagatatttttgtactcagtataaatatatgaaaataagttcagagaggctgaataacctttctaagatcacttagaaagtgtccaaactctgatgctccctgagatccaacttaccgtaccatatccatcctactgccactcaaggctgccctcctttttaaaatctacttaaccaaacgttaaattattctataattagacaaatagaaatttttggccataattaaaggaaaaatgttgcaacatgatatcaaatgatggttatagaaaatcagattaaaatagttcaaaacatctcaacaattagatttttctcttggtttgtcatttcttttattgtttactgataaactcactaggtttatcagctagcaggaagaaagacaacaggacttttcctattgatgtggagcagatgcaagatagatctggagcacaggaaaatttcagatctggatgtgtttaaatctggccctgcactgccaataggaagagcatgacattactggcaaatgggggtggagagggatatgtgtaaatagagggataaagcaaagtagcaaaatattataaaatgaactcacaacatactccctgattccattaaggccagtcttaatctctatctataccatgataagctgtatcttgccatatattgacctgaaaagttagacctatgatatattgtaggtaaaaaacaaataatcatttttgcagtataacatcaaagaaatgttaaaccttcctcatttcctgccccaaatgtacacattttaaaaagtaatgcaatatatttatattaatatattctatccattcaatatataaaagttagcctagacacttttatggaatatttttacaataaaaaagttagaaagagaacattttgtattagatcaaaaataattcaaagaaatgaggtaatgcattcttttgtatcacttctacataagcaatagtctttgaggtttctaagtggcttaaaaagagatttgataagttaaaatattgtcttttctcattttatagccagagaaaaatagtacttgtctggaatatatataatattgcacacggggttaattaggttaggaatgaattaatttgtaacaatttccgttatttgacaggcatcaataatatagcagcatattacatgcgttccagacatcagcatacttccatgacccagtcagattcaatttggaaaaaccttggatcatatgaatattttattattgatttttgtaacatcatattttacaatcagttctggtcataaaagaccataataacttgaagagatattttagaaagccatattgttgatgaatggaaagtatgctttctgcagtgaaaagaaaacttactgtctttttcctgagacaaaatgtcaaggtataatttgtactttattaacagctatcaaggaagttcattttctgagcaattttttcatcctttgatttgatattttgggtgtggggcatgggggtatgatgatagtttgtatttcttggttgtcctggctactttcaaattcttttcatttcagactattttctgttgaatgatttgacttctcctaaaaatctttccggtatcctggccctcaatcatttgcacataataatccaataaagtatcaaagtttgcagtaaatggtcagacggccggccagcttgatacagaaaggttatgttgatggtacccatgtttaaatgcatttcatttccaaacacatgcttacattcagcagaaacctaattgtagaacttttgcttatggagatgctaagcataatctattgaccacgtataaaaatacaataatgacatctctaaagaatggtagagtaaatcacaagacttgatattagttatgagttttcttatactgtctgtatttgaaaatgtgtaatacttgacacaaatactgtgttagttacatttaaacaattttgtgaaatcagaacacacacacatccttccccagaggagtgcaaatattgatgttctgtaggctcaaagaatgattgctcaaatccacatttccttggttttcttacttaccatatgttattcagaatattttgctcttagttatgcttttgatgaaatcattgatctctactatcagtattcaccatttgtcattttctgaatctccttgccagtatcacttatcttttctccaggttccaaaatgtaagcaattttctgatattctggtctaaatgccattttcttcttttactcctttcttttctactatagaacctaataacttctggggagaaagattgagagtaagagagaggagggagaagagaagtaggagcagagacttatatcatgccatgacatgtatactgagtattatcagtgcacaccaatgccccacacatgtatgcatgtatgtatgcatgaagtttatttgtgtcaatgaataataattaccaattttgtattaggcagtattaggatatccgatacacaaggatatataggacataattcttctcactgaatttacagtgtaatagggccaaagccccgaagagagctaatgacaatacactatactaaaatagaagcatgcacagatgttaatattacaaacaggagagctgcgtagtcaccagagagccagaaagagtggtgaaaaaactgaagctcatagaagctcagcacaatgactatacccatcaaaaccctatctagaggaagggccctctcttatggctcaatttattctgtcaggagagagccttttatcgtttgtgcaaaaactgggggcctcagatgacctaaactgatgccataaaatgttaaaatagctcctctctcttttaatttctaagctattatgtgaattccctataattaaaaattattagtggttttcagtagaggctcatggtgtaacagcttgatcttaatgtgctttctataactaatctggaaacttttaaaactcgtgggcttgtttttaataagtaatggtatatattttatataatgctatatacaataacagaacaaagtggtatttataaatgccttacaggtacctacaggcaaaacaagtatgtatttaagcatgagttttttcagaatgttcacaattctgagcacaagacaatttctgatattgaaaaaaatagcataattctaagaagaatgacttattctttagtcattgctagtcaaaactagtcttactagtaatatatagaagaaagatatacatacttgcaagaacaaagaattcaaaaagaaaataataaaataatgggggaaaccacatgtaagtgccagctcctacagttatcttccatgacacccaagcctttcacttcctctggtgcagcagcatttcagtggcctccagctgggtcagaatagtgttcatctcgtgctattctctagtgtcccaaaggtgtttaattttcaagttacagttgacacagaggaatagaattcagcaaatgcaagaggaacttgagataagaaactaaaggtgactacagggatattatcttcgctttaggggaaacatattctccaatgtaatcattgagccatcttgtgtcatcttctaatcctgggagatgagtgctaaatagatgaagaactctatttactctaggatatgagattttaaatgaaacaatcccatggactttttttttaagccatgaggctacatggcaagattttttaaatctttgtttacacttaattatatgcctatttaggatcttgattaacaaaaattagatattagattgccagcaatgaatgtagatgtaaaacaccacaaaaatatttgaaagtcttttataactcctgaaaaattgttactgaaatattcaaaatgttactattcaccaaaattaccctattcatgtgatgagtatgtaatgatctatctctctcagtagttgctgtgtattcctctgtaatgtgaaattgagaagattcctaagacagaatcaatatcatcttggctactgaaaagtcactcctgtgtgtatagtaggtgatagaggaagaaatgatgggctatgtatattttatgagagactgcctttttttttctctctctctataacaaagttcacaccactggcttgttgtatgacactgttcctggttttcagtatattcacacatgtatgcggagtaaaatatagtcaaaagtacatgcatcccttgttaaactgacccaggaacaatttgttagcttttttttaaggttctatgctgcgagcataatggaagcagcatgtgagttgaagaaggaaggtcttttggcaagtccttctccaccatccattggctttgagatctgggactagttcttaatgtaagacactagccagctaaacagtgccgatcagaagtaatatacagatctgctgcctcctagtctgaagctattccttttcctacatgaaaaatgccattcaataaggaagctgtgcctatatacttcaagctcatttaaaataacttctgctctaagaaatgttctgataccactccattaagtcagttctgaaataccttgggtacagcacttcctttaaatgtctgctattcctttagaagcaccacaatattctccttctcatttgctgattacttgtgagtctaagaaatgtttaacttattaccaagtgcgagcaaatagaaaaaggttggaaagaaactgaaaggagcatggcagagccttataaaccagtggggacaaaagagcatatttagaattataaataaaggtactgtatataaaattgaatcctaaaatatgaatttaataaatgccttaatagcaacagattgaatgttgtattacttttgaagaataacaagaaaaagaaaatttggttaaaataacattctataaatagcattaagcttcttgataaaaagtcatttacaaaactgagctgctgcttctagtatcatggtatttagatgtataaagatgttgtcttccattactttaattctataataccttatgcagcatggaaatgaattatcttatttctgagcttgcatttggtataaagttaactttagaagtttggtagaattgtgtgaattctggtacagattattcaaatgagtctacttcagtggaaaaatccatggaaaaatagtaactgcacacacacacaaacacacacacacacacagaggggggttggagagagagagagagagaaaacagtatatacttatcgcattcaagagagtttcctatttggcaccatggaattattcaagtatccattgagtctttggaaataatgctatgatcacctaaaagagcctgccaattattgccatatgtgaatgtggtttttataatctggatacttatgccctaggatttggactaatagctctaacctttgacttctcattaactgctagaaaaactatgagacagaggagacattggtcagtgtcaacatgatataaatttggacaagtggctgaaagttgagaggattagtatcaccttagcgatggtactgtacttactgagaaaaaagactgggaaaactaaagtatttgaaagtcatacatgtttggaaactatgtaaatgaaggctccttccaaaagtgaggacgagatgtagagggaaggcagccaggtttggaagtgtttgctagtgcatgtggcagcctaagaaataaaaatttataattgccagtattgggagtgggaagagtgtacctatataaaaaagcaaagcagctttgagctacaaagtcaaaggtaatcatttcaattacccctgaggagatccattcagctttggtgcttttaccagcaagtacaaagatttcagagcatggtaaacgtattagatatatgtgatcagatggcctggcatatacaccaagaaccaaaagcaaaaattgctttgacttgtctaatttgttaagttatctagacatagtttatctatggaaatctctaggctcataaagtagggtgtggcaaaggacttgccatatatctattaataacatacttggaaaagaaggtgctcttttgtgatatatctttgtgaattatatttaaaaagtataattttaacagaaaaggatgttggtataatattccaagaaaaagcaaatgtccaatacatctccaaaagtagaagactaagtaaaggcaaatgtggtttaatattgcttaaatatattgacacatctacctatgttgcagattttaaaaatgtttatacacaatatgtaagcatttatttatataaatgtgtgtcaatacttactaatttctaatatgctaatgtgtattagagaatatttatactcacatgtaattcctacaaaatcctattataaagttttcactatccccattttacagacaaactaaagcgtgaggaggctttgtaacttgttcagttacatatatagtaactggcagagccaagatttgaacctgagcattctgaacctgggctcttaacaattaaaatgtgcagatcaaaataatatctcctattgatttaccagcattgaggatgcactttaaattgttggtccaatagtcatgacatgatttttgttggtatgatcataattttttcttttctattttgttataaatagtatttattagccaacaacaacaaaaagcttatattggagttcttaaaacacaggctttctatttttgaagacaagtatctggttcataaagaaatcaaaaccagtattctggtttaataagtactatattctaagacaatgaatcgctcaactcagtaaagatagtttatttttcttacgtatcagtaacgtgaaagatttctccagcaatattttattgaattatttttacatagaaattatgtatttctagatcactttggcttctctagaaatccatatttttgctaaccaacttcatttagtgtcaataaacagaagcctatgtgacaaagaaaactaaatgtggcatttttcataacatgaaaatattggaatccatttttttttgcagtacaaatactataaataccacacgatttactacagcaaatgctaacttggcatttcctattggctaactcaatgtaacacatccaaattataactcctgtgcctttgctcatatagccattccttctgtaactcaaaaaataggaatagttcccaactgctcaatgtggaactttagatgtcagtctttttttttttttttttttttttaatttttgagacaacatctcactctgtcacccaggctggagtacagtgatgcaatcttggctcaccgcaacctccacttcccaggttgaagcgattctcatgcttcagcctcccaagtagctgggattacagatgtgtgcaaacatgccgtgctatttttttttgtatttttagtagagacgaggtttccccatgttggccaggctggtctcatcctcctgaactcaagtgatccacctgcctaggcctccaggcgctgtggctcacgcttgtgctgggattaaagacatgacccacagctcccagctagtttatttttttattttttttattttttattttttttaactagtttatccagatttattttttctacttctattgctatatcattggcaaaaattacatatatttaaggtatacaatgtgacaatttcttatacatacacactgtgaaatgattacaaaaacatatctatcactacacataattaccaacttttagatgtcatcctatttttttataatttcaagttttattttagattcagagcatacatgttcaggtttgttatatggctatattgtgtgatgctgagatttcggatatgaatgatcccatcaccaagatagtgagcataatacccacttaatttttaaacccttacccacctccctctttccttgccattggtccccaatgtctattgtagccatctttatatttgcgagtacccagtatttagctctcagttataagtgagaatgtgcactatttggttttctgttcctgcctaattcacttcgcataatggcctccagttgcatccatgttgctgcaaaggacatgatttccttctttcttatggttgcgtggtgtcccactgtgtatatgtactatattttatttatccaccactgatgggcacctcggttgattccatgtctttctatagagaatagtattgtgatgaacataagagttcatgtgtctttttggaagaatgatttattttatactctcttccactttgcactctgcatcatctaaaatcttcatatcatctacataatgtatctcaaataaatacatttctttctatgtccataatcacttctctacctatgtcttatgatttcttatttagattatttcagtagtttcccatctgttccattcttgactcagtttaatacattttcccgatagaagcaagcataatctctttgaaatgtaaatctgattatggtgtacctcatgcgtgaaacctttcaataacccctgataacacttaatgtagaaaaacaagccaccttaatataagcctgaagacatggcatggcctaattggcctgcatgtgccaccaaattaatctgaggccctcatatcatttcttttccagctatactctttttctttacctttcatttactctccagttctttcctgcctcaagacttttaccctagaattctctgccttctactttattttttccttttacatatcatgtgaatactgtagtactttgtacatatcacagaaaatgatagatctcttttaaaggttagacactgtacataccataaatattattcaactggaaattcacttactccatttcttttctatgccaacttaaatttttatttaataaaaaaagtttccttagtaaatgtaactcatattttcctttatttttgtgatattttctttaatataattaagatttatatacagttaagatattatacatattaagaatttttaaaaatgaaatctttaatataaccaaagattatattaaagaatacaaaattaaaatataattaaagattttgttttaaataaatgcttataggacactgggaagtcctttttttctggttttaaaatgtgattatgatgatcattaattatatatattattatatgttatgtacatattacatatattatacagagttgtcccttggtatcaatgaaggattggttccaggacccctgaggataccaaaatccatggatgctcaagtcccttgtatataatagtgttgtatttgcaaatagcctattgcatgcttccatatactttatctctagattacttgtaatacctaatacaatgtaaatgctaataagtggttgttatactatattatttagggaacaatggcaagaaaaagatctgtacatgttcaatacaagtacaaccatcttttttttgagacaagatcttgctctcttgcccaggctggagtgcagtaatgcaatcatgactcactgaagccttgagtcccctggtctcaggtggtcctcccacatcagcctcctgagtagctaggactacaggcaagtgccaccacaccctgctaatttttgtattttttgtagagatggggtttcaccatgttgcccaggctggtctggaactccagagctcaagagatccacctgtctcagcctcctaaagtgctaagatttcaggagtgagccactgcacctggcccttgactagccagttttttttttttaaattgatctgtggttgattgaatccatagatgcagaacccataaatacagaggccaactgcatttctgtatttagcacctaatgaaacacataaatatctttacaaatttgtccatcctctttctgtttttttaattcggaagcttcttgatggattcatagcatgagactgattatttaaagggaaattagacctactaagatatatgtgtttggttggaccaagtaattgggcataggacatgtgataatggagaattgctgtggagagatgaaagaggcctccattcttccctgaaagtttttcggttgccttatataagccagtcattctagtacatggtaagaaataaaggtaaataaaagaaagatgcccatgaagtgcacttaccttatctatcacactgcagtaacataataggagtggagttttaaacacatgtagaatgtgctttctacatgtgttttatgaaaacatgattatactgtcagtgtttagagtgacaagattgccttacaagatatatcaattttcaactgaatatagcacactgttttagaaagaagattttcaggtagttgaaatttttatctggcctgtaaacacacagatgatgaaatgttaaggcagttagaaatgactgctagaatatgagttcaaatgattttatagaatacttccatgaacttgcctagtcataaaaattttcttttcagatatatccccacactatgtatcatcaaataaactgtaagcgctaagaaaccaagacttactcagaaggaaagtggtacagactctatcatgtgttatactgagggcacgttaggtgtactattagatgtgtttttccagttctaattgacaaaagtgttattggtttgtaaatactttatttaattgtgccaaatgtataatcaaattggtaggtgcagttgggggacagtatggaaagtttttttaggcatcttttctgaagtgcatcaatatacccctgaaagtcttgagaactgtgctttttttttgtttgtttgttttgtttttctctgtattgctttcagatacatggtacggacacatagtagggcgttatatctgtaaatgccataaactgtttctgatcaaaactcaaagaacttgggaggctgaggcgcatggatcacttgaggtgagaaatttgagaccagcctggccaacatggtggaaccccatctccactaaaaatacaaaaataagctgcgcatggtggctgtcacctgtaatcccagctatttaggaggctgaggcaggagaatcacttaaacccgggaggcagaggttgcagtcagccgagatcatgccacggtactccagcctgggtgatagagtgggactccatctcaaaaaaagaaaaaaagaaaaaaacagaaaaaactcaaataatttatgcaatctcactttattactttattctgtcagacgttaagcacactccactaattttggaacataaaatgctttattttttccctctacccaataaagttccgtgtttcgactaataacatgtagtagacagtccattacatgggaagcaggcagatccccccacaaaataattcagcccacaaataccttttcagcaggtttgcataaattaagcattctctactcctaataaagtttctttgcatcagagccagtcacttgactagacctctaagatattgttgaagaaaactactgtgaaactaacagtcactggaaagagataaggtaatcaatttccctgtgtgccttggaagatgtctctatcttcatagtcacccttccattaaattggttacattatttttacagtgcaggattgcatgttaatgctacattagttgttcttttacagttttacatgaataagaagaaattggatgcaaacacagaatacctatgtcttggaagccctcaaacataagtttcatttctgtttacaacacttaaatcttgggataaacagccaatgcacttaatacctttaagccctaaccttctcctcaggaaaaagagataataccagtctcacataattgttatgaatatggaattaaaacacaggtgcaatgctaggcatggagtaggtttcagtaaatgctgctttttacattacctgtaggtatgaactgttctctccaggtacatcgttctggaaaaggtgatgtaaacattgtagttcaatgtgcctgggttttcaaaggcaacaaaatgtgtgccgctgtctaagatgtaacaatctcagggaactaactccctttcccaccctcttcccaatccctcacctttttaggtctcatttttttgcatgttataaaaaggacacaattatcctgaatgagtatctcaaggcaatcaatgaaattctaaaaagtaactccaaagggttaatggaatatgtaattatctctactaagaaatagggtgatggtttaaattcatatgtaaacatacacacataccctcggcgtgtccattttaacacacacaaacacaacaattctctctcctccttctccttcccactccccgctccgcccccaccatcctctccacacttctagggtagcaacactgaatacagatggccaagtctgaggttatgtgacatttccagataaagtgaacaaaaatggcagagattcttctattgttcttccttatggtccacattcctaatgtgtcccagttatttatactatgagtgttttatatttgccaactataagcaatccatcttaatatttccaatacgctattttctcatcttttctcccattcttcctgtcctctaaaaggacaggaagagagaatttcttcctcttaaatggatttaatcattgtattccttttattgcaattcatcttccaagttgaaagtaaagttttagcataacatagtgaagaaaaaaaatggttatctctatatttataaattaaccattttaaagaatgtaaacctgttatagtgcatcttgaagttttgggatattttattttcataacaccattaaatactactatatattgctgtggtatctgcccatgagattgttccatatgcttgagaagtttcttcccaccttcactgggagaggggaatatttttgtgtttctgacatacaaatgtcagtgaatatacaaatctgaaactttatagaggcaagtttttaaaaatatttttattcttagaaaaatattttttattaaataagatagaactcattttatgtgaaaatcaaatatataaatgtttctatacaattacaaatatttatgtctttatagtttcaaaaaagaggattcttttaagatatttaaaaaactcattcagtcaagttttgttgatcccctaagcacttatttatcatggtgtttatgttttccttgagaaatccattcttatctatttagggaataaatttcaggataccttaagtagaaaccccctttccatcttagaacaaatacttaccataaacataaaaataaataaaaaacagaccctaaaattacactaactcttactttatttttctgttacctgataaatgtctgtctgccatgaaatcactcaaagcaaatattgaatacttttaaatgataaacttctcctagttggtaatattatgtgataataaaaatccaatgtataaattatatatcataggttttttttaaatccattggctttttaacaataatattatcacataagtcatagtaataaatttcgaaaaataaagtgggatggaaagctgataggatgatatgaaatattaaggtgtgaatttgaaagctgagttaattcctcagaatagaaatgtatgttaatttaaaataaatttatctaaacagtaaagccaatttaaaggacttataataaaatgcaatgatgtcaccatttttcaaagttccagtttgtcatcttttatttgcagagtggataatcaacaatataactaagagagcaaataattgcacattgtattttgcagcatccacagaaatttgtcgtttatccctctaaattttccgctctgttttcatttaaaatcctggatttaaaaaagtgctatcttctgtatacatcttaccaagtggggatgcaattacttaatctggaaagtgtgaaaattcatgttagtggactatcaaaattttctgtcaattataaatttcctccatgttgcatgtttttgaagggaaaaaagcaagaagaaaaaggaagctcttagatcagtgaaatggaagtaagaacaaataaaaactgtggtgagtggatgtttgtgcatctgtatgtgtgtgtgtagacagagtgagagacagatatggatatgcagatgtttgccccacatagagtgtgcaagtgtgcaatgtatttacatacgttacatgtacataactgcacgcacatgcacccaaacctcaaattatacaaacacacatattctttgactaagatattttgattttttattgtgtatgtgcaataattttacttctaagaaccttttcgtttttaagtttatgaaataagtgatcaagttaatgtttgatgaataagaaagtacaaacaacaacaaaattatatatacatttttatcctgcctttttcctgtaaaaatattatgagcatctttccatgtgagacactaataccattatacaaatgtatgagaatagcataacttatttataaaaatgtgtgaacatagcataatttatttagctgcttttctaatttaggtcatcacactttttttctaatttgccaattttataaatagtgttgctcatataactttgtgtagatgaacatacctaggacctaagtgttcttcctacattcatgtacaatattgatcctttagaaattacagcatctaggttttcatcatttctatctcagactccttctctgggtggcattggacactccaaaattcaatttatggtggtaattctgttcatctaaaattaaattataaaggtggatatttgattggtaaccaaacctcatgttctagttatgattccaaatcagcctgggaaatgctaatttatagtaaagagtattcagatgtagtagtgatttagcatctccaaaactcctttctaggagttttcctatacattccaatgctgttctgatatttaacaaaacaaacaaacaagcaaacaaaacacttcagaaaagcttttcagcactattctgaaaagcttctccaggctgtctgctaatatatcctgagtatagagttgagctttatgcattttgacattcaccttaataacatcttcataaataagactttctatcccattctcgctctggcccttcccacataatcgtctgctcattacatgcatattctgttaattgatctcattctctgagcactgatcatgaagaacggaaaacccaactagtgctactcttaggacatacagttccttgaaagtggacagccaaaaagctggcaaaacaccaccatcctcaggaccagaagctgttttaacattctctttgtggcgaatgtacattggacatattttagtgttactggcacctgtcttactaaatctgatgcaataacaacaaacacaataaagccttgttactaagctatctttgagccatactggattgtgattgattttgctgtgtttaatggtgtggtggcattttgccttaggccttttttatagaacagtggaaggaacagaagaaggaaacacttgatcactttgtaaatgctgcacattgcaggcagagtttaatgactgaacgtagccacttccagtgtattgaaatgcctgggccttgcctcaacgcattgtacctctattcagatggcaaagaatagagttcctgtaacattgtggagtgcagctcattttgggcataaacagttgctgtgaccttgtacaggcaaatagaccctgtcaggcctggaattgcagggccaggaaatcatctgtttagtcagtgctggttctagtcattagtttgtgtttatggctgggaattgctaatatagccctgtgtggagggagctaacgtctgaatactaaaagagacctatttaccaacagctttatttttttaatttaaagtcaattcaaattgaaatgagccttttaacccttaattaggaccatgtttcttctaaaagtcaaccacattagtcaaccggagacaaaattcactttgcaattgaaaggctgccttctttctttcaacagtagccaccatggtttactaagtgcatttgtttccctttcactatggtaactttacccattccctgtatcagcatagttcaaagtcatcaattacaactgtgacaaaaatgtgttttgtgctttgggaatgaggccaagattctatctggaagctcttccataatgattattcattgtataggtagtgctcataatactccctgtttcatacttgtttccatattatttttcagagctggcagtttgctattttacccccatatgggcccacagtgtttagttcctgttttattgtttccccttcataaatatgaaatcagcaggttcccaaaatatttctaattcatccactacaaattggtattattttggcttccttctattatcttactcatatttttagtatttcttaatagaaaattaacattttgcaaaggccttatctaatttgtttcactgtggcccattctgggtgttttttaaaataagttttggtgtttgctcgataatgcacaagcatgccgtcactaactcggcacttaaacttgaagagctgaagactagattagcaagaaaagggtaaataaaacctaactgcaggctgggcagggtggctcatgcctgtaatcccagaagtttgggaggttgaggcggggagatcactaaggtcaggagttcgagaccagcctgaccagtatggtgaaaccccatctttactaaaaatacaaaaattagttggtgtggtggcatgcgactgtagtcccagctacctgggaggctgagataggagaactgcttgaaccaaggaggcagagcttgcagcaagccaagatcacgctgctaattccagcctgggttacagagcagagcaagactccatctcaaaaagaaaaaaaaaaataaaaaacctcactgcagactaacagaaggcaaatgtgctctcttttcagttgtctttttaatactgtgcttatttttcttgtcattaaaagagaaaatatcttatatttttaaaattagaaataattttgattgatgttatcaaatttgatttttatgtctattcattcccataaaattcacaaacttccaaacattcttcacaatgtaaaatgtgggaaggggatgactatcataacatatagttttattatgttattggttatgatgaaagtataacagggaattatttgtttggcagtcaatgtatatcattcagtccatttgactataaaaccaatatgccctttgaatatacactactctgctagaggaaagcactgcaaaatccatcatttctttttcaagtatatttgttctcagccaggaaagaatttcatttccttgttctgttgccatatggcattttataatttcaatggctaattttaatccttaaagcagtgatgaacatgaagttaatttgttcttttatctccacttagaaagtgttactaatcctacagatttgggcatacagggtattaacattttaaagtgtctaggctaagaagagtctttagagataacttagttaacatctgtcattttttaaatgaggaaattgaagtcctgataagacaactggttgcaaataattcactcactttaaaaattcatctcattcactgctaggtgctggatggtgtgccagatatagggtgcacaaaatgaataggaaataactcctgtctctgtatggctcaggctctaatctgggaatacgtaattacttagggtagaaccttagagttatttatagaagaggaagtcactgtctcaaacacctcattaaagtttgaagatacctgatcagtaaatctaagccaacacctatttaataggaaaagctagatcaaaacatgccatttcccgcttcctagtccagtgcttttcctctaacatgctgaagacaacttgaagtattgggataaaaagaagaaatttcaggaaattgcttagtgaagataacatataagtgacatataaaaacgtatcttgcaactccaattctcaggtgagaagatccatttataaaataaccatgatatgaaactgatctcctttttaaaagctgggattttgacttttattactataagacacaataaatggttgttttcatttctttgggctgctatatcaaaataccataagctggttagtttataaacaatggaaatttatttctccctgttctgaaggctgggaagtccaagatcaaggggccagcatattcggtgtctggtgaagacttatttccgggttcataggtgacacctgctagctgggtcctcagatgatagaagggacaaggcagttctctgggacctcttttataagggcactaatctcattcatgaggactctgccttcatgatctaaacctccccaagatcccacctcctaaaaccaacatattgttcattagatttcaacatatatattttagggaaacacaatcattcacatcatagcaagtgtctaggtcattttaggaaatcgatacatgtttgataaaagtgaaggaatgaattcaaacattatgtgaacaaatacaattcgtagcaaatccaggatgatatctagtaaggcttgagaaggtgctgccttccattttaattgttatcaacttagactcatggatcatcttacttgaatatatcaatataatgttaaagataagagttcctgccacaattaactagtttaaaaatcttcttacaaaatgggagaaagcatctctggagccacataaaaaggtggcaatttgcttccacttgaaagattttaaactattcaatcactctttggttttgctatcctggggttaagatccatgaataatttttccacgtgtttgactgacaagaacatttactactggattacctgagggaagacgtaaatcagaattgtgtcattttggcagcagctttttgatatgtgtgtatctgccttagttaagtattgatttaatagctggtctccactacagacaaccttgactgtatagctggggctttgtattttaaaatttgtctctggataaatcttttttccacccttcttgtctaatctcttttttctttggtattctctaataagttgactgggacttattttcattaacaaaaggaaagaaagcacattaatacatctactttttatttcctacttttattctcttatatgtgcaacctccttcagcctataaaaatgcttaaatgagagaaatgtgtagattgttactcactagttttacattcaaggaaggaaaggagatgttttcaatatacaatcattgtctttgctactataagcaaagataacacacacacacattcacacacaaacatagatgctccttaaagtctttaatactcaggatgattttttgaaggataaagaagacatgacagacagacaggtaattgagcacaagttgatttactgcaagggagagagattgcttattgatgatataaatttaaaaattggcttgttagagaaaaatacatttatagagattgtttctttataaaataataattttatacattctccactcatattctcaaattcattgaacagttttggtggagaattgagatactacttggacaagaaatggaaaatttacttatatgcctcccaaatacagcatgtcactgtcgtcctactcgtgaaattgaaaaattcccactgcccttccaactaaaaggacacttactcatccgcccataccaatgttagacatcaaatagatagcaaatcctagagaaaggctgggtgcagtagcccaagcctgtaaccccagcactttgggaagctgaagggggagaaactcttaaggccaggaattcaatactagccaggtaatatagtgagacctcatctctactaaaagttttaaaaattagccaagcatggtagaatgcacctgttgacccaggctgaggtgggaggattgcttgagcccaggaggtggaggctgtagtgagctgtcatcatgcctctgcactccaacctggacagtagggtgagaagagcaagaccctggctcaaaaaaagaaaaaaaaaaaaagaaaaacaaaaatcctaaatcctagagaaagacatgtacgagagagcattagcctttctgtgatgttttctcacttggaatagatgacaaagtcttgcaatttttaattaaataaaagtttaaatgactatgtttcaatttcatatcaacagtttagaattggtagaaaaataatttgtgttttaaggaagtaatttgctttcaatgattgatttttataaaattaaaagaaagattccttccctgttcaaactataccattgaatttctttgttatcttgggcatgctgtcctttccattggtgcttcaattgtacagtctataaaatacacagactgatacctacaccgataatttcaatagaactttgataagatttaattgagatggtacatataaaagtcctaccaaagaagtaaagacatctacaaaaattaaaatgttattatagaatctagcattttactctgcatatagttgacattaaatgactatctattcattcgtggttaaagcctatcagctagttatcaggtgtcagatgttgcaatgtctgtccctaaactgtgtgtcacttaactttctggacttcagtgacctcagatgtaaaacacacatacagatcaatgtgatttctaaggatcttttagctccattaggctattattctatttaattagcacatctcaactgaatttcctattcatctagtcactcaggtatgccgtctgctacaagtaaaagaaacctaggccacagtgacttaaacaaacagggtattgtctttctgacattataagaaatcttgagattggtggttcctggatcaagtacagaaaacacatcatgctgaatttcttggcctttcactcatgatcacatgtaagctgctgcaattccagccataatgtccataatcaaggctggaataacttggcttcaagttgtatttgtacatcttgttagaaaacaaaaaggtatcacaaatattttaatcggacttctgtgtacatttctttgcccacctttttgtccataactttggccgttcatctctagcttcactggtctaaggaaggaaggatttggctggcttcatctgtgagcaaaatcaggattctgctggcaagaagggagcagagtttgggtattgagtaccaacactacttgccataaaattctatgtaacagtttgtatttttcatgttgatttatttgtatattgaattatgcttcatactggccacttctactatctatgtatgatctttctcaaatggcgctccttctgtggagtctcttccaaccaccaatcacaatgaagtgattgctcagcatgatttgtattaaatgcccgctgcccattttctattgcaagggccctttgggcatgggcagaattagggacatttttgcctttttgggaatcaaagagcccaaacaagaatagatgtttgacaaatatttatttatttatttatttgttgagacggagtctcgctctgtcgcccaggccggactgcagtggcgctatctgggctcactgcaagctccgcctccctggttcccgccattctcctgcctcagcctcccgagtagctgggaccacaggcgcccaccactgtgcccggctaatatttgtatttttagtagggacggggtttcaccgtgttagccaagatggtctcgatctcctgacttttatggtttttacaacatttgttatacaggtattcactaaacactcagtcactttttgtttctattacagatggctatactatacgatacttgaaaagagagtcacataatcacttcctaggtactgcacaaattatcaagattattgatagtatcttgaaggtagctacagttaataaacctaaaagttaagaatgctactcaaactagtcactagactttatccaattatgactaaataataaccctgagataataacagtaaaggatacgtaggcacatatacatacagcttcataaatatttgtcggcctgtggcggtgactcacgcctgtaatcccaggactttgggaggccgaggcgggcggatcacaaggtcaggaggtcgagaccagcctgaccaacatggtgaaactctgtctctactaaaaatacaaaaattagctaggcctggtggcgcacgcctgtaatcccagctacctgggaggctgaggcaggagaatagcttgaatctggaaggcagagattgcagtgagccgagattgtgccactgcactcaagcctaggtgacagagtgagactccatctcaaaaaaaaaaaaaaaaaaaagaaagaaagaaaaattataattgttagggcagtagaattgactatatgtaatggatctcagtgtgacaccaaaagttgttcaatacattggaaattggtcctacagcagccattcttggtaggaactagaaaacagtaagactagattaatgattgctatcattttaagttattccagtagtttattttggcagtgtatttcccttgtcttattttaagaaactttcagtaagaagatagtctaccatggatatattgtatttcttttcagaaacatatttagtgattataaatattgatttgttcacacaggttttactttaatgcaaataatcttctcttcacaatatgaagttaatataagaaaattctagaatgtaatgaccatctatagggcctattctgtatataagttctgtaaatcatcaagtctatttaagttctgtaaatcatcaagtccaaatgtggcactgaaattgagctttagaagttttagaaattattgacttccaaggatcatcttgaatctaaaatttacatcccaaattccttctcaaatgaattactagagacttcttggaattttcactatgattttagttctcaatgtaattataaaaatgcatcaaaagaagtaatgcagcattttgaattttctatcagacaaaatgaaaataatatagtagaggcagttttaggcatatctctgtaaaacagtacatagatgctgaaccctaaattataagctgaaatcaatgttcgataaccagttcaataggcttacaaaaaccattttatgcagagatatggccagaaattaaaaagataacacagttattaaaagagctctcatctagtaacagttcataagtgtattagtttaaataggaactgtatatccctctgtatttcagatatagacaaaggaatatatttaaatctttattttaggccattgccataggaagtaaggaaaagtactgtcaagccagaaaaaaatattgtagctcatgaaaattatttatcaagaatcttaaaaatatacgtgaagccatgatctcttctttcagttgcttacactttgtgggacgaagttgtacccacagagcaattagaaaactagtcaatgttaatatactgcttgctgcagtgcagatagtatacacattgcatcatgttttaaaaagggaattactacatggtgacatggttttgctttattttctccacaaatagtccaatgccaagtaaagctgtgaaaacacaagctggaaatttcatcatacactagtgccaaaataatctaaatcttgtgtgtgtgtttttcttcttaacatttggtgcaaattcaagcatttatgtagaaaaactacagtaggctctgtcatttgcttctgtaaattcttggaggaaaaaacttgatttttatttataataaattcatattcgaacttacttaaatctgttttacatattttcaaaaaaattatcacagacttttaaaagagagtcattttgtttgtagcttgtcgaccaggtttctacaaggcattggatggtaatatgaagtgtgctaagtgcccgcctcacagttctactcaggaagatggttcaatgaactgcaggtgtgagaataattacttccgggcagacaaagaccctccatccatggcttgtacccgtgagtagttttgctgcaacccatgcctccatgtttgttttgttttcttcttgttactgtgctgtttgtttttgttttaaagcatttggcccatttccttctgttgcccgtgtgcaaattgaaagctttctctgcttcactccccatgcttggctcaccacaaatgcaacatttatcacacaaaatgaattaaattttaaagcacttcctgcaacacaaccccctgaaagagagaacattttctgtgtcttgtttagatcctgcattacatatgacaggataggggaggttatagacaggggatttatgtttttacatttctattccctcttgctgtatgttggtcataggtcatagggaaaaaggactaagagttataaaactaatactaaagttttcataactattcacaagggttttgaacatagtgatgagttactttgttagaatttgtgaatgtatccttacctttgagttaaaactccgccattcacagcttggggaagacagtgttcttgaatccatgtgtctataatatcatggatcctctaaggatgaactgaaagttgataataaagaaaggatagttatttacctcattcagttccattgtaaattatctatttcccttgtagtagaaaacagaagtgaggctcattaatctttgttgaactactttgcaggacctccatcttcaccaagaaatgttatctctaatataaacgagacctcagttatcctggactggagttggcccctggacacaggaggccggaaagatgttaccttcaacatcatatgtaaaaaatgtgggtggaatataaaacagtgtgagccatgcagcccaaatgtccgcttcctccctcgacagtttggactcaccaacaccacggtgacagtgacagaccttctggcacatactaactacacctttgagattgatgccgttaatggggtgtcagagctgagctccccaccaagacagtttgctgcggtcagcatcacaactaatcaggctggtgagtacatactagatgcttcttactcttatcatatcacgtctgagtaatggttttgactctgggtggaaaactgggcggaaggaaaaaaagattttatagaaccccaggattttgccttctaacacatttaaacagttatggcacattaaataatttaattcttcaagtgagaataaaccatatttgttaggtgatttttaaactagtttatacccattgtttcccaatttgaaatccttaaatatttgaggctctcagatagtagtagaggggctccttgggggaaacatttttatatttcagagaacttaggcaatgaatcttagctttaaaaaaagttatgcaggatatgaaaaattgtaaatatcttcagcttagttaaaattaggtattcctttgttatttcatacttctaagaagttctgtgtattataactgatagttataaatctctgattgcttaataataactatgtagattacttatggattttacttgtgggattttaattgtgaatctctcaaacatataaatggattatatattacatagaaataatgcccctttgagatataacaatcatttttcaatattgataactgataaatgagtaataaacagttttcttttgtattcaaaatgtcttgtacaaagctaaactgataggtatttgttgtgcttaaattattgctacaaaatgtcagaattaggtatacatcccaagaagctcaattcagagatattattgtcttatttttacacatacacacacacacacacacacacacacacacacacacaaacattggagccaaagggagagggaagagagagacaagatgccactctgattctccagagaactaccgattctccagttctctcccaggtggggtcacctctgagctggttgtcaagattgagtataaactcggcttctgctcttcatttggcttacattatggacatccctctggtccctagtgggaatcaccccttgctctgagaatatcagaatgtgtcctggatgctctaggcaaaaggaaaccagaggtgactaaattatcttatcacctaggtcttctagtagccaaatcatgagccaaaaaaactcaccacattctgtttccatcacctggcttactcagaaaggttagttcaactagtaaagacacagagtaagtgtcatctacaaaagcaagtatgcatcaatatgactctgctggttgttaacattttcatctatttatctactggttaaatgtagttctagctgttcctgcaggttattacagaaatgcctctctactggttaatttctcaaatacactgagtagtcccctaagctcagtatgtcaggtccatctccattctccccatcattcagcaaccaaagggataaatctttgcataagaggggtatacagagcctttggctagcacccgtctttcttgaggggcccctgtcttccccatgccaatggatagatattttaaatataagccatggcagagtccatccatattcaaatatgtatctttctgattctaaatttctctttcgtttccactttgcttctggtctcatatattgatgaaaatcttatatttttacattcctcatgatgataagtaaacttaatttgtggaaaatacatgaattttaaatgaagtgcactgaatcattactttaatcttgctcactgtatctataatttctcccacttggagctagatcccagaccaaccagtatatgctttgctttgcttccgttaatggtatttatactttgtaactaatgatatttaaaagtttataacttaggtttatttaactgtcttctatgggaaaaaatgagtactgcaatactgttgctatatattgcatgattatggcttctcatcttcagctaacacaggaattttaacaaattatgatcatgtggcaaatggttttccggagcgctatatttcaagctgatttactaccttgtttaaaattgtagcatcaatctgtgttacaattatctcttaagtcaaacagaattgtataaaaacaaacaagagctccttatttcctatcttatcattcccctctggctttctgacaatgcatttatcaggaaactaatagttccaaatatacacagtaaatgaatctaggcaaagtggcaaccaagatcaggccaagacattaaaaaataaatgagattgatgctttggccctcccagttacaaatcacagtttaagacagattcagcaaaggtgatagaagttacttaccctagtctctctcccatttaaaaaaaatcactaatgtgtttataatatgcaccaccaggcattttatatatttatttcaggatgtctgtatcattttgtgtgcctggggagatagaggtctttgttctatcttcaaatctccagggtaagatatataagcatgattagaagcaatgccttttctgaagggagtgtttctttgttttcctttatttttgttcttgtgaaggttaatggactggtagccttgaaaaataagctccctaccactggaaggatatggctgtgacagatatgatgccagggtgcttaaaatcctcctagcctctatctttgacgtggatataaaggggaagcatgaatgtgtcccttttaatttagtttgtgagatcgagtttgttgattcttctcttgatgacattgtaaaagcattgtgatgatcaaatgataaggcaccttttaaattgtagaagattatgttgtaaattcggatattagttctcagctctcaatactttcacaaagtatgtcagtgagataagaaagtaggccaccatataaagattgtatctgtgaatccatcagtcaagtaaagaaagaattgcagattacaaaacaaaaatcttcaaacttataacgacataaattgctgctttttgttttctttcacagaatgagtatattcatctttttttttcttctggacaaaaacaatcattccactagtggaatatgcatatctgttcattcttaactgccattatagaatctgccgctttccactattctatagcatataatgatctcagactagaataaggagcactaatagagaatgtatgtggccttggggtttggaggtccacctctactcttattttactacttggatgaactgatatctgagaagctttttcaacatttcatcaagacagcaaagttctgagtaaattgacatttcctccctttaccagtttaccctattggaattcagcatgtgtatgtacaatttctatcaaaaaattggattcattcacatgtgtgaaaatattgcaatagtgtgcattatgcctatataccttcacccagatttctcctagattaataatttattccacgtgctttatccgtcccacccccatctctctttctatgtaaatgttacttatttctgaaccacttgcagatattatgaccttttcctcctgaacacttcagtgacaatttcttttttttttttcttttttttttttatactttaagttttagggtacatgtgcacattgtgcaggttagttacatatgtatacatgtgccgtgctggtgcgctgcacccactaactcgtcatctagcattaggtatatctcccaatgctatctctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacgtgaactcatcattttttatggctgcatagatattccatggtgtatatgtgccacattttcttaatccagtctatcattgttggacatttgggttggttccaagtctttgctattgtgaataatgcctcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctgtttctccacatcctctccagctcctgttgtttcctgactttttaatgattgccattctaactggtgtgagatggtatctcatagtggttttgatttgcatttctctgatggccagtgatgatgagcattttttcatgtgttttttggctgcataaatgtcttcttttgagaagtgtctgttcatgtccttcacccactttttgatggggttgtttgtttttttcttgtaaatttgtttgggttcattgtagattctggatattagccctttgtcagatgagtaggttgcgaaaattttctcccattttgtaggttgcctgttcactctgatggtagtttcttttgctgtgcagaagctctttattttaattagatcccatttgtcaattgtggcttttgttgccattgcttttggtgtttagacatgaagtccttgcccatgcctatgtcctgaatggtattgcctaggttttcttctagggtttttatggttttaggtctaacgtttaagtctttaatccatcttgaattgatttttgtataaggtgtaaggaagggatccagtttcagctttctacatatggctagccagttttgccagcaccatttattaaatagggaatcctttccccattgcttgtttttctcaggtttgtcaaagatcagatagttgtaggtacgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgagggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttctttgagcagtggtttgtagttctccttgaagaggtccttcacatcccttgtaagttggattcctaggtattttattctctttgaagcaattgtgaatgggagttcactcatgatttggctgtttgtctgttgttggtgtataagaatgcttgtgatttttgcacattgattttgtatcctgagactttgctgaagttgcttatcagcttaaggagattttgggctgagacaatggggttttctagatatacaatcatgtagtctgcaaacagggacaatttgacttcctcttttcctaattgaataccctttatttccttctcctgcctaattgccctggccagaacttccaacactatgttgaataagagtggtgagagagggcatccctgtcttgtgccagttttcaaagggaatgcttccagtttttgcccattcagtatgatattggctgtgggtttgtcatagatagctcttatcattttgaaatacgtcccatcaatacctaatttattgagagtttttagcatgaagagttgttgaattttgtcaaaggctttttctgcatctattgagataatcatgtggtttttgtctttggctctatttatatgctggattacatttattgatttgtgtatattggaccagccttgcatcccagggatgaagcccacttgatcatggtggataagctttttgatgtgctgctggattcgatttgccagtattttattgaggatttttgcatcaatgttcatcaaggatattggtctaaaattctcttttttggttgtatctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattgatctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctctcaaaaaaccagctcctggattcattgattttttgaatggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcatcccagagattctggtatgtcgtgtctttgttcttgttggtttcaaagaacatctttatttctgccttcatttcgttatgtacccagtagtcattcaggagcaggttgttcagtttccatgtagttgagtggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcttccatccttttattttgagcctatgtgtgtctctgcccatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggcatgattttgcagcagctggtaccagttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttgagaatgttgaatattggcccccactctcttctggcttgtagggtttctgccgagagatccgctgttagtctgatgggcttccctttgagggtaacctgacctttctctctggctgcccttaacattttttccttcatttcaactttggtgaatctgataattatgtgtcttggagttgctcttctcgaggagtatctttgtggcattctctgtatttcctgaatgtgaacgttggcctgccttgctagattggggaagttctcctggataatatcctgcagagtgttttccaacttggttccattctccccgtcactttcaggtacaccaatcagacgtagatttggtcttttcacatagtcccatatttcttggaggctttgctcatttctttttattcttttttctctaaacttcccttctcacttcatttcattcatttcatcttccatcactgataccctttcttccagttgatcacatcgtctcctgaggcttctgcattcttcacgtagttctcaagccttggttttcagcttcatcagctcctttaagcacttctctgtattggttattctagttatacattcttctaaatttttttcaaagttttcaacttctttgcctttggtttgaatgtcctcccatagctcagagtaatttgatcgtctgaagccttcttctctcagctcgtcaaagtcattctccatccagctttgttccattgctggtgaggaactgcgttcctttggaggaggagaggcgctctgcgttttagagtttccagtttttctgttctgttttttccccatctttgtggttttatctacttttggtctttgatgatggtgatgtacagatgggtttttggtgtggatgtcctgtctgtttgttagttttccttctaacagacaggaccctcagctgcaggtctgttggaataccctgccttgtgaggtgtcagtgtgcccctgctgggggatgcttcccagttaggctgctcgggggtcaggggtcagggacccacttgaggaggcagtctgccggttctcagatctccagctgcgtgttgggagaaccactgctctcttcaaagctgtcaaacagggacatttaagtctgcagaggttactgctgtctttttgtttgtctttgccctgcccccagaggtggagcctacagtggcaggcaggactccttgaactgtggtgggctccacccagttcgagcttccccgctgctttgtttacctaagcaagcctgggcaatggcgggcgcccctcccccagcctcgctgctgccttgcagtttgatctcagactgctgtgctagcaatcagcgagattccgtgggcgtaggaccctctgagccaggtgtgggatatagtctcgtggtgcgctgttttttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcgcacccactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcctgagtctccatatattccagtgacaatttcttaaaaacaataatgcttttacatagtctcaatatatttattaaaatcaagacattagcattgttctatactataatctcatctgaagatactagtcaacttttgttcattgtttcactcatatccaaatggcaaaaacaaattgatgttctgtttacctccagtttctatttataataataacatatactgatataatatagttcccatccataaaaataaataagtaattttctgtaaattcaaggcagatgcaaaaaaaaaaaaaaaagtggagaaggaagaagaccaacacttattgataggactttccaggtgctggatatgatgcagggaatttcagagttgccattccattcaaaaatgatcagcaaattatgatatttaaaagagagaacgtgacttcattttatgtagattttcgatagaaggtgcactaatttatgtaaaggaaaagatctttgaggctgttagctataatgaaggaattcctatcctctgctttagacagaatgacctctattatctacttaatttgatgatcaaagacaacctccttcttttccccttagataaacgccttcctttcttctggctgaaaattgccatccattacatgaagggattaaactggaaatccaataattatttttgtttttaatttattttttggcattctgggactataattcaaaatgttgtcactaatataattttaaacaattaattatttttgacctttaagaccacctatggactcacttactataaaaaacgtttataggctttctcgttcatggttttatggccttttatttcacagaataaagcaatagtatccattcgttaagaaaagtaaatatctttaataaatgttaaataaacaagatatacttaaaaaaagaactgtaaaatattagagccctttgactaaatttagaatccacactaggctaggtgtggtggctcatgtctgtaattccagcactttgggaggccgaagcgggtggatcacttgaggtcaggaattcaagaccagcctggtcaacatggtgaaaccctgtctctacaaaaatacaaaaattagccaggcatgatggcaggtgcctgtaattccagctacacgggaggctgaggcaggagaattgcttgaacccaggaggcggaggttgcagtgagctgagatggcaccattgcactccagcctgggcgacagagcaagactctgtctcaaaaaaaaaaaaaaaaaaaaaggaaaaagaaagaaagaaagaatccacagtatttttttgcatttgataaagaaaatatttctaagttttctgtagtttcattctggaatatgtttcctctagccaccttatttttcttttggaacttagtgtatgtagatatgacaaagaaataactcatgttgaagatatcagtcaggcttcagcatttctgaagaagcaaacattttaaaataaaggtagaataaatgcttagctgaatctgccattaaactatggccacctattggtatagtccctatagaactgtatgttgccgtgtaattatactccttggaagtaaattaaacaccaaaaggatctacatgaattctttcagaacatgaaggtagacatttttcagcgccaatgtagcgaatcggaaactgtaaacataatgaaaatcacctaacaaaataatgaacatcatatgactttagtaatgttctatgatgcatccttctctttgtttcattttatgattaatgaaacctaaaaatcaaagtcttaacattttgtttatctcaacaaacaaatgacgtctgaatttggccctgagagtataagtggttatatacattatgattttcacagtacatcatgcttgactggcaattcagcttcttcctgttttgaaatcaaggcagatacctgtgcatctgggaatgtcactgtgcagtgatgtgtcatagtgtggccaagccttccacatcatttaacacattaatgatgcctctcagccatcacaccctggtatggaggcacattgcgtaactgtagaatgagcaataagctgtagcaaaagcaaaaaccatatattgtcctgacagttattcaaaacccttatatgagcttagaggccataacaaaatggaacatgagctaaggaagacagttggagagcttcatgaatctaaactgaattttcattccgtcttcatttctggttttatatacgactctaattaatggagaagacatgtacgtggaagggtatgattacaactttcattcaagagttttcactagaaaaagaatattaataaccagttagaggagtaaatatagtgttaactaaagcacatggaaattaagaaagaattagacttttgatgctaacttgttgtatgttaactatattcccccaagggcaaaaaatatttaattcacagaaagttttctcatccttattttccaaggagaacatttttagtctcaaatcacaataaaatcatattttatactttaaatgtgttctacctccctaaagttaactgaaatatagtccttaggatataatagcatcgtatgtgagtaattgagaaatttaataaatgcaagtatttagaaagaaagaaaatgttctgtttccaaaagcagatatattactaccactggcaaaactctttcataataaattcttaattatatttcagcatctcccaaagtgttatctcagtgtgaataaccatcatacagctcagcattctgactttataatcctatcaatatagtaccagtgttcaaatagaaaaaaaaaatacatccctttcttaagtgactttatagatatctatcaggaaattattgcaataagtatccaaattacaaagactatgactatgaggtatggcacccctataagcaggggccctgacattctataccattcgcaccaaagtaaaagaatgccaaggccaaagaggtgagaagttcatattttctgctcctttttattattattaattgctgacctaactcttcttgacatgattagcactgcactccagtcctttatgtaattatcttattcaatcttacaacaattttatatggctataagtgaataagtgtcttgtccatggccgcacaactccagagcccctatctacatattctttttcctatgggttgcaaaggagaggctttgcacaaaatctaagtaaggctgaagaaagaaatatataaagatggttattttattatagtaaaatcttgactgcctggtacacaggtggtgtgatttcttctttgaaatcaaaatttcacatgattgtatttactcttaatcaatgctaattcaaaagcaccctcttgacaattcatcatccagaaataacctcttactcctttcccttttcatttcaattggaaaaaaaataattataacaaattgacaaaaaaaaaaaatctgtctctggtcacaagtttttcctaggaaatagctttaaaggcaaggccatgtgcctgagtaagaagagttctggaatgtgtgtccaaagaggtaaatattcatcttgatcccactccaattgggcctcagagtaggtcagaactattgctttatctttctgtgaaatgtaacatttggactagaccatttctaagtttctttccaattatatattctaggaaactaagttaatgcacattgtatcatgtacttaagaaaaaataatccactgtttataagtgaagcaaatatgccttgggaaaaaaaggtatttgaaaaacaaagtggaacaggacagtagcaaaagtccaattgtaaattcaggtactgtcacttaataatgaagtgactattttttgtatttttaaatttggtttgtttatgcattcatttgcaattttgtttagaaatgaatttaagggagttattggactaaacttactggcatctttgtatcctttttgattattggtacagtaagtcctacacatagattgttgtgaggagtaaataaaatgagagagcatttgtgactgggaaagggcttgaataagttgtgctctgtctccataatgatcatgcagatcttcccgtgtctgggggaaatagaaactcttttttttttaattaaaaatgtgaataaatatatatatattttttattttattattattatactttaagttttagggtacatgtgaacaatgtgcagattagttacatatgtatacatgtgtcatgctggtgtgctgcacccattaactcttcatttagcattaggtacttctcctaaagctatcccttccccctccccccaccccacaacagtccccagagtgtgatgttccccttcctgtgtccatgtgttctcattgttcaattctcacctatgagtgagaatatacagtgtttggttttttgttcttgcgatagtttactgagaatgatgatttccaatttcatccatgtccctacagaggacatgaactcatcattttttatggctgcatagtattccatggtgtatatgtgccacattttcttaatctagtctatcattgttggacatttgggttggttccaagtctttgctattgtgaatagtgctgcaataaacataggtgtgcatgtgtctttatagcagcatgatttatagtcctttgggtatatacccagtaatggaatggctgggtcaaatggtatttctagttctagatccctgaagaatcgccacactgacttccacaatgtttggactagtttacagtcccaccaacagtgtaaaagtgttcctatttctccacatcctctccagcacctgttgtttcctgactttttaatgattgccattctagtaagatcaaattctgatacatttctttggtgtgattggcttaggccccaagtttttttcaaaatcgcaattcatatctataatgcgtgacaatcctcaatgtaataggtcattctcgtgttgttcgttgcacacatatacatatgtatatataatgtatgtatatccattgattctgtgccatcactgaggtgccctacataggatgtaatggaaatgactgattgaaagttatatatattggcctatatctcttagttgggctagaacaagaaccaaaggcacacataaaataagaaattgataagactaataaaaggacaaccaacactttgggcagccgaggcgggcagatcaggaagtcaggagatcaaaaccatcatgggaaacatggtgaaaccctgtctctactgaaaatacaaaaattagctgggtgtggtcgttggttgtgcatctgtaatcccagctactcggaaggctgaggcaggagaatactttgaacctgggaggtgtaggttgcagtgagccgagactgcaccactgcactccagcctggtgaaagagtgagaccctgtctcaaaaaaaaaaaaaaaaaaaaaaaaaaaaaagcacaatcaagcaaagatatcggcaaagagtaaagaaaagagacggtgatacgggaagaaaccaggtggcaacaaatgttctaataatcattctggataaagagttagaagaatacactttaccaaggcccaggttgtgacaggagacaaagattttacaactacttaggaaatgctcactttttaatttttaatcactagactgttagtggttgactttttctacaagtttattttaatagattcactgtaattccaagatgagaatgtcagatgaccccaaaattaattgtgcataccatagatattttaaagaaagaaaatttttgcatctttacttttatttgtttagcttatcacgctatttgaatatactttgtgggcaaagttcgtctatctttgtccacctaaggagggcaattgggtatatatcctctaaaatgaagtacatgttatggatatttatacagattttcaacatatcaaagaataacattctctatttctgtttcaagtagtaaagcttgttttatttctcttctattgaaatgatttcaaaaggtttttcatagttgatatctgggatacattgcctactgttccattaactcccagttaaaataaaacaactaggctaagaacatagcatgcttttctcttggtttgaattgatatagtaaaaaacttcagtttaatttgacatttttatatctgaaaagtttgaaaaaaatcccatccatcttccctgaggtatgtttccattctaagctgcttttacaaattcttattattgcagatataagatagatgtccttattaaaatcctaatataaaatggctagaagaagaactaggttttacaactattcatatgtgtatgtgtttatatttgtatattcatgtgcgtgtgtatatatgtacatgtataaattaggaatgtaaagatctagaaataataaagttatagaaagtatatggagtctaacagatatgaaagaagagagacttttttttactaaaatatttgaacaggatagtctttttcttaaccatctcatctgttaaataagggttatggctacattgagatattgtgaagtcaagaaaaaagcatatataataccttgtgtggtgctggctgcttattaagtgatcaatacttggtagttaatatctttcataaacatttggaacatttagcagtaaatgtggtctaaaaaaaaacccatttagataactccaggttttctttggcaataaataacacactcaattacttgcctttttctgttcccaaagcattgactaagcccttagtatgagccagttactatactggatctactgggataaaatgatgattaagatgtagtcactactttcaaggagctctcaatttaggacatcttaaaggtttcatgaatacagcatgaagttgattggtttggccaagaaaagacaggcaaagccagctgccaagagaattcaaaaagcatcaacagctcaatgaagccccccagtgaaagagattggtcttgaattcacagattatatgacattaagtataatagttttatctttttttcattactaaagcagaggaaaaaaagaaaaacctactgattacacatgatgctaaaaaactcgcatgctgtcccaaagtttttcactaaagagaaggaaagtaaatgaaatgctttaagttatgtacaaattcgatgataattgcatgtgtattttaatgatctctcaaatgcatgtatctggtttatgaaagcacatagaatatgtgaacttataacaatgggacaagagcaaatgtttaaagttgtgcagtaaaactcaccacattaatctgacttatttgtctatctgtccatttacttacctatttgattaagcttattgttattagtttggaattaaatattctagttaaatagacagttaccacataaagtatataaaactagaatgcattaaaatataatcaacagtaattagtatgaaagtgactccttatttcagataaagacaatgtctaaagtttagaaatgtttagaataatcattttaattatgaattataattgttttgaagatacctggccagaatttgacactaacataatagtaagtcaggttttactagtttgctaatatttgttaagacatacatgtttacaaaccttgcctatttgtgaaagttaaaagatattgctttctctgtatgaaaagtaaaaacgattaaaatgagtttcaaaaaagatataaaggaaaaatccactattttatctatgttaatctacatgcacactttgttgagaagtaagaatttagctgtcttgttgggtagtacttaaggagattttataatttatgtacatttcacatgtaatactggtatttacacactatttgctgtattttttagcactgtatgatgttttttaaattgtgatacattttcagataatatatattcctctactatcagtagccatttcttctttagatgaactggcaaacattatatattgtgtgtgtgtgtgtatatacgttatatattgtgtgtgtgtatatatatatacatacatatatacacatatatacacatatatacacatatatacacacatatatatacatatatatacatatatacacatatatatacatatatatacatatatatatacatatatatatatgcatatctttggattgttgcagtggcctgagggaattgttgcccacattcaaaatcagaatatttattatttaaactaacaaccaatactgtactgtactgtactgggcattttcgagatatcatttaagccttaaatcaaccctgtaatggagacattattacccttatttttagaagaaacttatcaagagtttgccagtcctatttatctaactcaagttgctagggagaatttgaacctagatctttccagtgcaccaataatttccaaatttcagtaaacaacttactgcttttaggaattttgcttcatccatatgccaccaggactcctacaacataatgtgcttaaatcaagcctctcttttttttggttttgttttgctctgaaatgtgaaaacagtttgctcctataaatagaaaactaatgttacttgccaaaaatttatgactaattagataataattgcttgtccacataacacctaaaattctttcaccaaacaccatgagtaaacttggagcactatgagtaatctgctgattcctatcaacactacctcactggcaattgcttataaggatcactaaaccacaggccatcccatttcagctaactgcaactctatgcttttagttatttcagtcaaagctgttggagtcatttggcgcttctctttctctcaaactgtatatctacatcagcatagtctatacaacatgccttcaacatatcacaagaatctcaccacttcttacaagatccattgctaccaccctagtagcatcatcttccccagattatcgaaaatgctcccaactgcatttcttttttcacccttgccttgagaacacatggacacagggaggggaacatgaaaaacaagcctcttataactatactcatgtttattattatttattttattgcataaattagcaatgtttgcagttttttaaattatgtcataactaatcaaatttcctgtgtaatttcaaatatttaattcacttctcatgtattatttccaaggtgactggcattactttttaattgaccaatgacaaaatttaacactcacttctcatatgaacagataggtttgtttaaaaaatggcttaggcaggaattgctagtgaacatgtgcccttaaatgctaactcacaattatggcaacttactgagtcaatggtttgggcacttggcaagtctttcttcagttaacatcttgcatataaaatattcattttcagaattttacctagagtgcacatatggtttttcaactcaaaagactacactaaaacaattggaaaaaagatgccattagtgttgcccaaggtacagagaaggccttcttgtatcctttgcctttctttggaaataaagacctatgaattcctaatctatactttttgttaagatccctttttaaagggtgtcatgtgtagcctaagatatagcttgaaagttgatatgagtggtgctttgtgacagaaccacagatgttcagtacatgatatatttattttttaccccagtggcccttataaaaagggctagaaaatcagcttataacaagccaactaatgacatgatatagagaggcccctggttcaatgactgttagtacagctgtgtcccattacatattagatacctagaacatacttgcattctgaatggcatttatcttttgaatttcaaacattcctaccataaataaggattttatgcttttcacaaatgtttcacagtttagtctagggaatactgaaaggttgcttttacttaatgaaatttaccctttaaagtttcctggagctaagacgaacattttctgagcgctcacctcaacagacctgcctcactctcctctatgcccattctctgctatccccttagcctggagaggtgataataacttgagtttcacaaaaccaacagtgtggggaccacatgagagctggcttttgatcatggtttaataattccctctttgttacttctccctaataagaggtatctgagtctaacatagaattgctacacttgtgctgtgggaaaagcaatatttttatatgtattttgtttgcaaaatgcacactatgtctaaaaattactttaagtgaaaatattttcacaaccccctcaaggtcctgattataatttgaaggtaataaagactcatacttctaaagtagagtagtatgacaccttaagaaatgttatgtgagatgacctcacttctgaaataatgtttcagaattgtttcgttttaaataagtgtgatggtccatctcatcttcttcaagcgcaagtagctgctattaatccagaagatcttcatttctttttgggttgaacatatctgctatcttgaggaatgaaccatgaaaaagaaggaaagtcatttcttgtgattcaggcaggaactcagtcattttccttttgtccttcaaataattgttgaaatggtgggagattagcctagatagtgactgctgcagtaacaactgctgcctagaagtgagctttattccacctccatgtaaagaaagcagctgtctttctattgcagttggcgccaggcagctgcttttactttctgtatttctttatagagcccttcgtcttaaatgcagtcacctgcacacagcctacactttttttagtcacaaaggctgcaacaagaaagcttcatatgactcctgtaatgagcaatgcagaaagtaatatggaaagatgttccttgagcattgtataaggagtgtactgggtggacgttgggagatggggcaagggagaaggagtttaacatgtgtgattgggtgtttgtgaaaagcaccagattgtcagatggcaggatgtgtacaacatgggatgagtggcaggaaaggctccagtggtcagttcttgtcctgcacaaaaaattcacagcacaatgagaaccaaagatatctccaataaatgaagttttacttcttcccagttaaaagaaaatattctcattgaccaaggttatatttactaactcaaactaagattatagtctggtgtatgtttcaatctcctctttcctcctagagttttactaaagaagatttatgcaaacccaaactgtgataagatttgtaagatgattgactgtggcaccaaagaaaattactcttatcatttcatcttatataaagctaggtatctatctactctctttttaaacataggttttggtttcatgcatagatttgcaaagtcatttttcaattatattagtccacatattaatgaagtttctccagagaagcagaaccaatagactgtgtgtatctatctatccattgagagagagatagagagggggcagggaaagaatacaccaatagactgtgtgtatttatctgtctattgagagagagatagcgagggggcaggagacagagagagagtgagagagagagagtttaaggaataggctcatgtgattgtggaggctgccaaatccacagactgcagggtaagctgataggctggaaacctagggaacagctgacattgcagcttgagtctgaatgcactctgaagctaggattcccttggtcttaagggttctctattttttctcttaaggccttcaacggactgaatgaggcccacacacattattggagtacaatctgctttactcaaaagtgtgccgatttaaatgttaatatcatctgaaaaacaccttcacagtgaccccagactggtgtttgaccaaatatctgagtaccatggcatagctaagttgacatataaatttaaccatcatagtcagtggtgtgtgtgcgtgtgtgtgtgtgtgtgcatgcacatgattgctgtttctcttttgagttaatttctagactatatttttaaaagaaatgtcaagataaattgatataaagaaaatactaatcttttaatttcacccactgaccatattggaattctcttttaatggatcttcattcttccttgagagtctttttttaggtttttcttggaagacaatgcccagtgcatcagaaagtgtcccctcccctattcctatctcaaatatattcagtttgaaaatctcacttggatgaccacttatcaatagcaatgtaaactgacaaactgctttgtggaaaaggcacactataggttttttttattggtaaatattttcatgtcaacattacccttttggagatcaccttcttatgtgccttctgtgcatagaatttcaggaatagtgtcaggcctaataagacagtcttcactacactgtttccctttaccgacctttgagagtcatccctattttcaggacagtgctgtggctgctattagcaccacttgagggcttgttaatcatctttgggtactgctattgatgaaaactctcagctcagtgatttttgaaaccagaattgcttaaaatatcattcagaggcctttcagaacaccagtatttacctactccaagccaatcctacagatgcagagtctctgaaaataagcatagggatccctagtagcacatgcatttttaaatcactctacagatgaatctggtcaacaagcacttgggaagttcttaggaagaaaaactctttcccagttgcaaggctgcagacaggcagaaaatttatagctccttcacattacagtttgtgcttccatgaactgcctggcctgaggccatgcaaattgaacttgcagaaagagaagttggataaacccttgttaaaaaaccagatatatttatactaatattatcttggcctcaaaaaggcaacacttgtttttctagattttatgcaaatttaagatattgtcattatcttctcaatatcctctaaatgtctttaattctaaagaattatgttaaacctgctgaagagtaatgctgagatggccaatcagtgtaatacagagattgtacttaaaactgttcattaactaatactgagttatcttttcttctgcattttcatcactccttgctacttttcaaagatttccttaatatttgttttataaagtgactttacttcctaacaatgaaatttaattattcaacttaattccaacaatatttgttgcatactgttatgtgaccaacactgtgctgtatgttgtggtgagagataatgataattgatacctactttctaccctcgatgaatttataattacctcaacatttatttaactaaatatagtttgtgcaaagaaaacacaccataataaagaaaaagaatgattattctctgtctgagaatagagaaaggttttcttgaagaggtggggtttgaggtggacaataaaaggtaaagaagggtttaacaggagccagcatgttgaagactggaaaaaggaataaagaggttgggaagataattgtcccctcagatatagcctttcagctgaggcagagtagaggggaagactgaaagggcaatggtggatggaatggtggcttaaggtctacaatcttttggggggattttgttagtccgctggagtggacacacacttacatttccaaacatatttagtcatagatacaaaacataatgcaaataaaggggctacaggcataagagcagatacaacatagcttttcaccttggtttgattttccacagggcaacacttgactgtctgtgcagcaagggccctgccagacttggaaacatagactaatgttgctgcaccattgcttgttagtactcagttctgtgtcaagaattccagaaaaaataacaccaagaaattgtgttcatcaatttaagggactattcacacacattgacttccttttggttcctgaacctacttagcatcaacaataccaacaagtagagaggaatagaggacaaagcggtatgactgtcctcatgtccttgaatagggtctctgcctccactttcccttgaaacagaaagcccatttccctgcagagcctgccatgcaatttcttcacctgggcagaaatgcatgggtattttttcttcattttataggtagcggtgcttgtgtatgatatagatggtttgggatgggatggtttagcagaaatgcttcttgatttttgtgtagaaaagtgacacaatcaggcctatgacttagaaaaataaatgaagatgcaaggaaaacaaaccagttgacacactaatgatagcccaaatgagagattataaaggtctgaaataaacctggggaaatgagggagatgacctttcagagattaaaaccagaataattaaaaccatgaccagttctgtgtcatgcatttgggaaaaaaacagaaccaatacattcatcagtttaagggaatatttacacatattgagttccttttggttccagaaccaactcagcatcaacaataccaacaggcagaggggaatagaggataaattgaccagaattgaataaaggagcaaggggggagttgtagctcactcaaacatgagaataatttaaacacatgtggaagaaaggatgataataccattgatcaagatcaaaaacatgaacgcataataagataatatacagcattttagaattgatgaaattaaggcaaaaaacaggtattctatgcgggtggttgtacaaagtaagcaattgaccactaagatctgattcttgagaaagatcttaaatataatttgtatatttgaaagccatgaaagttgaagagaaaaagtgtagataatagagcatggaatttaattttaaaatagcatcaaggaaaagatcttgagaacagcaatggatacctgctgagtatagacggagtcagctttggaatcaaagcccagactttaactgggaaacagttatctacaaagtcatttatgaaatcttactctgtttttgccctctcacttagtcctcctcaaggaatataagcctaatgagggtggggaattgttgttcactttgttcattagtatgtattttgttcattttgttcattagatgtgtttcctcagcaactaaaatgtattggatatttttaaaaattctatcaaatgaagatgtagccagttagcatgtcccatagattccaccagcacaaactctcttctatttctataacattcttcctatcttcacttgatattactaacttcaggttctcatcaaccctcatcttgattattacagtagccactagtctgcagttgcgtttccacctcatctgttttacaaagtaccttaatccaagtgctttactgtgacttacaaagctctccatgaactgtttaaagactacctgccaattaatacctttccactttatgctccatgaatacattttcttgtaaacttgcataaactcgctacaggttcatgccttttaaaatctatttatatacacgtatggaaatttcaactatttcccttctttacctgttcatttctcatctctcaaaagtcagttcttgagtcacttcctgcaggatgtttcccatttcttcactagagtgagctggcctcccgtgtacccacataggaatcagtttctagctctgtcactgctcttataggtgaagtgactcctcaaaggcagggacctagctttatccatgtttgctgaactcttgataaaatcattgtcagattaatcacattagcatatagtttcaatcacataacttagctcctttaaatagtggcttccattacagaggagaaaaaaacaaaaacaaaaaaaaacttcttagcctcgaaattaagattcctcttatgtggcatcacacaaatttccaatcataatttcctttactccttgttacaaagatagatatatctccttcctattctccaggatattttgaaaatttggtaaccttcacctaaaatacaattattctatatgcatgtgtttaaaattttttaattctgcaagactcagactaagtgccagcactttgttaatttttctctaattcttctcagctggaaatagttgtccttttatcacaactcccatagggctacagaatcgtttatctgtatttctcttatggtgctcctctgttctaatttgtattagaatgctacttcatatgcatttaatctttcttactgcactctaggttccttgagggcgtgaccaaggcatggctcacatttgtctccttcatagtggctaacttgggccttatccaataggcatttttatatacattttaagtgagagagctgtaagaagaagaagagctgagcagaagatttcagtcctagtggtttcatataattagatcagaatactaaagtgtgtgctgttggtagttgtggaggtatggggttttttaaaaaaattattattttaagagaaaactgagtgaaatttgggggcagaatttagatcataagtgttagagtacattatttaaagcaatcttcattaattaaaaaaagacaaagcagaactataaggtagtatattagttagggcactccagaaaaacagaaccagtgggttatgtagagatatgtaagaggagatttatgatgggaatttgtttgcataattatggaggccagaaagttccacaatctgttgcctgggagctagagaaatagaaaagactgatacaattcagtctgaggccaaaggcttatgaaccaggggagtcaatagtataacttccagtatgaagtccaaggcctgaaaactggagggtctgatattgtaattcttagaattagcagacccaagaagctggatcttcaatatctgaggtcaggaaaagatagatttcccagctcatgaagagagagcaagttcactgccctctgccttgttctatttaggccttcaatgggttggatgatgcccacccaccttagtgagggtagatcttctttactcaatccatctattaaaatgcccgtatcttctagaaacacccccatagattcacccagaaaaaacaaaaaacaaaaaacaaaaaacgcttcaccagcagtatgagcatcccttagcccagtcaaattgacacataaaattaaccttcatagttagcaaccattaattttccagtttttcaatgtggaaaactgaggcaaggatgtgaagtaagatgcctagttcacactggtgttgctgactcacaatttgaactcaagtaatctgacagctgtgcccacattcttagtcatcgttttctctgctattgaagcgtgtcatggaagggaagaagaatatgaattagcaactcaatgacaagagagactgggtttcttgagaactcaaggaatggtaagaaggaatggaaacaacaaaaaaagagcccgcatcaccaagtcaatcctaagccaaaagaacaaagctggagccatcaggctacctgacttcaaaatatactacaaggctatagtaaccaaaacagcatggtactggtaccaaaacagagatatagatcaatggaacagaacagagccctcagaaataatgccacgtatctacaactatctgatctttgacaaacctgagaaaaacaagcaatggggaaaggattccctatttaataaatggtgctgggaaaactggctagccatatgtagaaagctgaaactggatcccttccttacacaactaatttatacaaaaattaattcaagatggattaaagacttaaatgttagacctaaaaccataaaaaccctagaagaaaacctaggcattaccattcaggacataggcatgggcaaggacttcatgtctaaatcaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggaaaaggacatgaacagacacttctcaaaagaagacatttatgcagccaaaaaacacatgaaaaaatgctcaccatcactggccatcagagaaatgcaaatcaaaaccacaatcagataccatctcacaccaattagaatggcaatcattaaaaagtcaggaaacagcaggtgctggagaggatgtggagaaataggaacacttttacaatgttggtgggactgtaaactagttcaaccattgtggaagtcagtgtggcgattcctcagggatctagaactagaaataccatttgacccagccattccattactgggtatatacccaaaggactataagtcatgctgctataaagacacatgcacacctatgtttattgcaacaatattcaccatagcaaagacttggaatcaacccaaatgtccaacaatgatagactggattaagaaaatgtggcacatatacaccatggaatactatgcagccataaaaaatgatgagttcatgtcctttttagggacatggatgaaattggaaatcatcattctcagtaaactatcgcaaggacaaaaaaccaaacaccgcatgttctcactcataggtgggaattgaacaatgagaacacatggacacaggaaggggaacatcatactctggggactgttgtggggtgggaggaggggggagggatagcattaggagatatacttaatgctaaatgacgagttgattggtgcagcacaccagcatggcacatgtatacatatgtaactaacctgcacattgtacacatgtaccctaaaacttaaagtataataataattaaaaaaataacaaaatacattagttgtatatagacaaaaaaataaaataaaataaaaaaagaaggaatgcaaacaacaaagtagaaatgaataaggaagtctctttctctcaacattgagaaaaacaggaagaaagtataggagaaactaaaaagtcaaattacctgaaacaggttgtgaagtgaattgggcaaagtgttaagaagttgctaagacttgaaataaaacagtacagtagcccctcaaactggtactgcagtttttcatcttttctgtgcacctagacaaaacatctacattttggtaatggatataaagtaagaaaataaaagaactaccaaggaatttttaaagtgaatatggaaattttattatatctgctcttaaatggtatgaaaataaatatttcaaggtagtcaggttctctgggaaatcagctttgtatagtcattatagatttgtgtttaaaaaattctttatattagttattcatatatttgtttgtttgttttcattccagtgattatttttatttaaacttgtttttggctgatgattttgagacattataatttgtaccaatgactacagttaccataaaattctacttgagcacatttaaacaaaaacatcttttatctgttctcatatctttaagtttccctggaagattactctctttactcatttaatgaacatgcccttaactatcgtcgacattttggtacctattgtgcaggaatcttttcattctgggtccacttctatcaggtaaactgaagaagagatgatacaaggtaagatagataaaagataagataagaaatgataggacaagataatgtgtgggctggtttatttgtattccttataaggagatttgtagagtttctctctcaaagtactgactgtcagccagggccacctccagttcagtaatacacaactgtaccgtgtggcacatttagattgtttaagggaagtctgttaatgggaagagttttgctagtttgtcttcctctacttggtttattgtacaaggcacagtgatacacatacacacacacacacacacacaacacacacacacatatgtgtatgactgagattgacaagtagcaaagttttaagactggataatttattatatggaaatctttcatatcctagtcaacactgcttgcctatattgaagagaaacagtttctaaatgactcaacatttgaagagttactagaataagtctggagtgggctttactctcaaaccagttgtttctgtagggcaattctctatgattaacttccagcctagggagttatctaaaagctttcttcaattaaaaaaaaaaataaaaccattttagcagagagagggaggaaagaaaaaaaatgtcaccacaagtttaagtttctgcataactgatcatcaatctggtctgaaacattccgataaaattggcattgacatttgcccatcttggaatctatggattgatccatctgaaggttttggaaccagtcagcctcagtgggatgtactgacaagaaggtagggtatctcaagacaggacatcctaggacaactcatagcttcactagtcatgacctagtattgaagaggcttcatatacaaatttaaggcttaaagactttatagtgtgatggagactattggttacttctagcagcaaccccctcaccctcatacttaggttcaagcctttatattccaagatatttttaaaaacacagcagcttttattcatatatagcacagactttttattccttctaattgaaaaaaaaaaactttgcaatttgcaattggcatatgtgccacttctaggaatgctcttaaccacttcatcagacttggcactgtctggatgttggttttgattgccaacctatgaaagagaaaggaaatcacaaaagagaaaattaacaagtgagcacagttccaaaatttgttcgacaaatgtgttttaaatcaaatgaatcatcctttggcacaagctattcactttatagtcattcatttgaacagcttagtctctgtctcctacagactgtggttaacattattcttgatgaatgagacagttaccttaaaacataaataaaacaaatagaataacttaacatctgactctcaaaggaaggtatgttatcttaccttgcactagtaatatattttaaataaaagtattcagaaaatcagctaaaaccacaaaagaaccaaggatatgtctacatagaactgctgcatgaaaaaagtagtttgatcaaatacatatatcttgattaagaaaatatgtgacccttccaaatattttatcagttttcttttctagtctttcactccataaaagtagtttccattcttattatttttacttactaatttaattaaaagtctctggcacaaaatagttttcacgccatagagtattgtacttattgctgaaatcaacattttaaaattaatttcaagtctttgcaagggcaaagacttacaaaagtaaataattatgtaaatcttaacctgtaagataatctttttttcttgttgttttttgtcatcccatttaatctttacttttaaagaaattatattgctaatttaaaatttcctccagccactttttgaactgaatccttaggcaagataacaaccttttaaatgtgtagaacattttttcttatttatgtaggctttatatagataactttgcatatatttctgcatcattttccaacatccatcttacctcacaaaacaaaaccctggtgtaataattgtgaaatggcaatgttatttcagaaaattcttttagcagcaaatgggaacttagagagtcagaaacagaaaagatttctgtgtaagcccactggtctcattcctatgtgacaggtgtctctgttggtgaagtctgctagtcagtgggaaaccaggatatcatcaccctgctgtgaatgagtctctcccagagggaactcacttatctgcctctgtctctgactcctactagactctaattctcactcaccatgagaattgacaggaaagatctattcagagatgtatttcacttcactttccatcctggatcaggcttctatttgtgggtttgttcaacatattatattaacatagaactaaattgcattttataaggctttgagatgtagaggataaggtcgatgtcattacatggttttattcattctaagtactagaatttaactctaagggtcaaatagagtccatttggtctgattactatgagataggtgctattcaatactatatataataaatatcagcttttattaagacaacaaaaggatttgttaaaaatgagtttccgaactaaaatttcaaatatgtacaattatacactctccacacacacacatactcagaaatatagtcatatataaaatgttcagtaagatattttcttgttgcttgggaattggcaactagaataaaaaagtcaggcaaaaatacaccaagtataccacatacaaaagagaactgcaaacagttggagccagacacatcttgaggcatttttaagaggaattaaatgggtccttgccatgtagatttttgcagaatcatctgaaaacgtcatgagtgcctacagaaagctagcacacaatagtaaaagtcagtattagtcaagaaaacagtggaagtcaacaaatacagtgcaaatgtgtgcacagctaagtataacctctattttccaccatctctccacagtcctccaacattggaaaagggaaggaagatgtaaatgagctgacttttttcctcttccacccatgaaattgctgttttatactgttatacactgggcattaataaccaaaagtgaagagcaggctatgagatattacagcaatttcatcaaagaacaagaacttgaggttcaacagatcagagggtctctgttctctgtatttcactttttagaaaaatcccattggtctggtctgcattaggatgtctgctgcttgtttgagggccaattgtcatgatacatctcagctatttcttggtcatttggaatgaccaagtaatgaagtagctcttattttctaacctgagaatgccacattccgagcacataacagaataaaaaactaaatttttggttcagaatagccacccaacttagagtagacagaaaaatagagacttcattgaaaaaaagtaatgccactaaacctctatataacaccacaaactatccttcattccactatagcaactgtaggtcctgttaatcaaataattttcaatattatctgtatcacagcttacaactcaatttcacaattcaagaataagtttgaggcatcgacgttgctggggtagagatatatttgtgtatgtgtgtgtgttagctctgtgtattcatatgcttgtatgtttgtgtgtttttttagttttcctaaactttgtcccactcaaagccaaaactacccagtgacacacaatgagccattaactaaaatagacttaaactgttaaagtgtcttgaaaacccaaataaagctttatatggtctcggctgtcaccaatattcctaagtatttacaatgatgcaaggtctcttagtttgaattctcccagaagtaggcattgagatgagaatttgaatataggttgtttatttgggaatgatccctgaaaacacaggcaggggagcataaaaatgaaacaaggaaaggaaggcagccactgaagaataagtattaatcattttaccctgtgggaaactggagcttaatcctgttgctgaagagtgggagcccgtttggaatacttgcttcagagttatcccacactagataagaggaagctgggatatttatacatgaactcttcatcagtcattgactgagagctgttccaaagatgagaggtaattgaagagtataattttttatccccaagacttccagcctaaagtgcatgaatagaagtgactctgataacaaaagaagccctcagtcatacagattaagtagctgacatcttgaaattggaaagttgcccatatagtaaattccaaagggatattgtacagacacaaacaaaataggcccattaggtatcctggaagagctgtagtacttcaaatccttcagtggttaactgagatgatgataggttccatatgcatttgagggaacataggttatcagagggaaatttgtaaagaaatccaactctagcaatgagaatgtttcagatctccataaaggcaggcgacacatctgcctttttacactactttaaccttcacaccttacatggcacctggcatacagtaagcacagaaaatcttcttgaatgaaatcattttatgatatttactttaataatttttactaaactgataagcaaaggtaagcaaaaaggaacacataaagagatattccatacattattaattttaaaaagaccctagaaccataataaggagcactataagactaattaggatgctttattgaattaaatgcaaaattgtctttgaaacaattttcaaacaattccagaattttttagattacttcgggaattaaataaaagaatacatgaatctaatatataatgattagtaattgagctttatgtaggatgtgtgtatataaatatatatatatacacacaactaaaagtgtatatttataatatgtatacatattttagatattgtatgtacatataagtatgtcctccaagttgtacctttaaaattagtacaatcagattttgctttcctcagttttctttccttctatatcaactgtgaataaatgattttctaactggtgtagggtttctgatgattcatatggtttaaataatttatgttttaatttcatcaaatatttgtgcccatatttttgtgatttttatattcatatttaaaaatataaacaaagtctcctctatactgcatgtcttccacctatatttggattaaaatgtgttgataagatttcaaagactaaagaaaggttgatactaagccttgagatgccagttttcacagcagccactcttgggatagtttgtcatcagcgttatttgccatttccttaaatgaacattggtagttagcaatttgtagttcataagggccttttaatttgtcttcgaaaagtggctttgaacatatgttattttgttaaattatagatgttaactgaataaattctttggttgcatgttttctttctacaatcacttgattgtttcctataaaaccctgctgactttttaaggaacgtgttggaaaatttttctcacaactttccttctgtgcctgtagtttttggagttgcttccctcattataaatgtaattgccaggggttttgtcacaggaatatgatcttttttagttcaaaactttcattctgcttatgtagattgttttttcttatctgatttcatgtcccattgtgttactaaaatctagtggtgaattacctaaagcacttcccaacctgtctctatacattcttttagtgaatgaagagaatacgaacattatattatgtgtaattgcctgtgcatcagatgctttatattgaacacaaatgttatggaagattcatttcatatgtacccatttgcaaactttacatattgtttagaaccaacatctggtcttactgaactcttatttcaggatctccttttagagattaaaccaacccattaaagccaaaaatccatttaacagttattcctaaggttaacaaagagtaaaaataccacactttagccatccaggaaggtaaggtataacatagattcatagatgcatgtatgaaaaccaactgtgaaccactctagaatgtaaagggtaacgaaacccactcgtatttggaaaatagactaccagactttgtaaacttcaagtttgctttgcctctagcatttttccctcattttttttcctagctaggtgcattttgaaggaaatttaacttgaaaagcatgtttctaaagctaaaccacagactgtgcgatgtgaataataatgattcttggcttattgtttttcaattccagaagaaatctgacagaccaggccagcaacactttataatgcttatataatagtttcatacagatctttttttcaacaaatggctctgaaaattagaaaaaaaatatggaacacatagaaaaatgttcaaaatcattcaaagacatgtaattagtttaactaccccttaattctggtaaaccacatgtactactttttactccaggttattcttttttaaaactaagtgtattggcaagaacagaaaaccaaacaccgcatggtctcactcataagtgagagctgaacaatgagaacacttggacacagggagaggaacatcacacactggggcctgtcacagggtgggggactaggggagggatagtattaggagaaatacctaatatagatgatgggttgatgggttcagcaaaccaccatagcacgtgtatacctatgcaacaaagggggacgttctacacatgtatcctagaacttaaagtataataaaaaattttttaagtgtattgggatatattcacatctcatgaaatccattcatttcaagtggacaattcaataatttttagttactttattgactcatgccggcatccccagaaatcagttttacaatgattttacaactaactaataatgatgataaactcatcattgcatttttaactatttttcgtgtcaattctaacttaagaatcattacatgtaatttagttttttacaaaaaatctcatcatgaaaaggcttaagtttacttcacaagcttggaaataatgtttagaatctttccacacattaggtaaaatgtagtatctccctgtaaaactgaagtcttcacacctgtgtttgagaacacttgctctatataggctaatgacaattttctgtaaactactgaggttaacaattagaagtgcaggaacctaaatacatacattggattgaaagccaaatccttgaaagaaacaagtattgctgtatttgtatctgcatgatttcctttttagctttacttatgaaatccaaaaattgagcagcttaaggctattttttctaatgtgttgaaattgtaaaggcgtgtataaacatcaatcagttaatcagttctcaaaattctgagatcaattatgtgaaatattcataatggcaaaaataagtattgatgcaatttacttatttggatggacttaagaaatagaatcgctccaaaatttatggctagctgaaaagttacttgacaaaaattcttcagataaattaatcctgtgtgctggaactaaacaggtcaggccacaagcatcatggaaattaagcagcaggtaatctgtctctgcaatttcccctttgctttctgctcagatttttaaaaatttctgtttgtgaggtataaagttatttattgccactcaatgtttgcatttcttaatcaagtaatatggggcagagaaagagtaaatttgtttgggataaaaagagactgagaagtattagtaaacccaagcatagacaatgcaaattttacagccaaaatagaaattctgcaggcatgattgcttttggaaactgtaagtctctgctggtgttcactttgtttgtataaatatgcaaacagacccaaattagcatattccccacctgcacccttcagaaagctaaactagaaactattaatacacacaatctctttttgtagtacttaatttgttaacattttaattgaaatttgataatgggtttaggatatatacttggaggagaagtagagtagatattaggattccagttataattgtcaagtgcatttcactttttcgtattatatttttaggtgattgcttctaagttagaaaacaaagactgtgctctttaagagtacgcctatgttacaaataagtttctggtatcgtggtaacatggaactagggcttctcagaaagatttcatggtaatcaaaatgttttacattgtatacaatgaccaaccaaaattattcttattttctgaaatactatattgtcccattttttcaagccaaatgagtatttttatgtgtgagtaaattggatagctctgagctaatttccaaaatctgatttccaaatgtttgaattgacttcataagttttctgttatgggaggtctgggattttgcccccttaaaggaagggatcaacctacacaactttcaataggacctctctttctgcttcaattagtctctattgcactttgggtggggttgtcaggcatatacaagccatatgggccaggcatatataggccatatgttaagcaatattttttttctgtttccacgcacatggtgaataatattttgatgcaatgcatacgtctatgttgtccaccatattaaaaaaattttgaagagagataattccttttgaaaactcatgagtcatataacaatgtagagttaagcaatggtgactcactcaggcatgtgatatgtataaggacagttgtcatttctgtaggagtaaatcaatttctttctcactcgcctcagaaggtatttatgtgagaatgaagttataatggagccacagttgaatccatacacatatatatatgcatgcgtctgtgtgtttttgtgtatgtttcaaatttggctcctcaattaaagttagcagtttattatttgtcacacagaccccaaaaacaacagggtttgtgtatgacgcctttgataactctggtctggtgtaacaatgccctcattttcttttcttacttatacgaatgaaaggagccagccaagactaaacaacattgtttattttgggcctcaacagtaccaaccaagaggaggtagtgctagaaaaggggtttagcttataatttagtataaccatctaattaataatgtaagctgactaaaatcagaggcgctaatcagcagagacacaaagcaacatatagtaaacttgtaagtgtactataaactgtgactctttaaacagcataataggtagtagctttttttttttttttttaatgaagttttgctctgttgcccaagctggggggcagtggcgcaatcttggctcaccgcaacctccgcctcctgggttcaagcaattcgcctgcctcagcctcccaagtagctgggattacaggtgcctgccaccactcccggctaatagtagtagctttttaaccaaagctgctataggctgtttgtttgtttctttttttgagacagagtctcgctctcttgcccaggctggagtgcaatggcgccatctcggctcactgcaagctccacctcctggtttcccgccattctcttgcctcagcctccagagtagctgggactgcaggcacccgccaccacgcctggctaattttttgtatttttagtagagacggggtttcactgtgttagccaggatgatctcgatctcctgacctcgtgatccgcctgcctcggcctcccagagtgctgggattacaggcctgagccaccgcgcccggcctataggctggttttaaacctgtgtataagttaaacatcaaagagtgcatcatagacgtctttcactatctgaatgtttctgtcccctccacatttatacattgaaacccaatcatcagcgtggtatgatggctcatgcctgtaatcccagcacttcaggaggccgaggtgggcagatcacttgaggccaggagttcaagaccagcctggccaatatggcgaaacccatcactactcaaaatacaaaaattagcccggcatggtggcacatgcctgcaattccatctactggggaggctgaagcacgagaatcacttgaacctgggaggcagaggttgcaatgagccaagattatatcacagcactccagcctgggtgacggagtgagactttgtctcaaaaagaaaaaaaaaaattaggacatgagcccttggaaagatgatgattaggtcatgagattagagccatcagaaatgggattagtgctcttataatgaaggctccatagagctaccttgtccttccatcttgtgaagacacaatgatgctagaatgcgcaatctatgaatcgggaaatagactctcaccagacaccaaatctgctggcaccttcatcttgaacttgccagtctccacagctgtaagaaacatccattgtttataagctgttcagtttgtagtattgttatagcagcccaaatagattaagacaagaactctgggtttaaagagtgagaaaaaaaattacagcaagattgtatacatgccaaatagccagctatttctttagatagcttattacctctctgtcaagcagaggtcttttgcttgcttgaaaaaagttctagattatatttctctactgcaattgttttgaaatgcatgttttattgtaactcaggtatggtgcggccaacagatcaggagaaggttgccactaaaaaatagagactatggctgggggtggtggctcacacatgtaatcttggcactttgagaggcaaagctgggtggattacctgaggtcaagatttcattaccagcctggccaacatggtgaagccttgtctctagtagaaatacaaaaattagccaggcatggtggtgggaacctgtaatcccagctacttgggaggctgaggcaggagaatcacttgaaccaaggaagtggaggctgctatgagctaagatcgcaccattgcactccaacctgggcaacagagcaaaaattccatctcaaaaaaaaaaaaaaaaagagaatattccatgtcacataatgccacaaagagaagcaccagggtcagtcaggaggcagagggagcaagggaaaagcatggatgggagcatttattgtggtttcatgagaaaggcaagacagggtaaacagagtcggggttggtttgcttgaataatttcagttagctctgaggtatagggactgtctctagcagtctggtacctgaccctgacaggattaggacagaagaatattgcttgctggaagttaagagccagaaagaggaggtgtttcagaggaaaggctctggattggttagtttgcacatgaaggcatgttcctggactaacatttgctatctctaagaattgaagaattgactagccctagaagagacaatttcttcccagtcagtgaggcctcagatgccagagcatcaggaatacaaaaagaagaaaatattcagagtaacttcatatattgatatactgatatctactaatataaaccatatgttttacttcttttaatattgagtaaaacatacaatgaattattctattcataaatttgaaagttaatggcctttcacaaatatatatcctccaatcaagatatagattatttctaattactgtagagtgttctctgctgttcacttccactctatagttgtagtttgctaataaaagattaagaccagcacatattttgtttagtgtctgaatataacataacataatatataatggcatttcgttttactcctttctatcctatgcttgggcacagcacatgagccaaacaacccaagaatagcctttccgaatagttttcctaccattatctgttagaatggagggtgggcaaatatcaatcctttcttgaactaaagatatatttaagttacatctctcaacttttgcctctaattaaaagtgaccaaaaccttttttgagaagctccacagagaatcctgcaagcatccacctgccctgtgctggaactgccctggctgttctagccctgaatgaccctcactcagaacagatttatgacctcagcagtgctttaagacaaacaaattaataagaaacaaaacttcacagtgtggtcagcctacttcttcttctttttttttttttttttttttttttttgagacggagtctcactctgtagcccaggctggagtgcagtggcgcgatctcggctcactgcaagctccacctcccgggttcacgtcattctcctgcctcagcctcccgagtagctgggactacaggtgcccgccaccacgcccggctaattttttgtatttttagtagagatggggtttcactatgttagccaggattgtctcgatctcctgacctcgagatctgcccacctcggccccccaaagtgctgggattacaggcgtgagccaccgcacctagccagtcagccaatttctaatctgaaatttgttctgcattgatttcagcttgattttatagaatcattcaaaaccacatgttcatcagccatatactttcaatagttgtccctcctcgatctttggagccatctatactgagataaatgtgatttattgttcagactaaaaagttgtataagatactatctaatttttttctaaggtttcatatttagtccttccaattttgattatcaactgtagttttaaagtttctactttgtcgtcttaattttgtggaaaccagtgaattaagacaacaagcagaagatattgcctaaagcaatcctgcattggttggggactcgggctattaaaattccatcaaagttaatgttcttacccaagattaacaaagccagtagatagacatatttttcacttgcaaatctaagctatattttctggaaagtgaaagacagaaacttaactgaatttaggaattttgcaaaattgtttttcgctctctgggaataaagatttgatcttctccttgtggattgtttacattttctctgaaatgtatttttctaaaacgtttaggctctaacaaacagaagtgtgaagcatgtatttttcatacataaaattaagaatattgccttttaaaaattcacacaattaaatgcatatctgtctaagcattttgagggtatcttatgtttcaggtacaattgatgaaaaaaagaaagaatgtcatagatgcggttgaatttcagttgtctcatgttaaaagaccaccagatccgttagcagcttcatatgatatatgtaaagaataagcactaggctgaaagatgcacataaatacacacatacacaaatatttagatgaataaccatcattctcatcaccttgtataacaatgtatggatgtcccaggatagggatcactagatgcttaaactgcagatgtattatatgtactcacagccctctaaaggacctaaagagataaaaatattgtagaacatcccagaaaagagataagaatattgtagaacatcccagcaatccaaggatcatttttctaaaacatactgattttatacacacacatacataaatacaaatattatacatacatatctcctctaagagtcacagtattttatgataggtttgctaatatactgcattttctaaaaggatttcattatgaaaaaaaattatttgctctatatgtattatttcctaccaacataatttcttattttagagataatcaacttcagcttcaagtggacaataagagttttaaatatagctgtttatcaatattaacctcttatatggtttgactctgtgtcccacccaaatctcaactggaattatagttcccacaatccccacatgttatgggacggacccagtgggaggtaattgaatcatgggggctgttaccctcatgctgttctcatcatagtgagttctcgcaagatctgatagttttataaggatcttttctcccttttgcttggcacttctacttcctgctgccatgtgaaggacatgtttgcttcaacttctgccatgattgtaaatttcctgaggcctccctagtcctgaagaactgtgagttgattaacccactttcctttataaattacccagtgttgagtagttctttatagcagtgtgagagaagactaatatagtaaattggtaccacagagagtggggtgctgctataaggatacccaaaaatgtggaagcaacttaggaactgggaaacaggctaaggttagaacaatttggaaaactcagaagaagacaggaaaatatgggatagtttagaatttccaagagacttgggaggcttagaagacagaaagatgtgggaaagtgtggaacttcctagagacttgttaaatggctttgaccaaaatattgatagtgatataaacaatgatgaccaggctgaggtggtctcagatggagatgaggaacttgttggcagccggaataaagtgcttcttttaatagcttggcaaagagactggtggcattttgcccctgccctcgagatcagcagaactctaaacttgtgagagataatttaaggtatctggtggaacaatttttttagtagcacaacattcaagaggaagcagagcattaaagttaggaaaatttgcagcctgataatggagtagaaaagaaaaactcattttggtgggggagaaattcaagctggctgcataaatttgcataagtaataaggagccaaatattaattgccaagacaatcgggaaaacatctccagggcatgtcagatatctttttgacaggccaggaggtcaaggagggaaaaatggttttgagggccagtccaaggaccccctgctgtgtgcagcattgagacttgttgtcctgtgtcccagctgctccagctgtggctaaaagaggccaaggtatagcttgggccatggcttaagatggtgcaagacccaagccttggcagcttcttcctagtgttgagcctgcaggtgcactgaggtttgggaacctccacctatatttcagaggatatttggaaatgcctggatgtccagtcagaagtttgctgcaggggcagagccctcatagagacctctgcaagggcagtgcagtagggaaatgtggggtccccagtggggcactgcctagtgaagctgtgagaagaaggccactatcctctagaccccagaatggtggatccactgacagcttgcgttggatgcacctggaaaagccacaaacactcaacaccagcccatgaaagtaaatgggaggagtgctgtaccctggaaaacccaaggctgtgggagcccatctcttgcatcagcatgacttggatatgagacatggagtcaaaagagattatttcagagctttaagatttaattattgccttgtttgattttggacttgcatgggcctggagtccctttgttttggccaacttatttcatttggaataggtgtatttagccaatggccgtaccctcatcgtatctgggaagtaagtgacttgcttttgattttacaggctcataggcagaaaggacttgacttgtctcagatgagactttggatttgaatttttgggttaatgctggaatgagttaagactttggggaccattggaagggcatgattatgttttaaaatgtgaagacatgagatttgggaggtgtcaggggtggaatgacatggtttggctctgtgtccccacccaaatctcatcttgtattataattcccataatccccatgtgtcctaggagggaaccatgggtgggaggtaattaaatcatggggacagttacactcatgccattctcatgatagtgagtgagttctcatgctatctgatagttttgtaagggcttccctgccacttcactctgcacttctccttgctgcagccatgtgaagaaggaagtgtttgcttccccttctatcatgattgtaagtttcttgaggcctcctcacccctgagtaactatgtcaattaagcctctttcatttataaattacccagtcttgggcagtgctttatagcagcgtgagaatgaactgatataacctctttcacactgaagcattatatttagaaatctatgattatcccctagattttcagaaccatatcacatatatcatatgtatgaagattgctctaattctgtgaggatactgggagatattaaaaagaagaagacttttatatttttataacaaggaatatgttgattaattgttaaaatgaaatataagatttcattttggtgaatttatgcaataaatgactatgaaatgcatacttcatttgtcattacttttttaaaattttttatttctccacgctgagaaaaggataagattataaattataacaaaattctccagtctttaaaactactttagatctttaaaattcaatgattaaaattttggagttttagtctttagaaaagactaaatcttgtgtatactgttatcaaaaaatcgggggaggaaattctggtcaaaatttattttcagtgtattatgtcttagaatatttttctcccagcacaattaattctattgagaaaattacttttctttttactatagaaattgaataacataagtttatagagagtagtctctcttctaagcacattttcattgccattttgattttaatttttttattttaatatcacgggctaaatagaacttatttttcagaggaaccagccagaaaatatgctgtatactttattccaaggctaaccaaattccatggtagatttatgcaaagccggcactatgctaggcacctaagattctgagggacatacagtctagtgggaagacatactgtaagcaaatgatgtaattacaacacaatgcagtcagataaataatgggagaaggagcaactatactgtaagagggcagaggaaggacctgatcaactattgcctaagggactcaggagaaactttatgagggaattatattagcaaaggattttggagactaatgagtagtagaagcagttttccaggtggaaaagagagagatctagtgttgcagacagggagtacagcatacacaaacaactgaaaaaaagaattgtctttagaattttagctttgtatggagagcaataaatgacaaagctggtatgtatgttgcagtcttgtgaggagcactaaataataatgaaatgaatttcaaattttgtatcctactgtagtccaaagtttcccaactctttgtgatcctaagagttatctgctatcatcttcttaaaaatacagatctccagaccgttctgttggagcttattatttgcttaacattttagaaaacctagatttgaaattatgtgattttgaaagagaggggaatcaatgtttcatttgctttataaaatactaaatcatcaaaatgtatagaaagttgaaattctgaaaatattaagctgaaagtcatagaatccaatgcagttggtaaatggcaagggtttgaactaatccacggctggaaaagtagaaaagtgatcagttttcagaaagttgagctgattggcaagctgaattattggtgagaaaaaatataaactataactctgagattttgaactggatacactgcaaattgataaggttttgtagctaaaatagaaaatcagaacaccaggtttggggaaatcagtgtaggaatggtgagttgaagaacattaagcaatgaatgattatgctaaatcaaacccaagagagtttctagatttaacagaagtgttcacttctgaaaaaactgagaaggaaatgttcctcagtaggcattgtaatgaatggtaaagaaaaataagagactaatgcttttaaagtcatgtctgattcaaaagaaaaatctttcaaccattcactgcatatattttcccatggagacaatttttaaaagctttggctcacttagaaaagaaatcctgagccctttttgttattactttaacttgtccaatctctaaatcacagagatacctcagaggttcattagaaattcccaaatctagaaagaggaaggtcccaataaaaacaaataaaccaaaccagatcctttatgggttgaattttgaagttttcacttcctgattttaaggaagggtcatattttagaggcagaataatggcaaatatagattttaaaacaccatagttaaaacaaagaatcccttccatgtctgtcaccagatctggcagacacatgtatcaagtgtaattctaacacaaattgtgaatgacgcaagtctcatccctaaccagatcccttcacaaggagacactttctagccaacatttttgctttaccattgtaatttgtttttctattattttattgagtgtagtcaatgactcaggttacaatgtgcaaaaatcttccttctgtacttcaaatagatgaagaaacaatcttttagaaaaagttcttctctacttctcggctgaggttcaattattaactttttttaaatttttttgagactgagtctcactctgtcgccctgactgaagtgtggtggtgtcatcttggctcattgtaacctccacctccaggattcaagtgattctcctgcctcagcctcccaagtagctgggattacagtcacacaccaccacaaccagctaatttttgaattttagtagagatggggttttgccatattggtcaagctggtctcgacctcctgacctcatgatttgcccacctcagcctcccaaagtgctgggattacagatgtgagccaccatgcctggccaattattaactgttaagagtggtactttggccgggtgtggtggctcatgcctgtaatgctagcactttgggaggccaaggcaaacagatcacttgaggtcaggagttcaaaaccatcctggtcatcatgatgaaaccccatctctaccaaaaatacaaaaaattagctaggcatggtggccttcgcctgtaatcccagctactcgggaggttgaggcaggagaattgcttgaacccgggaggcaaaggttgcagtgagccaagatcgtgccaccgcactccagcctgggcaacagagcgagactccgtttccaaaaaaaaaaaaaaaaaaagtggtactttgcatctctccgttatatatgtcaactagtcattgcatgttgctgattcaagaggctgtcattgcagtggcctggacttagggaagaaaacactgtgagcaagtcaacccttggtttccagaaagttatgtcttcttggaagagaaattgaaaagcattttttttttttttttgagacagagttttactcttgttttccaggctggagtgcaatgacatgcaatctctgctcacttgcaacctccgcctcccgggttcatctgattctcctgcctcagcctcccgagtagctgggattatgggtgcccagcactacatctggctcgtttttttgtatttttagtagagccgggtttcatgttggccaggctggtctcgaactcctgactgcaggtgatccatctgcctcagccttccaaagtgctgggattagaggcacgagccactgcacctggcctgaaaagcacttttatatcagcttttataaaacacatattactagatatatagggtgaaaatatctgtctagtcctatgtcatgatcgaagaaacatttgaaagaagaatagattgaaagcatcatgcaattccactgacacacagttaagagtttctttagtactggcggtgtttggaagttttcagtaccgctgtgtaagtccggagaagcttcatggagaatggtcagctgtgtgatgcataagccacccctccctcttagtcttaactatttttttctcctttatttgtatttttttcttttcttttcttttcttttcttttctttcttttctttttttttttttttttgagatggagtctcgctctgtcacccaggctgggtgcagtggcgtgatctcgactcgatgcaagcctgcaagctctgcctcccaggttcacgccattctcctgcctcagcctcccgaatagctgggactataggtgcccgccaccatgcccagctaattttttgtatttttttttttagtagagatggggtttcaccgtgttagccaggatggtctccatctcctgacctcatgatccgcccgcctcggcctcccaaagtgctgggattacaggcgtgagccaccgcgcccggcctatttgtattctcttaagaaatatttcatttaaaatataatcaataccactttacaaagtatattatgtctcctttctttatagttttacaaagggcacatatatcagctgtatccagaatagcaaaaattaaagatcaaatattaatattatttctctctcttaaataccaatacaacaaaaatgtattttacataccagacattattttaaatttgctaaaaattattacctttatacggttttaaattttctttttaccagtttcttcatttgtttttctacaaaactatttgctaacttgcgtcaatgcctgcaccagtttctcagcatcctattctgtcatcaacttctttctcttaataggggaaccatttcagtaatctatcaattagtttgtgtaagaggcagaaaattaaaaatccggaggggcgcagtggctcactcctgtaatcccagaatttagggaggctgaggcagttggatcaactgagatcaggagttcgagaccagccttgccaacatgcgaaaccctgtctctactaaaaatacgaaaattagctgggtgtggtggcacgcatctgtaatcccagctacttgggaggctgaggcagtagagtctcttgaacccgagaagtggaggtgcagtgagccgagattgcaccactgcactccagcctggacaacaagagtgaaactccatcgaaaaaaaaaaaacctaggctatcaggtcatttactggcaattgcgattttagcatctataccagcatttttgccaaaaaatccctgagatttctcttccttcttaattttgcctgtagctctcagcatttttccagtcttaaggaagttgaaagttttttttttccattttgtttaaccattaacttccattctctcaaattgcaaatttaaaaaacagaagaatgaaaagaaaataaatctgtcatacagtgtacactgcaatatcatgaatttttgtacagaaaaacactgatttaaagaatttctatgaatttgcaaattagtaatttgaacaaatcactctttgatatctgaaaattaatgaaaagcataatttgtatcactttctcattaatattctaaattgtgtcacagcacataaaaaaatcgataaattatacctcaaaacatgaattaaaaagtattctagaaaactttttaaaagcattgatacaatggagtgcccagagaatttgtctctttctccattatgttttattatgtccacattatttatcaggggaaagaaaaacaattcctattaattatttattaatattaaaatattgatgagtattaaaaagtaccgggcttccagctggtgtactgagttgaacttttctgaaatgcagccagcacaaggggcgtgtattaaaagagcagaacaaatgacttattaggggtccaaaagcagcaatcagaaaaggttcatttaacatagcgatggcacaagcttcaagcaattgcctctacttaagtaagtgtggaattacaaaagcctatttattacagtccaacagggtcctgcagcttgctcaaagagctttgaagaaattcaacagttataaagtcctgctcagtgcagaagcagtaaaatttggacagacccccaaaacagcccacaaagctttcatgaaaaagttaatacaatcctcatcgcaattgttctttgaaatgaattgttttctcacttttctttttttaaaggagagatgctgtacctggttattttcaaaacttctttgaaaatgaattttaaccactaggaaaaaatgaaagtttcatggtggtatcaaattaaatgtaggacctcatgtgttccaacattaagcttcttgaaatgctcttgaaaccaacattaaatgtgactccgttaatggacttacttcagcagaaaaattagtagatttcctcattgtagaaaatgcaaaatttgagtccaaagacactggggctgaaatttttttattagtgattggataatgatttgatttttctaagtattaaagtaagcaaaaataaatttttttttaaaaaatccacatatccatttatttataattcagcaatacatttataaatatagaatatgtttatgaagcttcaactaaagtataagaaaaataacttatcttttgcttggaatcaattttagagagcaaattgcagggttgtgggggtgaagccaatttagggactaaaatagaggattattgaatagatgaagaattgataatgaaaggtaaatgatgttaatttgtatgaaaagatattaattcctaatgggagcaaaaagttggtaagaaaatgaatttactttttcatcagaaaagcaacacctacatttttccttggcaaaagattaagtcaggccaagtgtggtggttcatgcctgtaattctagcactttgggaggcctaccggggagaatcacttgagcccaggagttcaggatcagcctgggcaacatgacaaaactttgtctctacaaataataaaaaattagctgattgtggtggcacaagcctgtagtctcagccagtaggattgctttagcctgggaggtggaggctgcagtaagccgagatcacatcactacactctagcctggaaaacaagggcaaaaccctgtcttaaagaaagaaaaaaataataaaagattaagtcatcattcccaggccaatccatgcttcaattagaaggtgttcctatgagatctcacaaataataaaacccagttgatgggaaatattgcagtagattctattttttggtgtacagttttctctgaagtggcacaaggcaagcatcatgaaagtttctattataggtgaagaataaaaatgaaaagtgtttatagataggaaagtttgaatgagaggtcggatgcaaaaatcatcatgtgataatcatagaaacatcaacaaatacagaacttctgctaacttgtgggaaatacaaatacatgaggttcttatggtccttgatttgagaaaaatctatataaaaataagtgctttaacaatgaaaacaattcaacagttaatgtatctaaagattcctgagtttttgtttgttgtgtgtttgtagtttattttgctgcattccattaaggcagggtgccactgaactccagtgagacatttcgattggcgagtgaaccaagattgagatttgaaagcagaagtactttgatgatagtatgcatttttccttttaatggaagggtttgaagaaggaaatcacttaaaatatttttaatcttcagttagaaatgaatttgaccctatgatatctgatccaaacagatggggtttttattcatattccatactttcgataatgcttagcaaaacatagcaaatgtagaatcaccatcaaataagacatttcaaaacatgtctaggtaattgtaacacatatagcagtcatttccttggtacctctcattaagtatttttttaagaaataaaactgtacaaaagaagattgttgttccttttctttgtagtcaagagatgtttgtcagaagtcaaggcctactgtaatatgtcctaaatcatatctattttacaatatactaaatattattattacctatggataccatgggactccttgtgcataatggattccagtcctcttgcagagctgcatatgaaaatgttatcaatgagctgaagaatctggcattaataactttgcaacattataacaaataggtagtcctgatgttttgttctttttttaatacatcaaatatatttcattgcttacattatagtagcagattgaaaacatctgctcacttgccactagtccaccagcagcagagaatctcagcacattttccctaggcctgcatgtaccagggctataatccagctgttgagtctggatatggggccagattaatattcaagagccttggaaatggaaatagtgctttcttgccaaaaaactggaacaatgatagactccatttgcatgttcccttctccctctgttcttattcgccaccctttctaacccattaatttgcttccttccaccttcccctcccatcctctctttacagctccatcacctgtcctgacgattaagaaagatcggacctccagaaatagcatctctttgtcctggcaagaacctgaacatcctaatgggatcatattggactacgaggtcaaatactatgaaaaggtggggaaacaatgtttaagggttgggctgtgtaggcaagaagctgtttcctcatgagctgtgctcttgcaaagaaaccagtgacattcctggtaaatggtagagcactgtttagaactgtggccctgtgacccctttgatttattggtagaggaaggtttagaaagaatcttgttgaataccccctattctacagcaataaacaacatcaaagatgccactgccaacttaatccagttacttatggcaatagcatgacatttatctccctttacaccaagacccctactctaccaactattttattgtggtttcttagtctatttgtgaactgtttttttagttcattgcctcaagcatcatttcctgaccttcaaatttacatgcatttcattcaatacaaatagcaacattgtgctagtaagaaaaatattgtattatttaactgatgatgaaaagattttcttgaccctgtagaaggaaatttaaaaggttggggatagatggataaatttgcgtgacataaagttgtggcttggtaatgcaattattaaaaaaaataggcacatggttatttttaccccaaatttaaaaattattaaaaaatagttatgtggttattttgccctgagtggagtggcgagtattccatcattctaaataactcattttttttctggttgtaaatgatagtaaagtttaaagacaagatatgtttaaaccttagaatcacagctagttagtttcacaactactaacatgaacactacatatttgtgtatctacttcagtttataaagtgtgttaaaatgaattaaatgcaaattgtgcatttatatagcagtttatatttacagaacatttctgtggacattacttaagtctgagctgtataacaaccttatggaagtagcaaagtaagttgttttagaaataagaaaacagagagtgatgttatatgaatttcccacagcctcattgctaataaatattaggcatctgttttgaattgtggcagccgtgagtcctcctttagtaggtttttccctatatcaggtacctttttctacatgataatagatccttataagaattattggcataatcaactgtgcaaactgcgtaatgtaaaaacattgttttgcattatgtagttatttccttgcttgaagttaatatatttctctagtataatgtcatttttttcatagtctctcttacagaaagcctagagtatatcttttttattaaaagaaattgatgccaaataaacttcattgttcaaaaattgtagtagaaataaattttctcctagctttgagtcctctactgtggtaaagtcaaatactcataggattgtgatctattttcagaagtgtgacaagatagaatgggcaaatataataattcatgttcataaatgatgccacaaaattcttaaaaatcagtaatgtgcctcagttcaaactagatttcaggactgggagaagaacacctaacatttagatctatgaggttgatctcaaattttaattgtatacatctgcacctttcacaaacatgagaaatatgctgccttatttcaaactccctcaacaaatgcaacaagcatcattgccttttttttttttttttttttgagatggagtttcactcttgttgcccaggctggagtgcaatggcatgatctcggctcaccgccacctccgcctcccaggttcaagcgattctcctgcctcagcctcccaagtagctgggatgataggcatgcgccaccatgcccaactaattttgtatttttagtagagatgaggtttctccacgttggtcaggctggtcttaaacttgtgacctcaggtgatccacccgcctgggcctcccaaagtgctgggattacaggcgtgagccaccacccctggacattacttttaaacaatattagctattgcaggaaaaaatggtcaaatctattgattattccctaagtattttttgatacatacatacctgtaatattatttaaaatatattcctttaaatacatatttgcatcacatatacctaaatttaaaaattaattctaaatatttatagtatgcttggtaatatttagaaagattctctaggatttaaggtccacaaggtctagatttctggactggttatttcgctgatggtgattaacagtatatgtaatgtatggcatgttttctgtactattcaatctcgttttggttgaggatatacagcgtttcatattatccactctaggtcctactctaggtgcagggacattgtaccattgcttgaaatcaggttcctcataggagctctgtgtataataatatatgtgagagaaaaaacgtaattcttgataaattcaatttttgtaaacaaagcttgacacaaagagaccactaaaatgtgtcgtgtgaatctaatgtacaatgtgaatctcctagagatcctttttgggaagcatttctagcctttgatctggagatttttgtctctaccaaaccacagtgacttagattaaatacagcacaaatacagttaagctaaaaataatgtagagctacatataaaaccttgattttttatgtttaatattttaaggttgataaaaaaaagttctactccagaatcaatagagcattcctattaggtttaattcaaagggatattttcttctttgtaagtttgttattggaattagatttaagctttctctcagccttgactttgaagagaacatatcttctctcacatatttactggttagaataaagccaaatttttcctgctttacatgcaggacagaaatcataatattcaaattgggaaattctgtaaatatttttatttttagaaatgcccatgttgggacaggtgcggtggctcatgcctgtaatcccagcactttgggcggccgaggcaggtggatctcctgaggtcagcagttcaagaccagcctggccaacatggtgaaacctcgtctctactaaaaatacaaaaattacctgggagtgatggcgtgcacctgtagtcccagctactcaggaggctgaggcaggaaaatcgtttgaacccaggaggcagaggtttcagtgagctgagatcgcgccactgcactccagcctggtgacaaagcaagactttgtctaaaaaaaaaaaaaatgcctaagttgcgttcagagaataaaataattgaaataatcgatatgactttttaaatccatcctatgatttgtgttaaaatataaaagaatcaggtttgagtggttcactgtttatcattttatagcattatgaagatttgattttaacatgaatttttttttctgacctcaaagcaggaacaagaaacaagttataccattctgagggcaagaggcacaaatgttaccatcagtagcctcaagcctgacactatatacgtattccaaatccgagcccgaacagccgctggatatgggacgaacagccgcaagtttgagtttgaaactagtccagactgtatgtattatttcaatgcagtctagaggagggggcagggatcttgcaaaagatgtctgatcgtttattctcactgtttctaagttttaaacaaatgtgatacatttaaggtatattgcttgggacattgcaatttgcagagccctgtgtctgtatacagtatttgtgtttgtgtgggtgtacattttgtgtttctttttttcttgtatgcaaatcaaacatattctaatgcctgaaatgcttctgttttttttttttagccataaattgcttttgaggaacattatttaatatagtaacacacttccagtgtctgtcatttcagatattccaggttcattgcgtgattcaatgaaccacaaaaaagaaacttgctgatccatgagaatcttaattttgttttaatccttaacacattcaatagcatatcacagagagaataaggattttctaaaatgtgttttatcacttcattcacattcagaagtaatttgaatagcctgttcctttaaccccaaatttggctaaaattggcctaaaactggcaaacatttttccagtaacttttctttttttcaaatgaattttcttcatacttaaaaaagccctttgctaaaatataattttcaaaaaggtaaaattatgtctatggcactaatataaaatgagtagaagttaatgattttacttaactcatttttttctttctttctttttttttttttttttttgagacggagtcttgctctgtcacccaggctggagtacagcagagcgatctcggctcactgcaagctcctgcaagctccgcctcctggcttcacgccattctccccctcagcctcccgagtagctgggactacaggcggccgctaccatgcccggctaattttttgtatttttggtagagtccagatttcaccgtgttagccaggatggtcttgatctcctgtcaccttgttagccaggatggtcttgatctcctgacctcgtgatccgcccgcgttggcctcccaaagtgctaggattataggcgtgagccacctcgcccggctgtttaactcattaattaataaacagattagcaagagattaaaacctgtgctaagaaaaacttgaagaacagatacataattatgtgtgtgtgtgtgtgagcgtgtgtgtgtgtgtgtgtgtgtgtttaggtaatcataatatgctaaaaatgtgctaatatatcccacactggttaatatccaatgagggtaataaatgtaatgattgaggtcatctttcttacagggcacaaaccagttgtctttctagtaaataagtgttatttcaattgttaaaggaaaaaggatatatatcactatcagttttctacaacttaaattcactgttgtaaggtagcctagaaagatgagcaaagatgcacaccctttagaaatagattacccaggaaaggtctgacaatgctcaacactctgctgaatggaatataataatcttctgaccattcccatttcccattcttccctgacacctgtacttcccattttctagatagttagttcctgacataaaatctcattgttactggtatatttttgtgtccaaatttgatacctgataaaaactttcaggattgacctaaaaatataagaatcattctagttatatagtatttattccatcaagtttactcatgttggagtacatattttatggcacactttctgtcggacaattagaaatgctgcttacaataaggagctataaatttcaccaggtattgaaatgttaatgtttttagaaatcatctgctcatagctgaaccatgacaattctactcaaaggagagctgccatcctcaaatacgtaaatctattcttaaagacttcttttaatcctcacaataaaatgtgtatggagaaatcaccctcagaagatattagaaacaaaacatgaagtatgatggaaataatgcaagtgccaacaaggtttaaaacaaattaaaaactttagatggctcaataataaaatataagtgtaacttaacattagtacttctaagactttttgcaaatgttaagtggtacgaagaaagtttctccttttgaaatgattacagattaacttttctcaaaatctctttctttttttgtgacaaaatcctgctctgttgcccaggatggagtgcaatggcatgatctcagctcactgcaacctctgcctccctgactcaagcaattcttctgtttcagcctcccgagtggctgggactacaggctcatgtgcccacgtctggctaattttttttgtatttttagtatagatggggtttcaccatattggtcaagctgatcttgaactcctgacctcagggtgatccacccacctcagcctcccaaagtactgggacttaaatgaatatttgaaataacagcaataacaaaatctatatttgatttatcaggagagatccgaaatcatagaattagcaaaagctaatatttattgtgtcctgtggtagaaatcaggcatattatgaggcaaaaagctcagatcactattagataaacatgttttatgcatatttgggaacatccctctaatattacatggtcttaacacttaaccctctctgataagtaaatttgcaaaaacaatatattttaaaattgtaatgtaattccagatttaccacagatattgctgtggtagcatttatgcataaccttctaatgaggcttcagtgtctgaggtttaggaaatatctcattcgaaaactgcagggccttaggatttttgccaagtaagttttgtattagcaatgcttccattgattgagagagagaagaggaaaaaaggatggaaaaatatgagcctttttctccctcctcatttatttaaaaactgtgagttacacattttaatctttttacaaaagttagtttacttttgcccttatttcaccataatatttccagattttaaatataaatgagaaaaaaatgccttttgtcttaggaggtaaaagacaaaattttttttgtctcactctccctattgtttttattaaatcaaaatgacatattcctaaatgctgtaagtatttaataagactcttatttgttatatattgatttttttaaaaaatagacataagacttctgtttgtatttaacagtttgctttttccctctcgttttaatattttattttatttatgtatttatttattcttttttgagaccaagtcttgctctgtcgcccaggtgggaatgcagtggtgagatctcagctccctacaaaatccgcctcctgggttcaagcgattctatagctgggattacaggcatgtgccacaatgcccagctaattttggcatttttagtagagacggggtttcaccatgttggccaggctggtcttgaactcctgacctcaagtaatccgactgccttggccttcaaaagtgctgggattacaggtgtgagccaccgtgcccagccggttttaattttgtaattacataagaatgtctcattcatgacatgtatgcatatttcttggtagaacacaatgtattttgagctggaatttagataacattttctgaactttatagggaagagatggaggcagagcagagcacatattgttttctaagtgctttaaaatatcttatttttgtatgttggtattttatatttattatcatcttcattttacagttgaggaaactgagacaaagggaggttaaggaagttttccaaagtcacacaattggcaagggatacatcaattccagaatccaggtttctacatgacagtatataaagcagtatgataaacatttcatttgattctgttctataagttattcagatactattgtatccttttatacatgatccaagatacagattttgtgtgttttttttctgagtttacatatgtagtcagatggggcaacaaacctagaatctccaggttttgaagtcttgaaccgtgcaattattgcacatgaaaaaaaaaatactaagctaagacccatagaaagcatggagtataaaagagtaaaaggattttcctagcatgaaggtagcttccaccaatacaagaagtacagacattagggcatgtttggaaaagcagatagtccaattgtttggaaaccctcagtggggaaaaactgaagccatggtgtgtgctttgtgcacaagaaaatcagggataaagtgaaagttaagatcaaatacattagagcagctgagcattattagggtgaacttgacaagtcatttcaagtctccgtgtctcagtttttctatctggaaattggggaacatcatgtgataactcatgagattttaatgtttattaaatatgttattacttgtaaagtgcttaaaatagtacctcatatagcctcatatagtaggtactcactgtgcatgtgtgttgtgtttaaacaaatagtccgtaatttgaacatctgaagaatttcaagaataacaatctgtggaataaagttgagttttaaaattagaggatttcattggatattattatgaagaagacaaccccagggataattaaattagcgctcccgaaagcctcacaccctcattatttgttgttttgaagagtaaaaatggtacaactttactttcttgggccctattactagggaacataaaggaagcctgacaaagggagaatggaatcattaaatggagaaatttctatataaaaattaggcattcatcatctatcattttgtaggaaatagagtacttttgcaaagttttaaccagggaaatgatataaacaattgtaacatttattgagcacttaatatatgcttggcactactgtaagtgttttactagtactaactcatttaattctcaaacaacaaaattatgtcacacagcaaacaaatataaatccaggagttctgactcaaaagaatgaactctgaatcactcttttgagagagaaagccagcactctgtgtaggatggagtaaaatggaaatgaatagaaacagagggagcagaaaacaaattcaagttgaattattaagaaatgtaatagctatcaattacattaaattattagacacctatgtaactcatcactattagtcattcacatatttgctaattttagcaatggaaatgatctgatttagttatgtgctttagatagcctctgtgagtcatatattttagagacagaaaaaactgtggagaaatcctagtttaattctgttttcaacagaaaaagaaatagataattattttttctcctatcatagttcccttcccagtttcactgagctttattttataagctggctaatcaaaataaccacagaattcaaaccttgctgctttctataaattattacagtatgcaaagtgaaaagcatgagttcaagtcaccactatatgtttatggagcatttttgaaatattggattaagctatttcacaaatcattcacagatctgtagccaatggatagggatgtaacagccagatgctctgggaggaagatacaaagatgaaactataagagctttataggagaaatatttgtgaaggataaaaggcagatggagctgagccaggcaagcagaacctcagactgagatgtaggtctgtcatttataaaggcaaggagggaaagaagaaagagttgaggaggggaagccccagacagcagtgcagctctgagggttttggccaagccgatggggagtttcagagcacagatcacccatttgaggagtgttgcattgggcagggatggccaggctccagtaaccctttgccagtactgttaagtcactaaggggtacataacctgtgcttgaaggctgtagctgaaggtgctgcagctggaggctgtctgctgactgtactctctgcagcaggaacatctgagcaagcactcctgtgactgccatagaggtataaacaatagtttgctggtagtaaagagtaaagggcttacaacagtttatattatgagtgtgccatcctgccacactctgagcacttttcttcagatgctgctcacaggaaactcctaacaacctatctgtcacgtttcttttcttgcattatttaactaaccctaaaaccacatattttagagaaaatcttccaaacttagatttgttcaggctgaagatgatatgttggctcctggggaggtgatagtattcagataactaaaatctgctcttcttttgagtcctgaggtattcatgtacttaatcagcatttaccgcaagaacaacatatgcaaataagagcataaaagaggctgttccaggaattgtgtgtattttaaaatatctagagattaggatgcttatggagtttgtaggagatgtggctggggatttaaacatgaaacagattctaaatggcttttacacgctctgctatgaaatttgcatcttatcctgaaagttataaagagccaaaattttcctatgcaaaacttttatgcataggaatgacatggtcaaattcatggtttagaaggaatattctgaaagataaaatgtgtggaaagcatacaaatagagaccaaattaggaatttctaattataattcagaagataaatgaagacttaaactaggatatttaagagtgtttggtgattaactggaggcagaatgattaggagatggagaggagaaggttattttatatttatggtctagattcttgctcctcaaaatgttgtggtctggaatcagcagaatcagcactgcctgtgtgttcataagaaatatacaatctcattccccactccggaatgactgaatctgaaactgcttttccagagattcttgagtggtttttgtgaacattaaagtttgagaagcattggtctgggtcaagagtcagtaaacttttttctgtaataggccagataataaatattttaggctttgtgcacatcattctctattgctgctactcaacttgcccattctagcataaaatcagtcatagacaatatacaaattaatgaatgattgtggctatattccaataaaattgtatttatagacagcaaaatttgaatttcctagatttagaattttcacatgtcatgaaatctcattcttttgactttttacaactgttaaaagaaatgtgaaaccattctaagctcgtgagctgtacaaaaacaggggacgggcaagatttggctcctgggcttttttgccaaccatttgtctaggtgaataaatgggccatttataaaggtaggaaatagagggacagtttgttggtggtatgtgttgaggtccatgtattatatcacttttcaaatgaatatggatattggagttaaaacaagcttaattagaaagctttttataattgtatgctgagaaatcttcctctcttctctaagatcctcccataacttctggttcattcaacgagttttttgccattgaggacagagaaacccagtacagcatattttggacaggagacatttaaataatgtttgattgatgtcattgaaacaaagtatgtacccatattaattaggtagaaatttcaagcaaaattatgggaaatgtctatttttttaaacattaagtaaagaatactttcaacattgtatcagacattaagccatacttcaggtaaaagtagaacacatattaattaattaatgaatcaatcaactgttccatgtagatgttagtcatgattataatacctgttcttattttttctcttcaacctcacagctttctccatctctggtgaaagtagccaagtggtcatgatcgccatttcagcggcagtagcaattattctcctcactgttgtcatctatgttttgattgggaggtgagttcacagtctgtttcactattcactttctttgttgctttgtttgctgccactgattgctgttaaaatgtgaagagtgtgctcaataaaatattttaacaaataagaatgtctccacttgtagtttaggtcctctctttctcctccttttctttgtttctccatccttagttttgattttctgctctacattaaattcctgtccccactcttttaacatacacccctcctcttctctcttctgacactactcctagtttttactttctttctctaattatctcctcactcttcaaataaccccagatttccttgacactttctcacccagaacaggggtaacactgcacagcactaatcattacccatagagactttacccttcattccttctaacagaagttgttaaaaaatactataaacacattctaaagccattataaaaactgaactggagggtctgcacagtgggaagcaactctgtgtatctcctcattaggcagctttccagggttcccagagagaggggctttcttcagaggattttgaaaatatgaagttattaaactttcactaaagcatttaattgtttgaggaaaatgttttatttttatgctttgcacattctgagcataggtaactattttaaatatattcctcttatgtgttcgctttccttgatttacctccaggttctgtggctataagtcaaaacatggggcagatgaaaaaagacttcattttggcaatgggcattgtaagtttctaaacttggctttttgttttgcttcaccgttttagctttagcagttattgatttacaattggttaacttcctcctgacaaagagacttcaaaagtagttttatggaaaaactgagtacattaaatttattttagaaaaagagggaaattcatggttctgcattaaataatttttacatgtgtacatttcagcatacttaagctaaaataaagggtaatctgtggtttacattcaaataacgcacatgctaggtagtagaaactagtctgctctgcatggctgaaatgcaaagcgtatcttcaatttccttattactagtcctttgctaaactctaaataggagacttttctctttcctaactgccaagtaaatataaacaacctctgtttatttgaagtgccttatcccattttatcaaccaacctagaaagagcctttaaaataaactgtttattttgcagttacatgatatccaactagtagtaaagccagaactttctctccacattttaatttacccttttaattttttttaaatacacatttcagaaacaaagtgtttacaactaacaaaaagactttttttctttttctggtgaaacgaatcattccaggtgttttgcgttccaaactatggctcagcttagtgtggcaattactaatcagtagcttaaatagcatgttctcatggaaattagtacaaagactgtactcatgcttatgtgctccaaaataatctcaatataactaatgtagtcttgtaagcattaatttttttagtattcactattgccttctaaaattatttgcaaattgacatgatactttgtatcagccgttggattatcatctaaaaatgatagctttagttgtaactcaagtaaaaaacttgactacctgttgctaacctgcaggaagcatacagtagcttgaaaataatgcctttcaaaatataaattgatatgagaagaaagcagtataggagtttgaagaagcattattttgttcatccaattgcagcgtctataaaataattcacacaaaaaagccaaagtactacattcctaaaatcaacatcacatcagtccagattaattaggtgaccaactcaaaagtctaaaaagaatgcctgaacaagttacaggatccttgtctttctttttctcaatgggcccacaaaacactagtgttacaatttttatgcataaattagagcagtggcattcttgtggattaagtcaccctcaatttgacttggacaattgtaaatatcatctttagagcaagaccatgctgatttgattttttttttatgggaagcctacatcttacgaattttgagctttggtaaatttctgtgtgccaattattaaacaggttcctctatcgtcccagtctgttttgctattgtttttatggtggatttttgttgaaactttaatttttttcaaatgcacaatatccttatgacaaacaaaagagaaatgcatttcatcctggctgcaaaggcataaagtaacttatatgcatgtcataaactttctgcatcttaatactacagctggtttatttcagaccttttatttggtattactttaaaaagctctagctacgaactgttccctacagccttgttacaaatcctataatattgcttcaaaaggaaagaaatgtgtttcacctcctaagatcctgtccccttgccctttctggctgggcctttttacttctttgctatccttagggcaactcatgctggtaaaatggaaatgtaaattattgtgtttgcacagaatgagctgtaaagtagtgcagcttaacacgtgtgcatgtgtttattacctggttttcatgacagagcccagttactctgtatgttgcccttaattattggtgtgaagggattatgtgcctcgcagcctgaatcacctgattcctggaatctctggggtcagcagttaaagatcagcagccagtgcttctacagcgaacagaccattttacttgggggtgtatatgtttatgtttgtttttttcccccaaatgtcttatggatggaaaagaaattcaccttattttaattaatagaaattaataggattcattttatttgggaatggttatttaattttcaaattatttagtaatagtagtattgcatataggtatccatcatacatatattctctacaagctgactggtacttaagggtaaatctaaatcacacaatttcaagtctgtttaaggccaatgcttatttaaaatatgtgagacattgttcctaacaactcattttataatctttgtaaattctgatggcaggaaatctcccccacgttaatttccttaacttcagcaaagtaaaggagttataattatgtacaaaacagttccattttaccttatgcttaaagtatcattttatttccttgaaaaagattgctagatttctttaccttactgttactaagtaaaggcaaataaaaactggaagatcacacattatagggttgatctgatatgagttttcatccttaaaatgtaactaaattgactaaatgaaaagactccaacaagattttatttcctaacatattttagtaatggttacttacttttacaatttttcttactccacatctagaaaagtatgatagcttttccttaatcttaaagaagtttcttcttttaaaggtaaagggttttagtactggtaatgttagaagttattttaatgtaacaataaagcacaacagattactgtattaaagggtgactctcccatctgtatttataggaaggattcatgcttatatggaagaagcatataagctgatctgtgagctcaaaagtaatggacatttctaagtctaaattctaccattaggaaacatcaattatattaataattgtaaataaatgttcttaacaataaaaacgctcattagggcaatgagctctatcaatacattgagtgagaactatgcaacagtttctcatgctaggcatttgaatagtatagctttttttttttctcagagccctagcttgtcttttttgccaagatattcaagatgaaaaactctaaaagtgaagttctcacttcaacagctactccactcagagtttgtccaaagcaagggacagaacttgtatttccccatttctgtggatattgacttctagatagtggtgtcctttcaaattatccacacctcgcctcaagctggatagcagctgctcttttgttgtagctgtatcagcaccaggcagaagtaggagtcgtgttagcttttcttctgcattccctatttgccctctcaccaccatccctgctttctattatgctgtgtcaaagtcatgcaaataatagctgaggaaaatagagtttttacccaacctctctctcagccaccatttcttttacaacagtttattctcacacttacgtttttttactcaaaatctctatgaaagcttcacaagaacataaatcgtaatgcattataaccatgggtttcatgaagttgtcttgtagttcaaagaattgatcatttgttaacacatactgtgaaatcctagacttgttggcctaatgttcattgtactgaggcttcccagaaaaactgcgggcatctgcagtctccacaactatttaatacaaactacaaaactaactcaaagaaacgattggttcacgcagggtgttcaattgcaactttcccataattctcccattatgaagtaatattggaaacagtaatatctgatttcatttgttataatttaatgtaatgaatgaaaatatatttcactattaagtatccatattctgtgctaaaacacactattaagtatccatattctgtgctatgaatgttatcaaaattaaaagcaaaatcagtagtcttagcagatataccataggagttacattgcaatttcctttaattttagatcatatttatatagtttagtagatcttagaatcacttttttaaaactcagggtttttgtttagagaaagttaatttattgaaaattgcaaattgtctccactgttatttttccaaattataggaatcttattaatattaaatcaaattaaaatgattatcctgtatcagttgtctgtaatattttaactacaggatatgaacatttttaccttcagaataatttaatgaataaatataatatgaaggagatttttatttaataaattacatatatgacttacgtttggaacttagctccttagcgccattattcaactcatagacaatatttattttacttctaattatgttataaagctatacaatatgattatatttaactgatactatattggtgtgtatacatgtatgtattatatatacacaccaatataatatataatacatacatgtatacacatactaacagcttaaagtagatttgtaattacagtgggacattttgattgtgaatgttaatataagcagtacagtgtcagaaggtatgccattatatatcatttaatttatctataattgcagccattatctcaccttataattgtattgaattattttccaatcttgcattgtaatacatatctggttattataacatttgtgtaatcataaatatgcaatagcataatggtgttcactcactgttgctcctggtagtaatgactaggtctaatcagttctgaattatctttcttcttaagatccccttttttgagtatgcattttccttctgatgtttttgcaaagaaagctcctcattgtggttcctttatataattcatcatagagaacatgttttcttaaatttttcaacacagtccaatgtcactgccagtttctgtgatactacagaataaactgaaggttgtgcaccttatggggtagggatttttttaaaccaataatgccataaaatttgatctataattgtttgtacaaatctagctacaattgcgcctttctttctttcctcaaacagtaaaacttccaggtctcaggacttatgttgacccacatacatatgaagaccctacccaagctgttcatgagtttgccaaggaattggatgccaccaacatatccattgataaagttgttggagcaggtaaccacaatgaccctactgccaacttagtactgtatgtgaatcacgattgctcagtctctgaaacctaagtatattgctaaagaaatgggaattttctgatttcatgatcaaaggcaagtaataaataagtgcaatatttaatggaatgtaatgagttcaaaggtgccagacttaccggctcacagaccatggctgcttttgatttattaaatttctgatgtgacagcagcaacaactcaatcttcccatagctgtgctgatcgtgtgtcacaaaacctatttggctaaataaggataactggataaaagtctatttcaatttagacaacccaggtaatttgaagttttcattttcaattttagaatcatgtttggaattaaaagaacaaacaacacaaagtaatatcatgactcatcttacataaattttatcacaactatcttgggtggatattttaaataatataaggtgctccattttaatgcttgcttgactttgaatagtcttatgtgttaaagctttttttaataaatatacctttgttctaattattaatttaaacaatgataaatttgttaacaatcacctattaagtggttaataacagttgcatatttataagaaaaatttcatatatttgtaaaataacagtattttatatatttacacataaacacatgatatgtgcagtatgcatggaagtaaaactactattcaaaagtaaaaatgaaccatgctcaacaataaaaaattttgtaccatcatctaatccttcaatgtcactccccaaagcaaacataaactagttatgttgatacaggaattctctgtgtaacatcagatcacattttctgcaagtaccgtatttacatatttatgagtgatgtgtctttacaaaaatgtacatgtaatgctttgtttctttttctatacaccaaagtagtactgaaaaatcaagcagtagttagtatgcgaacaggacaatcttgtaaatataatgttaatttactagagcttctcttctaattatcttaatttcttatcctaaaatttacatgtgcaggtaatattaaaatatgaaacttgtgttcatagaaagaaaatggagtagtaacttcttttttacaatctaagacttgagagtaaacatattcgctgtacatctgtgctgatccagtgccaaaacagatatatattgtttactctgtttcatttcttcagtcctgacttctgaacagctccatgatgcagaagggtttagtctggctggttttaatgtttcctcacaagagtgcacttttctccagcacggagcctgcggtagcaaatgcagcacgaggactttgaacactcaactggagaatatgttgagaggaggaaaaggttacttatgctaagccactgtccaaaagccaggcagacattattatgatgttgaaatttaggtacctctccactgataaaatatctttatatagttattattgacagactcagatatacagaacatagtgatttgggaaaaagcacaccactgaaaatagcagctgataaatgagataaggggaggtctatttatactgaatcacttaatccctgatgctcattaaagattagaatagagcctccttcctatttctgtcttcaagtatatatgttaatgattagatatatgcccatgttcagggttttgcagccaatattcacatttgccatgttaagaacaacaaaactgtacttatttgcaaataggtataccttcaaggttagttatacttttcctgaaataattcaatacaatatacacacccaattctagactgccttgatgacctttcagagggtttgtatttaccaagttagaaaatgaaattattattcctaaaagctaacaatttgttaaacattttgttttgtaaaatgtaaaatatgtacacaaataaattaaatagtgtaataataaataaacctgtatgttactcatttctaaaatagcttttataacaatgaacaaatggcaaccttggttggtatatacatttacctacttcctacattcttaatcttaaaaaaaatatgttatttataaaaatttaataattattctaaattgattaccaactggcttccattgttagaaaggcaaacctttcagccaactacataactttcagagtcaattaaatttacagaaagaatatatatatatatatatatatataagctaattctcttaaatttctgtcagaaattttacataaatgaattgatgttatggaaactctcttgtatacattggactatagaaagaattatacttatactataaatgataaaattaagacatatgaattagcttcccacagtagtagattactagaagtgaggaattcatgactacaattcctaattttactcctcaatccaaccattctttcaacgattgaatactaaaaatttctgaagaaagtaaatacttagtaagtccttaatttatcctgtgcattcccatgatatttaattttattatcctttttagataggtattattatctccatttcagcacgtgaataaacaaaagctgagaatttgaatagacttgtttggatcaaatgaaaaaccaaaatttgaatcttatactttccaaatttaaagcccatgctggacactggagatcatagtagtgtcttcttcatagtatttttttttgaggattaaacaagataagttgtgcaggggacttagctgacacagaagcattgttcaatatgtgtttttattatgcttactttatgaaaacagtagaaggagggtaggctttaaagctagtgttggagggagtcattctatttaaatgtcggctttttttaattgtttaaatgaaattagcataagaaattttattttgagcagcttttacattgtgcattttaatcagaatacagtccccattcttataaatatacctatttcaaagagcaaataaaattgccgcacttattagaattaaaaaatcaagatctggcagccatgcttttatctagaaatgacaagatctgaatttttgtttcatatgggtgcaaagttaattgaataagacaatataaaacttggccagatgaaactattgcaaattgcatttgcccagtctttgttaacttttacaatacagttcttttattttttatttttaatctttttctatttttagcagctttattgagatacaatttaccaaccataaagttcagctatttaagtatacaattcagtgatttttagtatattttcagagttgtaataaccataattgctatcccaatgcagttattttaaattattaaaaatataattgaattaatattaagcatttctatgtcttttataatatattggcggctatttctagtgtttatctgatgaaataatcacattactaaatgtggggaattttaaaaactagcattgctgaaacacaattttcatgaatttcgaaggtaaatatatacatgtacatgtttatgtgtccaggtgtcccacttacaacaaagaacactcttaattggctcatttaaaatttgaactcctacttttcatatctctagtatgctatcctttacaaatatatgtccagtaagacatgagccttgttatcgccatcattaccataaccatctcttacattaacatagaatttggcattttataaagcactttcatattcatttgtcagtttgatttaaacagaaactcttaaagggtagttaggcaatttatcctttaggtgggtctgaactcagagagataaatagtgaccaacacttagatgtcacctactgtgtgtctggcactgtttcaagtacttaacatacattagttcctttaatcccacaacagctttatgaggtagatacaataagtgtcccccatagagataggaaaagataggtacagagaggttaagttacttaaaatcacacagctaatatgtggcagagtcagaattggacccgaagcaattcggctgcaggatccatgctcttaaccagagttctgtactatcactcctgtaaactgacaagtgacatgtcacttagaatatgtgatgatgacatctacatttaaaacatgctctattataccatgttgatgtatgataatggcagaactttctggttttcccaagcttagtgtttacacaaagtgaaacaaagtaaatgggagcgctctgataatgttcggataaccctatatgaggaaagaaactcttactcttgtttacaattctgagaataattttatcacaccataacttctctttctcctaatattctcatatctaaatggcatattcttccttcgaattagcaagatcaatgaactttctcaagttctactccctgattctttctgtatcctaaggaacactatagctgtagatatcattatcttctctacacttcctcaaagggaataaactagtcctgtcttgtttaccattatatctatctctgtgtgttttatactgtatgcaatacagttgctattatgaatatttattaaataaatgcatgaatatctgcttttggattttaagtgactttgccaaattaaagcataagtcattgctttgaaaacagggcaagagtggatttctggggatgagtcaagcctggggaaggttaaagcttcccagggagagagacaccatttgtagtaatgtagctggcaaatcaataggacaacctgctacttttgtggttcaaaccacttgcttgaaaacaaaaatagagaagaatcatatcacttcaatctgactgacacgtagggcatgaagctcatagaaaattcacagagagaaaattggaccaagattatgattccactccatcaagagccaaaaattaatcatataattaattctaaaatatttcaagaaaagctcatttgacattaaaaactatttttaatgtgatgcaaaacatatctgataatccacactatgttagaagttcttctgtgaacaaaggacattctatagaactcccatgtggcaatcatcatggcagcatgggtacagataaataaatgtaaagggtatctgctctaagtgagctccaaatgtaatgaattgatgattagtaaatctctcagtaaaaatgtattttgaaggtagtgtccatactagttctaggcagttttatatcaactggactataatatttaaaagtcagtaacactctatatgggacaaattctggattaattgcacattgaagacttttttttttaaattgaagaagatgaatctaaaatatttctacagtatttagataaggcatgttgtttttatttgatactgttatattgttgttgtcctccagaagcccagagacttttatagctggtatgtcagtaaagcaacacaccaatactccaataaaataaattgatagcagatgctttccttctcatttttagagtctgaatatatagccatattggccctcggtaaaaacagaattgttaaaatatctgaaatttaatccaatgctcacatttaatcactgttggtgctgtcctgttaatttctctgaggtaatggtagctatgacaacaaggggtaaaaaatctaacatatgcagctttcaacttatctctccttttacattacattatttatagtgtcgtactttaaagtatatggaattttcacaaggttcattttccaacagggggtgactatcctgaggttttctaggcagtttcatatgattatctttcaaaataatttggagtactagagtgtacatcttgcaggtcaaaggcacaaatattttaaatggaaattttgaaataaaacagttgctctctactgatgaatttttattatagaattccttacattttgttgctgttctgctttataacaggtgaatttggagaggtgtgcagtggtcgcttaaaacttccttcaaaaaaagagatttcagtggccattaagaccctgaaagttggctacacagaaaagcagaggagagacttcctgggagaagcaagcattatgggacagtttgaccaccccaatatcattcgactggaaggagttgttaccaaaagtaagtaaagtagtcataagacctgtgtttccgtatgttgagcaaaggttgtttaaacccaaccccaaccatttaagaattttggctttttttcataagtatctcagttttaccaaaaagaaaagtttaggaatagcatgcctttctttgacagtagagcagacctttaaataatattctattgacagtactgttttagacctcaaaaaattttaaaaaaatactagaagccacatattagaccatttaaaggtacgctgattagcagacagttaagagaagaattgtggggaattctcggctatgtaagtagcaaagaaaaacaatgactcaagcttgacaggaactcccagctagctgccttttcttttattgttcatcagttttatttaaaagttacaaatctttaacctcctcccaccccctgcatccctgcctttaggaaaattttgggagtctaggaaatgcttctgagctgtacagattggaatcacaatagacccaaggccgtttcttggttctctgtggattttaaatagttctgatctagaaacccaggtggattcttactgctctgtggaagctctggctcacagcccatgatagagatgtgaacttatttccatgatggtttctccagcaggtctcaaaagggatcctgtgaggcggatctgtgatttttggctccaatccctatataagtctcttgagaatactctgggacatttttcctcaagattttggagctcaggatgaagaataagtgaaattggcagcaaactttttagagtgaaagacaacatatggcagggaatttggcatcctttaggggataattcattggcaccacatttacatactctatcgttaccaacagacatatttttcataattatatttctctttaccattttatagagcattttccaaatggcactaatacttattctcactttagcatgactaaaaaggcatttccttcctcatgagagcatggtttaattgaaatagactttgatttccttttgagttttcatatataaaaagtggaattaagaatttaacaatgtggaatagttcaacatacattgtaagtccatattaattcttataaggctttttatttgtttgcctatgtactctacaaaaccaggccttattaatagaaatattttctgataaaaaacatttttaaattttaagttaataattaataaaaatgggcataattagtaaggattgggaaagtgtatgaatcctttgttctttctgagcaaggctatactgttttatgtctgtacagttacagtatcatgtctcattgggattttagtgtcatttagccatttaatgttctccattacatctgcatcaagtggtggttgccttttagctcttgagcctcctgggaagagaaaactcccttgtacttatgaagccattcttctaactctcaatttttacaagtttttcattatgaagtatctgttatgtgcccacattatactatgacattatttcattcttaccactaccctgtgaattagacatgataatttctctcttacatttgaacaaacaataactgtaaagggtaattagcttgtataactagaaaatgctagaggtagcactgggaacttgttctgttcatttcaccccatccccaactctgaacccaaacaggtttctacttgtcttttcctgtattctacttattcttttatatcgttactttaaaaatcttctctaacatagtgagacattcctcaatcttcaaaaatttctggaactattaataatccttaatatctaaaacaaaatataaactctcaaagagggcaaaaacccatgttatttgatgacaagtgactaaaataaatcctggatcataatagatacttaatttaccaatgttgaaaaattaaaaaaaatattgatgaaggaaggaaggaagaaagaaaagaaggaaggaagggaggacacaacaatatcttttaacaataggtctttctttagtatttgattcattaaattgaatacacttttcaaaggagtgcatttaaataactacttctatcacccagagagtgatgaaaaaaaatgattactttttagcttgaatagaatcataatctaacttcttcaacatgtgtaattaagaaaaaaatgagctaagagtcactatcacacaaatattaggttctaatttaagcttactaataaactcactctattattttgtcagtcatgagttgatttttttgtttcagtgttatgaattatgaaagctactccttatattttcctgtttcctataaatgcatttactggatgataagcaacattaaactataaatgttgtggcaaatttcctttagatataaaactgaaacaattaaatatagattatggtagactgacaaatctatgaaacaatctctaagacaaaaaatgtagaaaaatgcactaaaatgacttttaaaaattgcaggtattatatattaaacatcttactcaaaccgactctgtaacattctaatatggattacaactgccttattcttagggtgagagttctaaatttgatatatctccctggtcaaataagcatgtaagaagctgccaaatctgactatataaatcccagtcatctcatatattgtaaatataatagagtagtagccctagaattagattttgaactccttggtggcatatttataagctcttagtctggcacccggtaacatctgagaggaaatagaaactccttacaataaagttgatatgttgtatttaacacacacacacacacacacacacacacacacacacacacagagcgattgtgtttccaaaagaagctatttattctactgctattattgtctttgtttcctgagatttctaaaacaatccacctgcagagatcagaaagcacatctatacatgcacacatgcacacacacacacacaactagagtgatgcagagcttataatttaatgaacaaaataatattttcaaaagcaggcatatcagtatctagattaataatcaatgatctgagttcaagttctgaaacaaccttactcctctgagaactcctacaaatcagacaattcacacataattcatttcttcgcttgtaacaaaattaaacagtactactttactatttttagatactaaagatcaaatgagattacataagaatatattaagtggcaaagaactgtgcaaatctaaattactcctctggttgtttgagattttaccaatcaatttgggtgtatagaaaaaaattcttgaaaataattctttttttgctcaaagataaatctgtttattattgttattcgattgtgtgctttgaaacactaggtcaaatacaatgtatcattttcaaatcatttgaagaaaacttttcttaaagctttttattcagtcattgtattttcatttagccacaaacaattttaatgtttttgagcctgatggtcttaaacaggagaaggtgagagagtctctgatcttcaaagtagcagaaagcggggggcacaggctctgctcacaacaaggtactaacatgtgttatcaattttagctgaagttcaaaaggatagaacttgttcttagcaaatgtttgatatttctgccatcacaccattagtcaaataatgttcagactccaagaacaccttccattggccacttttcacctagcgaaatagaaggaattatattggatgagattaatgtattttgtcttgcattattttcaggaaattttaaaaaattaccatgtaacttaagtgtaactttgcattattgaggaatgtcatgggcagaacgttaagatgattttcataattaaaacttatctgtagtggcatgagtatccactttcactaaaagcttagccattggcttccagttgcctgtttccctgcatgtacggtaaggacacatttctggaataagaggtcatcatttagtaacaatgccaaattctagttattttctgtttgtttctctctaaaaatattctaaatttgtcttaagtgtactacacttcatgtcatcttaaaagacaatacatacgttgtacttactatactagtaatttacagagatagtttgttaggataacaaattttggaaactctaatgacccaagttttatcatggattcatggctgcaaattgttaaaatgagttcagaacatgtctgtctaagtaaccacatcaacaaaattaaaaaatcactgctcgatatattagaaaaatataagacagggaatgttatttttacatatttaaacagcttttgttacttcttcatcactgtccacttatgtcccttggatgaataggccattttgacttatagaaaagtgtggtattgtgtatttttctcatttatatgtataggatggttttctgatatttttgaaaaattaagatcaacttacaaaatttgttagagcacgatttgtgtgtgcccaaagacaccatttctagagcactggtttacatatacagtaaatctcctagagaaagaagaaatatgatgaagcactagtttagtagctgtctgaataactgtggtcttacacaacctttgcagaaagggaaaaaaagtatcacctctaaatgccgaggctagtaatatcttgataccaaactatacagctattatcagaaagtataataacattattgtaatgcataaacaaaaatttaataacactagaataattgtgaagccatatctgaaagtgtatcaaaaaagatactacaccatttcccaagtgtagtttattccaagtatgaaaagttggttttgtatttaacaattctaaaaactcataacattaataggtaataagaaagttctatcttaataaatgcaaaaaataaactattttaattttaattttttattagcacatcatacatagaaaatatgtattcctgataaaggtatgtaaacagcccccaaacaaacacaaacaaacccacaaatgtcacatttaatagtaaaactttaaaagcatttcttttcgagagaaaacaaaaagcctgttgttattattatttcaattcaatattgtacaggaaatcttaaacctttttttttgacttttacaaataaatcagctcctttatttgcattattttgagcactctgataatgacagtcttcactgatatttttgaaatcctgttttttgttaaataagcttttccaattaggcaagcaaataaataaaagaaagcttggaaaggagaaaaaaacaaaactttttatgaaatcaaacaacatattaagagtattatatacattcattccacttactgtatgccttacattattgtgcttactgcatgactcagctctaactagcataatggacagtaaattagttgttatctttgaagatgttaaatttcgtttcaagttaagcataaataaatataaatatttttcaagcagctgaaagtaaagcattctatgtgttaggattgatagagtagggttggttaaggaagtcttggagaaagtgtttctcatcctgattttgaagaaagaaattatctctagccagtctgaaattatagacctaatttgatcaattgtaactggcacagtggtaggtgttggatttagaactacagacaaatgggcttggtctttgctctcattaactcatagacgtaataggggtcatttccacacaataatgtcttgattaaaatggaatttggaagacgttgccctgtaattttataatgatttaataagaaacccacaaaaaaaaataccctaactcagctcaatatttcatttcaatatttcagttcaatattcattacaatatttttatcagttaggtatgatatgtgaaaatctatgatacattttttattctcatcaaagatgattcaaatcttctttcctggaaataggcaaattttgtcaatttttttcaactttccatctcccgttttttttttttttccttccatcctgacactgattatatagattgctagcggctaaggtcaaaggttttgattttataatataccctcattagagtgtgtttaatccttttgaaaataagacatagagtgttagacccaatgactgttgttaatagggagttaatagcatttccatttgaaattattaaatgtaaatatttaataatgtttcaatatctgataaacagtttgtttgaatgaaaatattttaatctgaaaaacaaagtttgttagaaaatttcaaagaaaatatctttatgactgactatatatgtatatatatatgcgtatgtatgtgtatatatttcacattattctactctataagaaatgtgattgagaaggttgtgttaaaatagctggtgctgaatctggaattcttagacattttgaatcatatttcttctgtcatcaagcggcgattcaatgactagtaatagctccgagccactggggatagttgggaaaaggaactgattataacagactgatttgcttccctttactttacaattgtgaaagatcatcattttatctaaactcataaatcaacttgagaacaaaagcaaaactccactgcaaattttgttttgctcatttttgatggtttcatttcagcaagtcatagaacagtactttcattgagtttagtatgtatacccagatgtgttttggggtttctgagagccgcaaatgatacaagctttgtctggaggaagacgatcatgtcatttgtaaatcaaaatacacctggaagagcatgcaaacttgagtacaaatacatggcataatgcgcagatgagctggcattttataaataatttcccaccacatttaatgcatgttggaactagttctcgccactacagaagtctctttttctttaaccctatttaccataatcaaaatcacaagggaaaccctaagtcaagatactgtttcccaaggtagaatatttgtaattctgtttactctttgtatatttgatttgcagaatctttgaacgtaatgcaaagcacattttcagacttgcccatcttaactgatgtgtttacaaatacctgaattctagagttaaatgcacgctgatgtgatttctgaatggtcatggggctttgacttaattgactggtttgatttttcagctacttttatttcccttcccaaacatcccactagacatgctaatgagaaatggtcataaggctgggagccagaaggaaaggagtgataagtaaaggtctgagtagtataaaaatgcagtaactggccaatgatattgagagttggtggtgtgaggcaaaatatctgtgactgcatttgaagtgtgcattgaattttggtaacatatcattcctcccagcactgtatgaaggaggaaagacagaaactgatggtgatttatagaaagtacacatatgcaggattttattcattcattcatttattcattcatttcatttcaggccaggcatctagaatcaaacagtctctagggaactgatactaattcaggagagatctaagtttccaaggaaatggtgaatcttccctttctttttgaatattgtttaatcaaagtttagttggaattttgataaagcaaattctgggggctcaaggttttgactgaagcaatttttcagatattactacattaactagatagatgttacatggtgccttaaagacataaatcagtgtcttaacggaaaatagatcaatgtatcaagtggttgtaacatgtataaaagttatctcaaaaactatagaatttaaatagatttttccttaataaataagacataattcctggaatatattcaaattactgaatgtaaaagtataaccttcatgatgctaactcataatttacattttgtacaaatcaaagagttttttacacatgaaaggaaaaaatcaagaaaaggaagttattttctagcatcagaatggcaaactaacctcatgataaataagacacataggaggaaaagttgtgttatacagttatgtgtacattaatgtttgtttaacatctgttatttgcttatgagttttcagcagtactcggttaatactcaactcacgtcttctggacttggaaaaggagtgattttccttcctgtaaaatgctggacttataactaaaatagtataagaataataaagtaagggaattacagtgtggtaatatgtataggttttgaaattagagacagtcgtgtttaaaattttcttgactgctatctaattgtattacctcaacaagttgcttaaacccacaatgttttctgggtaggaatcagtaaaatgggaataatgcatattgctaaagcataagtaagctgtgaggattaagtgatataacaaatgtcaagtacctaatgcaatgttacataattctaatcatgaaaaaaaaattaccagtatttcttttatatcaaagcatcctttttttggtatttttctttttaaaatgttagttttacataatcttcttaattgttaccataatgtatatagaattatattttcagctttgtataatattacgctgtaacaattgtctaaagtgcttaagtcttaaggtcatcattttaatttaaaatcatccatagctttaacatgcaataactgactaaatcattatctgtagtggaacatttgttatattcatagctctgtgtatccactatacttagcacctttgtgtctgatgctttttcatatgttacatttttccctcattatcagtttccgaaagtgacagcatagtgtgtacaggttgcaacttttagctttataacttgttagatgtatgatgaccagcaagttaattagcctctgtgtctcagttttctcatgtgtaaaatggaaataataatacttaatatgttaatatataaattaattacaccagcatcatgctcacaataagtactatttaaatacattaaaatgctgggttaaaggtttcatggtattttaggctacatatttgcaaactggttattacaagttactgccaatagcaattttaatttcagttttattttccatttaaacatagcattcatttcataatttttaagtgttaaacaaattttgtaaataattataactattattctgaattgttttgtagaactcgtgtagaatccataaaggcagaaattttgatctacttgctccccactaagcggcacaaaagagaacacctagcacagtgccctacacgtatatatgtgtgtgtgcacatatagcacatataaatacccatagaaagaataaataaatgttaaattcctaacattatcttgggcttggaggcagaaatatttggtgttgaagataagtgagaatttaattaaagagaggaaaggggcatattttttgtttacttgaaaggcctgtcaaaccaatttagatgctattggtcatgggcctttgttctggaaaccaatcttctccaatttttgtggtttttaaagttttattttctaatgaaacctagggctttttaaaatttttaaaaattagaagacaggcaaagttcttacatctctataatcctcaggtaaatccaactatattatatatgttcattgtataatacttgaactgtactgattattatttattatttactgtatatctaggtaagccagttatgattgtcacagaatacatggagaatggttccttggatagtttcctacgtgtaagtaagatgcacacacatacatatatatgaataaattgctgaaaacattagagacaccctccaatattgtgccaagcaattcagtaatctaagtttaaagtaaaactgaaatcttctgaggctaaatagacagagaagggctgtaaaattgcatctttttttgcagcattcaaatgttaatggtttatatttttaaaacaaatttgtgagttcttcttcaaaagactctttttatactgccaagattcacactcgttaaataaaaataaaaaagaatcctaaagcaagtaataaaacccactgatgtaagacagaaagtctcttttttaagtaatctcagtctgatataattatttaatcacagtctgatataagacagcccatctactttccaaacagtgctgtcagaaaataagcatgtgctataatgctaaagtatatatagttttaatttagatatatcattttgctgttagatatgtacattaattttttagattgagaagctttatacgtttatctatcatctatctatctatctatctatctatctatctatctatctatctatattttttgagatggagttttactcttgttgcccaggcaatggtgcaatggtgcaatggtgcaatggtgcaatggtgcaatggtgcaatcttggctcactgcaatccccgcctgctgggttcaagtgattttcctgcctcagccttccaaatagcagggattacaggcgcccaccatcatgcctggctagtttttgtatttttagtagaggtggtgtttcaccatgttggccaggctggtttagaacccctgacctcagatgatccgccctcctcagcctcccaaattgctaggattacaggcatgagccaccgcacctggccatattttgacatactatatttcaccataagaaagtgaatatattaaatttacatctatttcaacaaatgttatgttcaacaatttcatgaagttcaagacaataccaattaccagtcattgcaggcgataagaaaagacataggccctgtcctcaaggtgcttttgttgctatataaattgagatgggcagatgacagaaagatagatagataaatagataaagaaaatatgtagtatcattcataatcatggaggaaaattttaaattttctaagactgagaaaggatatgctttatattaaaatccattagccaaataaaaattttaatagcaattattttcataatcgttatttcaaaaataaacatttccaaaatcaggtgagttaaaatattatgataaatattctttcaaaattatcgtttgtaattaaacatggaattttatataaatacattatctatacattttaaaccttatgtttctattttaatccaagattaaattagattggaagctggattatgtgatttagtttcttattgctttctattttgtgactacaattcagaagtgggtagaaaaacaaatatccaataaatatttttgactaattatgaactaattatttatgataatgtttaaaaatgtagcatccaccttatttgaaacaattcataaaatatcaggaaacaaagaaggggaaatgaaaattcaatcaaacaaataaatatcaacctaaactagccacaagattcatttcacttttttgttcttaaccttaatgagtctgagcaggagttagtttttttgtcacataaggaccaggaaagtccttgcttttaaactgaagtcaaagaacgttaagatacttcctgttacaaagtatttgataacatagccagtgtgttattttgtttcagccttgtatccatttgccacatatctttgtcttgagtgcttaggactaaagtgtgtatagtcagtcttgttacaaaattcaatatgtgagattttaaccaataaagatatatctttaagaaataggaacgtatcttaattgtacatttgaaatgcttcccagaaacacgatgcccagtttactgtcattcagctagtggggatgcttcgagggatagcatctggcatgaagtacctgtcagacatgggctatgttcaccgagacctcgctgctcggaacatcttgatcaacagtaacttggtgtgtaaggtttctgatttcggactttcgcgtgtcctggaggatgacccagaagctgcttatacaacaagagtgagtaacttagattttctccttttttatcattgttttccatcttgtatcatgttgatttgtaaataagtagaaatcatgacccaaaacgtgttgtcaattatgctttccacaatagaaaacatatcttaaaattaaaatattattatttattctgggtaaatagatggtcactgtttaacatttaatgattttaactctgaaattctatacctcagtttaatgttccccaccaaaagcagcaagattctcacattcctcaaatcttgatatttttaaatgtacccatcttttcaccatggttgagtcaccctgagctagcagattggataaattctaaggaccttatcccagtacatatcattttaaagcactttcaaatcaattttttaataagtaatacctatttatactgtaaaaatgtcaaaacagacctataaagaaaagttgtccataattgtgccatccacagacaacatttataagattgtgagtcaattcttacaaatttttcttcatactcatatgtacaaacttgttcatgaatatattatttaaatacaattattcataatacaattgtatgccatttctctccttaccaatacacttcttgaatatatttcattgtcaataaataatctttaaatttttacatgtagtaggttgctgtattctatattgttgtatcttttttaaagcaaaccctaattagtgagcaaattattattatatttaatttttccatattttataccaatgtatgtgatctgcctgcattcataattgttatgagcctcatgattttctaatgatacattcctaaaaatgaatgttttgtgtcaaagattacgtgaatattttaaaagcacactttactacactcttgataaaactaggtattttcattaattttactattatcagttaggataaattgaatgtatatgttttaatttgcatccatttaattcaaaatgcatttgaattttttgtgagcttttctgttgttgttttgttttgtgtttgttttttgttttttaggcagggtctcactctgtcacccaggctggagtgcagtggcacaattacgactcattgtagcagcctcaaactcctggcctcaagtgattctcccgggctcaagtgatcctccctcctcagcctgctgagtagctgggattacaggcatggaccaccagccccagctaatttttaagtttttctttaaagaaaattatttccatggtagaaatttagaaaatatagataaaaaacaagtaaatgtctaataatcattactattaatactacacaaacataattattagcattttaaatttagcctttcgatttttttaaataaattttcacaaataaataactcctcttttggcataaagttacaaaaatgggattatactttatatactgatatataaaatgatttcaacataccgataatttaggcactttacttatatataaatcaatgccattttgttttctgccctgttttaacttaaaaatataaaatacataagtttccagatgattaaatatttttacaatattcaataatgtctaatactctattcatatacataatttaattaaataaagcactattaattgggcagaattacaatattttcatattatgagtgatactttgatgtcatgatatctattttgtgtctgtccatgattacctccttgggatatttctatagaattaacattacaggatcaaaacgtatacaagtatgtgagaatttttggcgtatatattgcccaattgtctttgctgtagtttgttatcaattttctctcctaatggcagtatctttctccatattctcatcagctaagagaataggtggttccaaagatggtagtcttctgctgtttcttattatctaattttaaaagtttattcccgattaaaaaaaaaagctcatcctatttgcaaatcactcgagaactccaataatcaaaattgtcacatggcatgcatatcatgctataataaagaacctaatatgccagatagcatttcatccacaagtaaagccgcaataatagaaccactgaataataatgacacaatgctgttgggatatttctagatgcattgatataggaggtaggactctcccaatggcttttaataataaacccttttgtttttccaattttcaaatatactctgtagtgcatttactttgttcatgaatctaaatttttttttaatctgagtattttttaaaaagtccttagacacttaaaatgtgtcctacataaaaatgttgttcttaacaaacacaattcaaatggataagagcatgacaaattaagacaaatttcttatcttgtagctagttgaattaaatttacaagtgactacaattatatagctctgaacatgatgaaattgccaaacatgggatcaatacctcaacagtgctttttagttctccttctctgatcaccagaaaaattagtcagccaatgtatctgcaacaaagcatcattttaataactgagctaccaattcagtagacactatatgcagcaagtgatacttaacagtcttagggaatgtatttcattctactcacttctactctttttctaaggctatccctcttaacctgtcatgacataagtacttctaagagtccatgaaaagtatcatgcttacttatattgtccgtgttacaacaatcatattatgccagaaaaatacttttaggttaaataaaaactatttgataaaaaaattatttgaaatgttaaatttctggttattcagtcaggttctaatttctatgccatattaaattatttatttatttatttatttattaatttttgagacagagcctcacgttgtctcccatgctggagtgcagtggcgcagtgtcggttcactgcaacctctgcctcccagattcaagcaactctcatgcctcagcctcacaagtagtttggataacagtggcttgccaccacgcctggctaatttttgtatttttagtacagacggggttactccatgttggccagtctagtctcaaactgctgatctcaggtgatccacctgcctcagcctctgaaagtgctgggattacaggcgtgagccactgttaccagccccatattaaattattatgtgagagcatctctgtccccataagtaggcttgattgccaggatactcaaaagaatagtttctctggcaggaattggaaacatttgtccaactttagatgattcatactctggagaacacagggggttaactctaaatgtttcctttacactgattgttgttttgtcagggcctctttagtgttagaagaaaagtgtcgtatggaaattgctctttaacatttctgaaataaaagtgaaacaggctctttgcatttctgttccagtcactgaagattcttaaaaacacactgaacaaataggctcattcaccaccaataaatagctgtttcgagttcttcagggttcatctttgtatttccttggaactccctcaaaatatccatgggagtcctggctttcttccgagaagctgtaatttgcatgtgcgtttctagagtaatttaaacatcattgatttaatctctcataataggccttattgagtacaataagtttatagtttactctaaatatgaggtatggttatgaagtaataagaagacttcaattttttaaaaaaacaaatataccaaacagctaaatgaggcagcattctaagttttccttttggaaataaatatatacttactccaggaatgctgatattgcacaaaatgttttgggaatttctcttttggaattatatttaaagctaaattataactgatgcattaatcaaacatttttaagcaggtagtattttgggatataggcttgactaagataaaatctggtctcgataagcagagtggggtggctcacgcctataatcttgacacttcgagaggccaaggcaggaggacctcttaagctcaggagtttgagaccagcctgggcaacatagcaagacttcatctctgttaaaaaatatatatatatataaatatatatttatatatataaataatatataatatatatacacttttatatataaatgctatatctatataaatactatatctatataaagtatatatatactatatagtatatataattttatatataaatacatctatatatatataaataaattatatatgttatatataaatactatatatatgtgtgtatatgtattaaaataatataggacaggtgcggtggctcatgcctgtaatcccagcactttgagaggctaaagcaggcagatcacctgaggtcagaagctcaagaccagcctggccaacatggtgaaaccccgtgtctactaaaaatacaaaaattagctgggtgtggtggtgtgcgcctgtaatcccagctacttgggaggctgaggcataagaactgcttgaacctgggaggcagaggttgcagcgaacggagattgtgccattgcactctagcctgggggacagagtgagaatccatctcaataataataataataattaattaataaaaataaaaacatatattaggcatggagacgctcacctgtggtcccaactactcaggaggctgaggtggaaagatcacttgagtccaggaggttgaagctgcagtgagctaaagcctggggatggagcaggaccctttttcaaaaaataaataaataataataaatttaaaaggaagaagaaaagaaaaagaaaaaatactattacatttttgtgtatatattgtctgtttgtcaacccaaagcaatatacccagcttagacatctgtcttgtttatttgatttagtgtgctctgattattgttatttcagaaaaacaagttcatcattcaaaacaatttgctgaggcattccttttggataagagatcctggttaatctgcattaaaaagtcagtcacattaataaagtttaacgcagttcatctagtgtctgaagtttctacaatttggagattaacatttggtgcctcaatgcaatgaccctttcctggttgctcctctgaaagttactgcctgtaggtagagcgtagttgcactgaagagtcatgaaggacatttgaatcaatgtcagtggaaaagaatactgaacatagaatgtctgtcgctcttgttttaaaacatctctgtgagtgacaggcagaatagaggaatgtatagaaattatataatctaattatgtatttaaaacttcttaaactttgaagagtatttgaggagttgaggaaacacctaagctcaaaacttaatttatcagacagtcaaagatattttctcacactgtgttctatactgtcttaggtgtatcacaagctttccttccttatgttctcgacagcatgccggatatgaaagggtcagctaagatagtactatacatttttatgtttattttctcttttacataaggatattgtgtaaggaatcagatttttttccccaatactcacttgttgttatttcttctcatttcttactgctgtgttacgcagaaattgcaaatgttgatattttccattatacaatgttattatgcatcctgtaaaactccactgtactctcatgggatgttcagaatgaataaggctatgaagtttcagtattattatgaaaatagtttctatcttgtggacccctaaaatgctcttggggacccacatacatgctcggatgacagattgaaagccactgttatagatactttactaggaaaaaagtcccttaataactaaatgaatatttttgccgttattcactgatataaatctaaattatggcatagttttatgtgatataatatattttaaagaagtagctttgaaagcagaactgcagctgcataccaaagtttgcaaatcatcttgaaagtccctggatttcgtttgggatggatatgattagaccatttagctccacaaatttaaatcatcaaagaagttttgtgtctgaaaaaaaaaacagaaaaattaattcctttcctctggtttctcatcatgtgactttgaaagtataattataacatgtttgttatatttttgccctggtctactaatttacttcattctaacagaatcatgacactattgtagaacagtttgccactgaatgatttttcaatttttgcttctatgaaattttatctttaactggttagtatttttgtatatatgcattcatgcatctatatagatgaatatttctatattcatatgttgaaatacatggaatccaaaattccaaaatggtagtgtttaattttctgttttatacaggatcaagttactgaaagcacagacttttatcttatttagatgctgggtaagccatcacttcaattcttcctatgtccttaagttcattttgggagcataattaccacataaactgagttggaaagtttgagaaaacaaattgaattgtccttggctatattctccattattcgatttttttcttttcatttctattctgaagttgcctacttagtaagtactaactagattttgttacaacattttattttacataataatttatttggctttttagatctgtgactctgccatattgatgccagatatattctatacaactttgttttgtttgatttcatttttgtttttttgttttgttttgttttgttttttttgagatggagtctcactctgtcgcccaggctggagtgcagtggtgggatctcggctcactgcaagctctgcctcccgggttcacgccattctcctgcctcagcctccggagtagctgggaccacaggggcccatcactacacccggctaatttttttttgtatttttagtagagacggggtttcaccatgttagccaggatggtctcgatctcctgacctcgtgatccgccagcctcggcctcccaaagtgctgggattacaggtgtgagccaccgtgcctggcctgtttgatttcattttaaggataaggcaaaaaaagaaaagtggctaagcaagtggttaaaagctaagaggttaaatatttcctttcaggtaactccaatctaagaacataaataacagaaaacaggagcctttgttctgtaacattttcaagaaccaaaaaaaccatgcttatcaaaattggtataatacaaaagacacatattaatttgataagtaatatatgtcgcatgtcatttatacctaaatgaaaaaggtaataacaaaatatctaatttgtgtccttcatatagtaacagtattttaaactgtgaaccaaaaaaagtcaactacgaatttattgcctccccttatgatcaatatgaatatgcctgcatgtagcatcagaaaatacagccacttattcaataactagaaaactctcaaaggttcagtgattttaataattaatgttgaatcgacacttaatgaaaagtctagtactttctacccatctatttcagagagatgagtagcatgaacatttaaacatgtaaaaaacaactatccaggtttatgtggtgaaaaattacaactataattgtgaagtggaacacaggagcacacaagtaaaggcagaaaagtaaaatgaggaatgcaggcagtctgtagagaatgcaattttatataggatcgtcagagaaattggtaaaatgacactagagcagaaaatgggtttgaatgaaggagcaaatactgaggctaaagaaacattaattttgctttcactaattttcaattgaatagaataattttaataattgcactgattccaagaggcccaccttgcaggaagacaatgtaagtcattagattaattatttagctcagactaaatgtcaagctaatagtaactagtcctctttttctattggtgatgcatgcctttagtcccagctactcaggaggctgacgtgggagggtcgcttgagcccaggaggtcagggctgcagtgagccttgattatgccattgcactttaggctggggcaacagagtgagattttatctcaaaacaattattagaatgaatttagtattatttctatcatttcaattgcaaattgtcagtatcccctgctacgtttctactaatttaccatcgcttcttcaaaaaattgtgttcagagtgctacaatttcagactttgaaatgaatcactataacttttaaaaattagagattttaaaaactggagattgaatatatataaaaaatacaaaatttgacatttaaaacctcattgaacttttaaaaaagccagactcatattaaggcacacacacacacacacacacacacacacacatatatatatgtatgtatgtatatagacttactccccgatgtttgcattatttttgtagaagatagatatcatacatcagattacttagtttttacactgtttcatgagagtccgaaagtaacataagcattatgagtttgttttttatttcctggttagccattataataatttggaatatggagattttcctgtatttcaagtaatgcttaatcatttcacatgatgttgaaagatctcaaaagttcgaagaatgaggttttgctacctaaaggatcatttatctctgatctcttgtggcaatcaacatttgctgaaactattctctcagtggcgctgagatttgaactgctggggataagactagatgcttcctttgggagccttcttggatcacccttcaccttgttgtctgcagtgaatgaattttagtccttgacaatacatagatgctaaatcttttagccaaataatttatctctatagttccacttttaacctgagaagctaatatttccctccaggttaaatactcaattacttgggtttactcagataaactctccaaagtcctttgtcactctaaatatgacctgacaaagctcaaaaacaggaaatgtgaattataaccagcaaacctttcctaaattggcaggcagagatttgtacatataattacagaaacatttggcagctatgtgatattatgcctcaatacccagaaatttcagcaattacactccttctctttagaaatcagaacttgaagccccgtaacccataccgcatgagctgacttcagttaagctcctgaaaaattcaggcttttagccacatgtctcattgaactgtctaaattcatcgagcttagggaactgaattgcagaatctttcaagaacagggttaccgtgtgattcctcatctaactgctgtatctaggcaaagtggacaaggttttagactctcaactaatcctggagtggagtttagcagttatgtagtgcctttttccagagaatcactagcatctttacctgtagcactttattcatctcctttaccttttctgtaaaactctatagacgtaaatcgaggtgacacccatgtggatatgcaatttattccaaagttagtctttctttaagagtccaaaataattaacattgaaaatgtcagcatccttgatactcatgtaggtttaagatagaaagttcaaagagctatggtcataagtcagcaaagctgttaagctgttagataaaactgaatgtaaagtcaaattttatatagtccatgaccctgtttttgaatgacaagacagctgtgcagagaggttaagacacctggctaaaattaaacaggaaggtcaaaactgaggccagaaaccaagactcctgattcttattaaacttcagaatccaaatggagcaaatgactaaacttaccctgtacctccagttatttagctatacatagatgagaagtcagcacttggaggaactggctgaaggtttggcactggagatgtaaggagcaaacattagcttctgattctgttaagtttgaattggaagtctttctgaaattgaggttttagatacactccatatgctatgattctgggcttgctccaagcaactggaagcttttctgaaatacataaatatatcttgggagcttacattaggatatagagaccagtaaaagtaaatgcttcattttaaatgtttaaatatggttaaaaaacacatcttcataaataattgttatagtgactagctgagcttttataatattctaaatgcctagtgtggcacatccctctaaagcatctacattttaaaaatgtccttcacatatataagctaggaaagcaatttctaaaccagaaaaaaataacactcatgcaatatgagcttgaatttgttaaggtgggaggtgagaagggaagaggaatttttgtggtcacaatcaagaacagaaatatgcatacgctctgtgatgaattacttgtaggaaacttagactcctatatattcaatttattttagtttgatagtctcagaactacagatcctcagcttaaatgcagcaagtcttattgtaaagtgtgactcagttaaaatttattgccccagcttcttcttttaaccatatttcagaaccaaattgggccctcaaggactcttattcgtgtctctctatgccaataatgtttacgtttttgtagctgtagacagtgtttgctgttggagcaagcacttgtatcttactaaaatgcttggttacttatacctccatttaataaaaaaattgatgcttaatttataaagttaatttaagttttactagcaaacttaaattaacaggaagttatcctaaaaaagaaaaagaaaaggaaggaagataggaaaaaagaagaaaggagaaaataaaataaaacataaaaaaattccagaagggatattattacatcatcaaaacccaagtattaggagattggctctggtgaacttgacccctgtttttctattagtaaaggtatagcctgtgacaggggtataaaatatccctagaaagttgatttcacttagtcaatataaaatcccacataatttgtagacctcatgtggattactttcccttgatgattgtacaacatttaaagcagtagttcgcaaatggggatgattttgttccccagaagatacttggtattgtctagaggcatttttggctgtcacaactggggagatgctaatgtaatctagatgacagcggcagaagtgctgctagatatcctacaacgcacaggacagccgtcacagcaaagaatgatctcgggtgaaaggtcaacagtgcccttctagagaaaccttgcctacaaggttcccatcatgtgcaaagaatgggagtggggatcaaatgtttctctcaggtactttctattttttcctgtccatattggactgcaagatgcatgggacaatatagactacaccatttgtgaaaaaatgtgcaacagactagccatctgttatcaggcctcctagaatgtgaaacttcaagctatcacaaacataatgcaacaaatcataagtcttgtgtgcctgttaaaatttcattttcatttggtttcaattaaacacttaaattacttaccaccctccaccccaggctctaaatttcaaacatagccactttagttgtgatgttctattttcattttattaagacatcatggagtaaaatcatacatagatgtatatctctagaagataaatatatcagatattttagtcagtatataagtcttacccttgtgtaatttttttaatgttttaacattttacttagcctcattctacaaaggggtaacgtccatgtgtgtagactaaaattattttttaattaattgtatttttaggttggtgaagtagctacaacattaatattgaagcagttgatgtagaatgtgtattgtttatggagtcaaatgaaaatctttatagcattctacgaactctaaaacacataatccatacaacatcctgtgacatatttttgtaattctacagatactctaaaaaagttgatgctcagtgaatcttatactaactatcgttgtggagttcttaaaatgtattaatgtaacaacactattaaatagtagcataagaaaaaagaggacattagaaagcagtatgatttaagaaaataaactattatgtttatattggctcattcacattcacatatattatgaaaaactagatttaactcattatcaactgaaaatgaactgcacctttaaaatgcacaaaattatcagaaatctttagaaaaatctactttcccaggtccacaaaataaatcattattctcacttgacagaacaacgtgcttttttgcaagcaacaaagttttgtaaacagcagaggtagaaaataagacatactttaaactgggggaatacagtggtgaagggggccaggtggttattcctctggacatcccagattaggcaggataataaagcagtagaaagatcacagaggatggaatgaccaactcttgctggaagactcctaaatgttcacccaaagagtttacatttgaccaagatgttcagataagaactttacccagttacagaaaaaaggaaaaaaagcctcccaaaaagaaagaccatgtatttgggaagatagcatgctcacagggggaattcaattaagatcagtgagcatctgttgaatgcctgcactgcacatttgccaagataataccaagataatactacagagagcaagaaaactgctctctgtagtgaatgtgtattgtttatggagaacatagtttcatgtgagttaatactccttatcttcagctttataatctattcagtttttcataagcttatgatttgaaataatggttcgggtttactatttttatttgttgcaattgatatgacaggcactactgctactacttttactagtgtagaacataaagagtttgaaactacaatgaagaatttaaagagtttatgagaatgtatgtatctatcttttcttaaattccataataattttgctcgtttgaaatttcacctgtagtttgatttttttttttacttcaaattaaatgtgtacaatgttggtttattattcttttatttttaaagccagagcaatttgatattatttgcttgccatagaataagataatttttaaaaatttctttttatctgatttagtattaattgctaaatttgaattgtactttgtagttaacagtgagctttcccttgtagcatcttttaataaatttgttatattgacagtaaatgtaacaattaaagggaattgaaaggaaggaacaggcataacatttattgaatgctctattaaggagcagacactttttaaatggctttatatatattataaattcatgacaaatgacaaaattttctaaataataatatataattctcaatcatctttattctcttcctgtttccctcaatgatggatggcatcatttacaatatggttagatagaaaagagataagagtcttgaatctgtgattatttcattattggagctaaactaatccgtctaataagctacctattagcagataatggaaattctctaatgaaaaggctaaatgtttcatgaatattgaatacattctgggctaaacagctaactcttggccaggtgcgatggctcacacctgtgtaacaccagcactttggtaggtggaggtgggaaaatgacttgaggccaagagttagagactagcctgaccaacatggcaaaaccttgtctctatcaaaaatccaaatattagccaggcttggtggcgcacacctctaatcccagctactaaggaggctgaggcacaagaattgcttgagcctgagagggggaggttgcagtgagccgagaacgcactgcaccaccgcattccagacctaactgtctatggacttcaacactaaaattgggcaaagcaaatcacttattcacatcttcttctaaagaaagagtttaaattagccccagctcttcttttagactgagttgtttggatatcatatataaaaatataaattaagagtttttcattaaaaataaaaataaatatgtttacttctaagtatataagctcaattaactgtgacctgggacagaatctggccagcgaggaaaagaactggtacaccaaaagttgatcaatagtagtatctggataaattacggaaacatttaaagcactgcaccctggtttcattgttgaactgattgaatgccacttaatttttgagtgtttgtaataacatgtccaaaataaaatgaaaataaatgagattgccccacttccttatgctttcccacaagggcagcaactgaacccttgatatagttaagagacaaaaaggaaaagtgtaaatcaaaaacctgaatgacacaagtgaaaagaccatacctacatttccaaagctagcaaaacttgtagcaagaggcctttgccatttcacaggtatctactgcacaatgtggccaagatacttttccaaggtaccacagtgagctaagagccagaatattttgttaaaaattagtacgaaggtaaagatagtataaaggtcacctgatcagcaagtatgttacattgaaaggtttaaagttgtcattctaacaataatatgtgtgtgtgtgtgtgcaggctacaacaattacaaaacacaaccagaagagcagaattgaaaatttaagtttttcttattaaaataaattactatacatttttccaaacatgcatcccatttgtttaaattttaagcattttaataagatttacacaggttacacaaatagaccacatgtaattgggaaatattctggaaataatttgcttgaatctgtaaccatgtatttcattagagaacatactgtataagtcccaggcaagttaagagattcaggtgagtgaagctttccttgaagatatgatcatgcgaccacagcagatacctctccaacattattatgtctgtatttacaacagagcaaaagaggattctccttccaagcttaagcagaaatatggctctgttcttcctaaaaatgatcacctttcagtatatcattattttaagaaattctattaatctcaatgctcttctctctggaaaatggtgaagaaacacttaaaatgaaacaactcttctgtgtttctttttaaccctgattgaattaaccaaataaatacacttctctttcatggctgtcatcaacctattgtttttttcttatgactctattttaatttcaactagagaccatggtaaggcaacaaatatctgggcctaatattttctaaataggtacaaagttttcagcatagaaagggcttttttttttcttttttcttttttttagtgccatttaagtacacttcacaatttcagtattactgaaagtatactgacatgatcctttcagtataagtatacttatataccttcagtaatactgaaagtatacttatacgctttcagtaatttggttctggaaaaagagaagtagcaaaggcagttagaaaaatgacaagtgtctataacagacctaagatatttaattgagatttttaagatactgtacctcccttgtcctatgaatacagctctgtttgacttttgttaattctctgagttcttaagaaggagaaagtaggcccaatgattccatttggcatcctgagtagattctgttcaatgccacatgtctaagtccacttttgtcgatgtcaaggggtagtatttgaaattttgaattataaaaacataaacttgatctaggcatatgtagatgagtgctttgggagttttagtgcacgttgcacactgtagtttatctccctaacttccgaggctatcttttctctggctccggtctctccaatttcatttgttttacttcatcagtagaaactgtcaactattcttcacctggtagcttcttaggaaggttgcgctcactgtgtgtctttgcaggcttattcttcctgctgatggtgtttttccatttcctcaattctctgcactgtttcttgcattcttcatgactgtgtaagctctaccttttcaaagagcttctggcagtactctccctgaacagctcatttgtgccaaaacaccaaggagaagtgctcagttttactgagttagttccaatcttatcactctcctagccaggataaagtttcccaagtgcatctgtgattaaataaaaatttgacattttagcttcctcttccattatatttcttcacacaggaaactgttcttctagaacatacagttttctcctctgtgctttgatttatgccatttgctcagaatatgagagtattgagctaacatttattgagtccttactatgtcctaggaagaagactaaatattttactgaaatttgtcgtttagtcccacataaatactctgaaccaggactattacattctcaataacagatgaggacagtcctgcacaacaaggcttagaaacttgtcccctaaattgctaatccatttgtgtaaagcactatattgcccccttgagcatcacttcaaatccagtggcatgctatgaggtccgatagaaatcggtcacattttgacgaacacggcttaagattttgaggatgtgagttctttctttgaaatatccatcccttttttcttatatcaaatattgtacttatctttcaagtgacttcacttgaaattgaggtcacttaattcataagtgccctcctcagtctctctagtgagaatcttggctccacgttccacattacggtggctttcactactgtctttctactcagggtaagttccatggaccagcatcacatggagattgttggaaatgcagacactggctacacactcaacctcctgaatcaaaattttcattttactgggagtaagctgtatatgatttatatgcattataaagtttgaaaagcaatgtgctagatacctatttcgttctgtatctagtttttcagagtaactcattattactcctgtttgcctgacacttacgaaacaaaagagccagtatgttatttatcagtttcacccaaattaactagcataatacttcctatatggttgacaatcagtacatctttattaaatgtatttattgaactaagagcaaattccatagacattacacttttatatctcccataacttataaaagcaatattattttcctctaaattataagttctgggaatgtaattattatgtctatctaatttatatggtgcttgcctactatccagaagacacttcaatgactaatgatgaagcacacagtaaattaatcaagatgattattgtgttgaagagagttttttaaaatataattttattttgagtttatttaggtaacaaacacctgtaagtacttatgtgccagggagtggtctaagttctttacaaatactgacttattcacattctgaacttcgattgcttggtcaagcataaatctaggttaaatcaataaaagttgatttgtgatacctcttttaattctaatacatgtcatgtcacatctgcttcaggttgttttgttgcagatgattaattaacctgccatagttgatataaaatgtcaatatttaagcaattttcttttttatatataatttcaaaatccttccaaattatttggaagtaaaatttgctgtaaatggtatgctacttctgcttggtattgaaatagaataacatcaaaatgtttcacagaaatgcatattccatttcagaacagaaatactatgagaaattctgtccggtttcagattatgttatgtatattatatgttctatgcattgctgatttatgtagacatgattttatattcaaagggagggaagatcccaatcaggtggacatcaccagaagctatagcctaccgcaagttcacgtcagccagcgatgtatggagttatgggattgttctctgggaggtgatgtcttatggagagagaccatactgggagatgtccaatcaggatgtaagtatttgtggtctatgagttatgagttcagatgaaaagatcaagctgtgcaaggaagtggaacataatgtaactgggtggctcctggtttataacactgaaataaaatatttagcagcaatgaaactgtttccaagtcttgcaaggatattatattaattgaattgttcttacagatttacatatttccctcaagcaagggtttagaaataagacaaaagaaacatttgtagtgaaaacgtaatgaaaaaagtgaccaataagataacctctagattctaatgcacattgaagtttgaaagtcactgctttacaccattgaaaagtactaatgaactaatagttacttaattttacagcacttaggattttacaaaaaaaattactataatttggaaggcaccatttgaactgcagtataactaaaacctgtatagtaattttgtccatattcattcatatatgttttccatagagaactatataaccaaataataatttctttataacaccaaatttgctctatcatttaacatttctttttattttaacccaaaaaggatctttacatactctttcctaaatttatgttatttcaatcttcctttatataatattttaggcatacataacgtcttatttatttgatcagttgttatccttttaggcaactaaaaatgagaagttttcccacttacctttaaaataagcatatttgtgagccccgcccatgaaaacgtaaactaagtgacacttcctgaaaacttcctggttcctgaaaactttgcttctcacacaggtaattaaagctgtagatgagggctatcgactgccaccccccatggactgcccagctgccttgtatcagctgatgctggactgctggcagaaagacaggaacaacagacccaagtttgagcagattgttagtattctggacaagcttatccggaatcccggcagcctgaagatcatcaccagtgcagccgcaaggtgacacattcaatttgttatctggcattcactctgaaatttgtgtttgctatctccaagatgttaatttttttagcccacccccaaaatgcattatttgaagcttgtattccaccatattagagagatgtatttcccctttcttttttaatctttagaactaattctcgtcctccttaatagtaatgatgaaattctgagatattttttaacatctatcttgactctacattcaggcttgtttaagtctttgggaaataggaatactggaggggtgcggtggctcgtgcctgtaatccaagcactttggtggatcacttgaggtcaggagttcgagaccagcctggccaacatagtgaaatgccgtttctactaaaaatacaaaaattagcctggtgtggtggcaggcacctgtaatcctagctactcgggaggctgaggcaggagaatctgtgaacctgggaggcagaggttgcaacgagctgatatcatgccactgcactccagcctggtcaacagagcgagactctctctctaaataaataaatatactgaacacatacttcttttcacccttcatgaataaagaagtcctgattcatctttcattcaaaataaagaaaaagaaattatccaaaatattgcactggctagcaaaatgcaaattttccccagttaattaaacaaatatttgtctagtctatattgcgtatcaattactttgctagacaccattgaagataaaactaagagtaagataaagccagtgtccctggacaacaacacaaatgttaatactctgcagctgtaatgcaatcctggatgcacaaagtctatttaattttatgcatattcttttaggttaagaatcactgagttctctcagtggttagaacaatgtaaattaaagtgtatctacaaagtacagtggaaaaaagaaggaagaagagatgaattttgtcaggggccatataagaagaaaataaatattaatatatttggtgcctctcagagtaattaaaggcaaagatatcttgtttaataattttgattctcattgtaagcataagaaaaaaaggttcttttacattttgataatgcattctcttacaggcttttaatttttctctctgatttatcacatgagttagtacatgttttatacttttgaaacattcctcttgacaactatagagagaagcatttcagacctatttgggacctctagctatgtgcctactcaatggcttggacttgtgagttcaatagtatcttgattggtacaatggagttttatcagtaacgatgacttgtgggtcattctgccttctttgcataaccagttgcttctcaatatcgcttctcaactgtgttagttttgggtctcaataatagtatcccgccctgttgtttccattgctacaaagcttagtgactaaagctggcgttcaatgcatgggaaattccttgcattttgtcttaagttatctgtttgaagatcaagcagggcgtgtgtgtgtgtgtgtgtgtgtgtgtttgtgtgtgtgtgtgttggtgagtgaatatgtaggtacattacaagtttgattaaccatgccttagtatcatatttttgtgaaaaaaatcaatcatatttaaaacaatattttaagatgtctaaaatcaatgcccctgaaatccacagggaataaaatagcaaaattttaacatataaacgttttttatccattcttctgtcagtggatacctatgttgatttcatatcttggctattgtgaataatgctgcaatgaacatgggaatatagatatctctttgaaatactgacttcatttcctttggctatatacccagagtgggattgctggatcatatggtgattctatttttagttttttgtggaacctccatacatttttccatatggctgttccaatttacattcccttacatgccaatgttccctttctccacatcttcactaacagttgttatcttttgactttttgataatagccatcctaacaagtgtgaggttctagctcattgtggttttgattttcatttctctaatgactagcgatgttgagtacctttacataaacctgttggccatttgtcttcctcagaaaaaaatgtctattcaggtcctttgcccatttttaataggggtattattatttttgctatcaaattctatgagttccttatatattttggatattagccacctatgagatatattgactgtaaatattttctcttcttctgtggattgcctttcattttcttgttttctttactgtgcagaaaatttttaatttgatataatccctcctgtttaatttggcttttgttcctatgattttggtgtcatctctacaaaattgttaccaagaccagtgtcatagagctttcttcctgtatttcctgctagaagctttacagtattaggtcttcagtttatccattttgtgttgattatattaaatgcacattacctgttttttacataatagtttaataagttaagtaggagaatcataaacaagatcttaatatcagtatataagaatcatagattatttattgataataacacttagtaggaatcactatgattgaatttagtaataagtccttaaataaaactacccataacttattccataaggataaatatctatcccaaacttcacagagactgtatagactcttagaaattcacctgacagtttaacaactaacaggataacaaacctgtcctttcctgggccatatggtcctcattctgtaccctgaaggcatttattttgatctttacagcatagatagtaatcacagaaaaaaaaagactttacctatcataaaaacattcaaaccattttcaaagctaactcatgtaatgtaatgtaatgtaggggtatctaataccagtttcacagagaaaagtagtcttactatcagatcataatatgtgaggctatgtcctagcatccaaattttaacatactttcataattcacttttccactcttattgaaatatatcaaatactttttcttatatatttttctttaatacatgaactaatttgatgtattttgtcataaaacataattttagaaaaaaatcaatattttctatgaaaagacaaccatctcaatgtacagaatataaacatttgggcaattatatttatatttttacttattaccattaaaatgcacgatgggttagattttgtcataatacatttatttttaacaacctcacattactatatgcaactatgtcaagaagtttttttctctttagaaaatttgctttcctacttttgacaatgattatttcatccttttcataactgattaaaatgacctccttctttaatttttagtgatgtccttgccaaatgctttattgagaaaataagccattagatgggaacttcccacagcaaaacagaaatgtagtggcacctgcacctacccatatcgtccttctttcctctaattataaaaggcagtgtccctctatttgtcagaggctaatcctctactcttcctctctccctgtctccctctctctcttctgcatatccaggctctttttttctgtaggatcattgccacaaacagatgttctattatattctttctcattatcttattcttatcaccaggggaacctattacacatacaaatatccaggtctatcccaagaatctccaggaaaagagaatggagtttggatgttttataaaaatgccaggtgatttttttctcctctggaaaatttaggtgatattgcttgtcaatattacccctgctggccccacatctctgccaactacttccctacttctctaacactcttcacagccaaacttctcaaataatggactcacagacataaagtcaatattctgaaaatttatcaattttctccccctagcctgatccttccactgcctaattaattgcatacaccagcagctacccattcacctaaccaggaattagagcaactcttggtacctctttcttcccctctacactgtgatcatctggatcaatgagatctatctctatcccttttcactgaaaacactctcctcatggctgtttcgtcttctgacctggaccactgcaataggctcctaacttgtcccctgctttgattgctttcaaactccaaacattttttttgcacagcctccagaatcttcttatcaaaacatatatgatatagtttcagtcacctgtttataatcaatattgaattcacgttacacttataaaaaaatctccttttggttgtttaaaaagccctgctgactgggtggagtgactcaaaactgcaataccagctattcaggagactggggctggaggataacttgtggccaggagttggagaccagtttgggtgttatagcaagacccccatccctacaaatttttttttaaatgggccaggcatggtggtgtttgccagtggtcctagctactcaggaggctgtagcagaaggattgcttaagtccaggagtttgaggttacagtgagcaatggtaacaacactgcactcagcctgggtgacagagcaagacactgtctcttgaaaaaaattataaattaattaaaaaagaaaattttgaaaagtcttgcttctccaatgttattatcttattcaaataaattttattcgaaaactatttttatataatacaatgagatgactatagtcaataataccttaattgtgtattttaaaataaatggtgttttctgccactcttgtaaacaacagacaagtacagaccagaggaaggaaataagtaaatggccgtgatgggcgataaaggaatagctgcgaaagagtctgaggagctgatgtttgagacctgcaggaagggaatgagccagctgtgtaacctcctcctcaccaaaaagaatattcttggcacaggattaaaaaatgcaaaagtcttgagatgagaaagggtttggagagttctaggaagtggcagagaataatatgactgaagggagtctgtcatgaacctaaggaggtaaacagaagccagagcacttgaggctacacaggccatggtgaggactttgaaatatttttcaaatgcatgaggaattcattaggcatctgaaccagagaagtaagatgatttgatttatatgactgctttgtagagggaggagcaaaagtatgaggaggtgggggtcattttaacctttcgacttgtgccaccttcatctaaacaatactctaacctcagtggctacttctagttccttcagaaaacaaaagcatttcagaagattgtagcacatgctgtttgccttgtctcagattctcctttgcacctttcttccttaaggaagcaacttacacatcatgtatgtgttgactcattctgtggcagcaccagtgaaataaagtttaacatcattattcttttacagagcaccatattctcgttcttcatcactattttaattctgttttctgtgattgtgtctgtgtattctttttaactatccattttctcaataaactctaagccctgtgagagcacacaccatgcttctctcgtattaccagtgcagattgataatgggtgctctgtaaatgtctcctaaatacctaataaatatgtgctgacatcattagtaaatttacatttcaaaagatgcaatttatagaaaaaattccagtgtttttctgctctctgaacagatttttttaatagacattgatcatatggtaaaagcctagacctgttctcctaagcaaaattctgcatgtgtacctttctgtcaactcaactccagaaatacactcctaaaaatttaataggagacttcaaaactgaattcgtggctggtacaaagcattcaagtttctgaatggtgtagttattcagatcagtgcatagaactgtgtttatacacgtaccctgtagtgtcttttaagaaaaacaacatcattctgatagaaatgatgtttcttcagtctttctggatttagtacattttatggtcaaattttatttttttcttggtggctaagtaccttttgaaactaattgtttgaatttaaaaacgttgttgcatataccgcaatagaagtctttttataatgcatcatttcacttttcagccttcattagagttgatgatttatagcagtaccattctcaaagaatcttccgcttagagtgtctccatgaatatcgtcactggaagtggggaaggtggaaaagctgatggtcagggtgggccagatcaaacaattacttagatgctgcaaagaatcataataagggaaggacagttacattaaactttgtgttatgcttgttccctagtaattgattgctttttctaaaagtagagtaaatcagaggagatgtgagggttttaagttttgatagtacatcagtacaaggctacagatgtttattcaacaataaccgtgtgtgagacattatgttaggtcctgtgatgattatataggtaccagatgtagcttccatcctcaacagcttacgtttaaatgtggaagaaaaaagaatatttagaacactataatacccctcagaacatgtaattattagagcaaaaataaaaggagttcgggaatcccgaggggaggtgagtttacttttatatttggagttttctggtatttgtatgcaaaagggacttttggatagtggatgaaattgaaatttctacaggtaggtaacaggaaaacaggctgggggaacactacagaaaagggaagacatgcaaataggtaggatacttccaaatcacatcgcataatacggttttgctagactataggataaaaaaaggaaattatggggaaaaagcctgatagatcagggatcctcagcccccgtgccatggactgcttccaggccatggcctgttacgaaccaggtggcaaagcagaaggcaaacggcgggctggtgagcattaccgcctgagctctacttactgcagatcagcaggggcattagattatcataggagagcaaaccctgttgtgaaccgcacacacgaggagtctaggttatgcgctcctcatgataatctaatgcctgatgatctgaggcagaacagtttcatactgaaaccatcccccaccacacccccattcgtggaaaaattgtcttccatgaaactggcccctggtgccaaacaggttggggaccgctgcgatagatgattcgtcaggtgatggaagactaaatgtcatttctagacatttgggcttttatccataaggaaaggggagacactgaagttactgaagtgatatgttgcactgtgtttagggaatagttctttggcagctacttctaaaaagggctggagatgaagggattcatacgagagaattaagctttcaatagtctaagaaaaggatctgctatgctagagcagggaaagtagacagtgtgtgaattcaatatgttttattaaagtgagttctataggacatagtgactgagatgtgcagagtgacagagaaagtatcagagaatacttccaggttctgaatgtggagcctttgagatcagccttctcattgacagtggtaggaagaacagaaggaagaacaggtctgccatgcagataagcattcttggcaacagtcaagaaactaatttaaatgtttgaatgcctcctgtttccattgtatgtaacaaggtgtagtggcagccaatccagattttaggcaccttgtaagggggctgtggagccaatcagtgacaggaaatggcaatacaagaaggaaaacaaatacgaaacattcactaatatctcagaatattaactcactacgttgactgccaccaagagagaaagaaaattccctttattttgagctttggagagcagtgccagttatatcacagaagaatgtgaaatggtaggtagaaacgaggaacaatcagggtgataggatgaggtttagactactgcagaaaaccacagtgcaaggcatttccaaaaagtagattcaaacggtattaacaaaagctgaaaaagggaaagaaaaacaaaaactgagggaatagacttccagttaaataatagaaggatttataatccattgggtatatacccagtaatgggattgctgggtcaaatggtatttctggttctatgtctttgtggaatcgccacactctcttctataatggttgaactaatttacacgcccaccaacagtgtaaaagcattcctatttctctgcatcttcgctggcatctgttgtttctagactttttaatgatcgccattctaactggcgtgcacacgtatgtttgttgcaggactatttacaatagcaaaaacttggaaccaacccaaatgcccatcaatgatagactgaataaagaaaacgtagcacatatacaccatggaatactatgcagccataaaaagaatgagttcatgtcctttgcagggacgtggatgaagctggagaccatcattctcagcaaactaacacaggaacagaaaaccaaacactgcatgttctcactcataagtgggagttgaacaatgagaacgcatggactcagggagaggaacatcacacaccagggcctattggagggtgaagggaaagggaaaggatagcattctgacaaatacctaatgcatgtggagcttaaaacctagatgatgtgttgataggtgcagcaaaccaccaagtcacatgtatacctatgtaacaaacctgcaggttcaacacatgtaccccagaacttaaggtaaaattttaaaaaagatagaaggaacattgaggtattaagaaaactattctgaattttggaataatatatattacattgtgagagacctaattataaaattggataatgaaaaggcaaggcaaaacaagaagatgtgcataaaagaatgaaaacaaaagaagctctcctctctttttttataagaatcaaagaaatgtttcttctttcttctctttctcttcctctttttcttactctttctttctttctttctctttctttcttcccttctttctctccttccttctctccttccttctctccttccttccttccttccttccttccttccttcgttccttcctttcttcctttctttctttcttgacagtgtttcactcttgtcgcccgggctggcatgcaatggtgccatcctccgcctcctgggttcaggcgattctcctgcctcagcctcctgagtatctggaattataggcactccccaccatgcctgactaatgtttgtattcttagtggagatggggtttcaccgtgttgaccaggctggtctcgaactcctgacctcaggtgatccacttgccttggcctttcaaattgctgagaattcaggcttaagccaccacatccagcccaaagggatgttttttaaagattgttcttgatagaaaatgccaccatgaaaataaatagaaaatagtcttaaaataaaaatattctttaacttcccaacacattgttttgtacatataagagaaatacacatttattttttaaaaacatattttgaaagattataatataacttctagatttaaataaatttattcacttattttataactgaagctaaattaaaaattgactaataacagaaaaatgagaatgtgtttctattcaagtagtaagataccctttttatttttgaagatatgagatttttattattgacaatattaattttgaagagatgtatgtgtgtgcatatgtgtgtaaaatgaaatagagaaataatttcttcttaagttcacagaatttccactagccaggtattgaattcttctatactgttgtaaattgataaaattcaaattcttgacacaaaaaaattagataatacattcaaaatatttagaacgaggttttaaatggaaggcaacacaattcatgacacagacttaagcaatatatttaataatatttagaacaaggttctgcagacccaattatatttagttaatttaattgaaatgtttttaaatatattgtttcattgcattgatcactaactttgaagggatttatttttattaacttgcagcatagaaaggagtaaaaataaacaatactcatattttccccagttaatgaaaataaacaagtattagtaaaaagcttctgatctctaagagtacataatagaattctttttgagaataactgctgttttgacaaataccatatccttcaagacaaatcgaacaaccaaaagacaatctgcctttatttctcaaaatgactttgacctcaaattctgaaactgacagggtgactttgctcagtgaataaatatgatacagaaccttttagagggaatcgaatatgccgaatacccaagtgatctctctgtctctctttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttattcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgagaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcaaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaataaggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttggagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtctcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccggttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctatttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtcgattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgtgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcaacatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggagtcagggacccacttgaggaggcagtctgcctgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggcgggcgcccctcccccagcctcgttgccgccttgcagtttgatctcagactgctgtgctagcaatcagcgagactccgtgggcgtaggaccctccgagccaggtgtgggatatagtcttgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcaccgtcttatgcgtcgctcacgctgggagctgtagaccggagctgttcctattcggccatcttggctcctccctcctgtctctcttttttaatcttaaaatcaaaacagctaattttaccacacggaggaattaaaccaggtgtaacggctataacttcaaagatttttgtccttaaggcctagagataattaaaataaacacaatgactttatttctccttaatgtgtcatttatgtactaggttcctgttgggaactgtatatattcaaaattatttttagttactgatgaaaaattaaattcattttatcgtatctggatttttaattttagtgataaagatcaaggtcatcggcaatcaacattaaaataaattggcaaatataagattttccccctgaaatacattggggaaacatttgaaattttaaaaaacagttataaaatgtacggaaaaaatatattactattctcaaacaataataaattcagatacaattattagtattttggctttaaaaagttgctttttagatttaatgtatttcctgaaactattcacaacaaataaaaaataattataatgttacagtatgcatctccaatgttattacctccttgtagacataataggcatatacttattcattcaagaaatgtgtattagttattatttttgatatttgaggagtaaatctctttgtaatcaaaaggagtctattaagtgagaaatggataactagagattcagaattctaaggtagcattgaaataagattattacccgaagatattcctgggattggcagttgtttattgagctttttccccagtatctggtgctaatttttatgcacctatttacagctaaaataggaattgatgggaagaaaatatatatgtacctctctaatgcaacagtataaaacccatgaaagaataattcacaaatcttaatagaaagagagagaaagaaagggaagaaagttatttttcacttcccctgagcaaatatgtaatttccatgatttctttttaatgactgcggtctgtagccagtaggtactgatttatgaaaagctgtaaaagatcaggtggagctctgtaggacatcgtttacagctgcatggattgaaacctatctaatttgtctagtaaaagtgtgagctcacggtgcacatcacccagcctataaatttccccttcagaccaatgtctggggctgggtctgaaaaaacgccaatgcctgcagctgctcaaaggcccagattcccttggtgcgcatgaagagacatcacaggctcttcacagtgagagacaaattcctatccattgataaactctccagatgtcctctctgaggaggaaaggaaccaatttttatttgaaatccccagagaaatcctggaagtggaaaaatgatactttgcagggctagttattctgaggtcattggcattaaaattaggtcatttttttttgtcttggatgcactttgatccaagtcataaacagacaaactcagttggggtcactaatccttaatccacacgtcctgttctatttcaatttgtttatactaattttctctaaactcttgttgagtctggctaaagtgttgagtgtaaaagtacaaactattctgaactgagaagaaagaattctgcattttgctattaggcacacttcataaatattctgaataaatgtcctggggtttgattcttcatacccacaaacccataaataaaaaagtattactattcatgggactaaaacttgacataagattctgtgctccagctactgtagacagagaaactgtggcgtgtgcgcgcgcatgcctgtagatagtttaatgtcttgtctcattctaggtttcacatgatttttcttctaaaatcttctcacacctgatttaatgctattcttatcaattttttagtggttcaatgacttatccaatgagtctaatgtaatgtctaatgcttgctagtgacaaagactatttcactcatgataactatgctgaaacaacccatgaatattgtgtacattttggtgtatatctgtaattactcaagttcttaggaaaagaataaaaatacaaaattttcaattataaaaataagctgtttttcttcctaagatgagtaatttaaaaaatcataaagtcgtttgcatatatgtttcagaagaagataacttatgaaatgttatattgatattttatagttttcctgatattgctaaaggaaaaaattaatatttatataatatggcccaatccttttttagataatctctgagagttagtaaaactaaactatatcagagaaatagaaattataaactccataattaagattttcaatttataatttgaacttgtgaagtaaaaaggattgaggtaattgagtttagtctagtggacagaagtttgaagaatccttccctttcaacttccctccactacacaaatgaccatcacagagaggggactattaatctatattttccacagagtatgtaaatagagtcagaaccaatgttgcaatttttttttcctgaaactcagggttaaaactgcactaaaatgtgaccatttttatcaaatacgtttcatgcatcgctgtaaaaatccagatagtgaattcacaaacttctcatatgttccaagtaatagcatgtaggtgtagggcacgatctaaaattatcctggctcacgaatcaactttacacttgagcaggtcttttgtacataagagagtaagttgaagaatatcaccagaagtggtataaacctctcaattaaaagacctatttaagtgtgcgcagagctggcacagatttgcttcatagattttctcatttagaacaggagcttttaccacatatcctagatggtaatcaatgattgctactcatatgtaaaacattatacagttttatttcatgtatattgttcattttgctatttcatgctatttctaaagatattgaaattagccccttagagacctaaatttatgtctaaaataaggataaatgcatgtcgatatattatttgttttggtgtcttctcaccacaaattctaaactttgaatttaaacacttcaaatgacagacttcacttagactaatctttcatttcaagtatataagaaaaatatgaagttctagttttaatactcctaattttggagatttttattgaaagattctgaagaactaaaacggcaaaaaatcaaaatataccctcttaattattaaataaagattaaattatatataaagttttaacattaatactatattttattacaataatgaaaaaaatcacagacagcagaatagcacttctgttttcaagcatttgcagtggaatgattgtgaagttgtaaaagttactgactattctaatgaagcccctaataatggctacttttcagggttgttatactattatgtacataatattatatatgactaaatttctagttacttaaaatggtggttaacaagatcattgcattcccagcattatatataaactgatatttactctgctattttctttttgaagttttcagaagtttaaccatttcaccatttacataagaataatgaacagctaacacatagtgcttattatgagccagcactgttctaagtgcttcccacatatgctcatttaatcttcatttgtgtgaaattgatatcctcaccatcatccccattttacagatgaggaaacagacaagaaattcaccaaggtcacacaaatagtatgtggtatacctgggattcaacccaggccttacggttccagtatctgtgcactaaacttcagggcatataaacatcgaatatgccacatgatggaatcataaatcatttaagaaaaaacaggggaaatgcaatatgaacaaagttttacctaaatggcacagtgtaccagtcaagaatgtggactgtggtatagaataatgtgggtctaaaggccagctctgcctcttttgcctgaggaaacttagcttcgtaacttaatgtgatttagtttcagcttctttatctatctcagaggatagcatcagtgcctaacaggtactgtaaggattaaggtccttcatgtctgtgtaatattcttagcatgatgcctgccacattgagtgcacatgaacgtttgatataatatgaaaacaagggccttaaaaacttatttctgtcattgttattattcatccaaaactaaaggcttttataactaccttgtgcccaagctcccttccttaggagaaaagaagagagaagtcaatatattgttcacctagtgactggctccagtcttataagtcaaaggacaattaaagaggccactaagagctgaagaaaaaaaaaaacacaccaaagacatttcaccaacagtctgcttcttttgcctcttcagggaggcaaacattgtctcattcatttcctttatgcctcttctgttccattgatttaccaggtcttgcaggtggttatagatagatgtttaggcctgtatttatataaaaaaatcctagaaggaagtcctttttctttctctctttctttttgagacggagtttcgctcctgttgcccaggctggagtgcaatggcatgaactcggctcaccgcaaccttcgcctcccaggttcaagcgattctcctgcttcagcgtcccgagtagctgggattacaggcatgtgccaccatggctaatttggtatttttagtagagatggagtttctccatgttggtgaggttggtctcgaactcctgacctcaggtgacccgccggcctcaacctcccaaagtgctgggattacaggagtgagccactgcgcccggccctttttcttaaagctgattgtattgtgcaatataaatcacaattacaatccctctctgagtctctgtgtgtgtgtgtgtatgtgtgtgtgtatatatataaaatattatgtatatatcatgtgtatataaacacattacatatataatgtatatatcatgaataatgtgttgcatatatatatcatgaacttcatttggtgtcaagtatgcaagaatgttttttcttatcagtcatctacttttttctattattttttatttttaatgacatgcagcattatttaactctgtattgagtttatgtcctgctgtgagtgtagcctagattgttcaagccattctttagacagcaacctgtgcaatgtcaaacaaacaaacaaacatccagtgggaaatacttaaaatattgaaactgaatccatcatcaaagcagacagcaaagaattcagtgtgtcctgcctactgtaaccgtatcctaaattactaccatttttgctagtgattaaattcaatgataataaaatatgtatggatatatttatgtctttcactggaaaattttcagtgatttaaaagcatttgtggatggagaaggggagaacttagacaagatgattacacggcgttcctccaagctgccagcttgaacagatgaagctttcatggcagataaattccacaaatgaaaggaacaccatatgaagtctggaagttcctgccgatgttagtgtcaaattttgacacacagcaactctgctgactcctgatctgtctccctttggtgttttttttcttgcaggccatcaaaccttcttctggaccaaagcaatgtggatatcactaccttccgcacaacaggtgactggcttaatggtgtctggacagcacactgcaaggaaatcttcacgggtgtggagtacagttcttgtgacacaatagccaagatttccacagagtaagaaaaaaaaattcattaagaagaatgaaggattcttttgaactttcttggcttgacatgaaagatttgtaacatcttggcttgacatgttacaaatattagtggtagatctgaggtactgactaccgcctggaactgctaatcagggccctgggtctccttgtggcccacagcttctggattgatacatattgatgtgtcttcctctctcaagatagggcccaggatcggtgtctttagatatgaccttcagatcaaccaacagattcacacccataaccacactgcagactcaagcccctaatttaaaacataagcagacatagattgatgattattatatttctgcattttgtgatttttctgttatttttactaaagcttaacatctgtgaatcaggaaaattgagagccaagtagataatgtggtatacaaggaaacatattaaagtctaaaactggttttcatagttgctaaataaacataacaacatgtattcatcattgtctaccctgtaaaggatatcatgctagaaaatgaagttataattaggtttaagatagaatttttgggttttcctcaaaaggcttattgccagatgagaaagaaaaaatatgcgtcataatattaatattaattgatagctttatgtgttaaaaaccaataataatcaagtataatatgctgtattttgtggacaatcatctttgggtaacaggaatcttttgatatgagaaacacatggactcaaggaaaggtggtatataaagaatcaagtgaatccagtgaatagtcaaaaatttggttcttattcacaaagtagagtgtttgggaattgataaattaagagttggaagtcacattcttcatctcactgtgattgagaaccaatttacttcacttcctaatgtgactacataattttttctttttctgcacagtgacattttctggattcccatgcgcatagctaaaaactggctttctaaactcttggtcatatagccttatagtgccattcaactgaccagggtccaactcccttaatctaagttaccaggagagaaagtaggactggctcagtcccacttgtacattggcacctccaaagtcatatgtttactagtatctagtcatttatcttcaaaagaagtagaatgaggtagtatgaacttggctctaggggccttttcctgaagataagatggagaactgtcccaaagaaagaagtgtatactggatagatacaccaaaagttgtccagcatgttgtcgcttgcatggtctattgggaaactgttcatctttgtgtcagtctttctttgatctttgttaaattaaataaaccctttagtcccccaagtttaagtattatcatctcccactaatatttaaatatttaaatattgttgaatatataaagactttcattgccaccctgtcaatcattcaacatcactgtgaaaaataacagattagatgccagaaaagaacatgccatgtaattaatagatataagtgcccaacaaacaaataaataagtttataatttatggtgtaacattacaatcagaaagacataaagccaaagaaggacttacaggaacagtttacgattattgaagaagaggacttgttctaaaaaaataaacttaccctagtcaatttaacatgcaccagcattcttgttcaaagtggaatgtggtgtttattgaatagacttctgacccaatcgacagtacacttgggtttctgtggtacttattttgatcagatacagtctcaggatatagtcatgtgtttaaatatttttataaattcttattttagtaatataaacagttagggttatgatacacaaaacacctgctgtagagcacagaagcatagcgaaaagcaaacacaaagttgaacatgtccacatcactgccagattttcaaaggcaaagttatgcaaatgtttactctcaataaaatatcaacactcaaaacttttagatattgaaacactatattgaaatgtatgaggcagaacactgttgataagattaactgctagtttgcaattcaaatattgtcagccattataagctatgaatgtgataagaaagctatttgctttaaaaaagtgaatgacagcatttgtcatactttccaagttagcgacattacttatgtcagcaataccatgttggacgtcaaactctttttggctgattggaatatttttacttaattgttattattatttgaacaacctgtgaatatacattcaagatgaaaactgacttttcctgaaagacagctttttcaggtttgtcctgcacactgagtcaggtggtatggatatgtccatattgcactccccacaatattccttcttctgtcctttctcctcaattcagggacaatataggattaacacctttgccctaacactccttcttgaaaggagctgcttttttccttgagtcttcatagtgtcatgcacctcatgctcctaatttatattacaaaaagagaatttattaaaagtctttaacatactaataatttgggtaaatataatgaggcaacattttcagcataaatgctgtaaaatattgagctagatattttagctttctttcgggttcctggcttattgtttgaatttgattgctttcagtctgtattttctttgtgccatccagactcaattcagaaatgatttgctcgaccaaataactgtggagatcctcctagaatagaaaaagatacctttattcctattcaggctgtcaaagtataggaaaagatcaataaaatttcacattcaaatgcatattaatttattttcgttagtttagagatttcattgacatgcaagctactcaagttatctcatttttgaacaaagcccagaacacatgcaattttgtttaataaatacatatttcaagacattatttcataacctaagatggatttaggaaggttaaagtgagaaaggaagagagaaagggaaaggttagagtggctgtgactgtggaactagaaagagaattaagtgtgtggaatgaatattaagcagattcattgccacatgtcattatcctgcacccttggatgccattttcaaagtgtcatcacctatccctttgcctttgaagtaccagataacactttaacctctggtctcagtctggagctgctctttagtcttgaacttttccgccactcttctgaacaggacagtcaaaatgaaatgagcacacagagtgttatggagacagcagcaactgggggttccaaattattttggacatgcagagtagtggacagaagatattcgggcaagaatagagagactagagggtgtttaaaagccctagctaaggaataacccaaatggataattactttaattctcttttcaaaagtccaatataatcatttgcattaagtaaaaaaattgtatataaaacatttatatgtagtatatttatataaatatataaaaatatatattatatattatatataatatataatgtttatatattgtagataacatatataaacatgtatatatatataaacatgtatatatataagcatattatatatatatatgtttgcttatattgggttcacagatacagaatgtaaaacagttttttgcagaacatttcttgaggaatacactcaggaggtgcagctatgaagaagtgatgaggaatgtctcaaatcagtctgtgaactcagcatcacatttttttttccagccacttggggatgagtgcttcagttcagaaggaagatcagggccaaacatcatagcaagcagcactcagtaactatgcttaaatttctcaaagagctcaggcaattactgcattggaatatataaatattatatatatatatttactcatataatataaatattatatatatttactttccatgactattattatttttatttatttatttatttatttatttatttaatttttttgaggcggattctcgctctgtcgcccaggctggagtgcagtggcgcgatctcggctcactgcaagctccgcctcctgggttcacgccattctcctgcctcagcctccggagtagctgggagtacaggcgcccgccaccacgccccgctaatttttttgtatttttaatagagacggggtatcaccgcgttagtcaggatggtcttgctctcctgacctcgtgattcacccgcctcggcctcccaaagtgctgggattacattccatgactattattttaggaaggggaaagggaagagacaaaggacaaaaaatcatctagtcataaaacataggatatggtattggaagaagatgaaagaaaaaagaaagagtgagaatctattgatttgcatacccatacttgtatctgtcctgttttctggctctagactcaaaaactgactttgctgtcgtttggggataagtggagaaatgtttattctttgttttaaaggtagattcatggtatgtttatcaaaatcctgtaacgcacattctcaaaggcagggatcaacagaagtagcatacattactccaagtgaaggcttccatcatccgcagtacactaagcgtggcaagcctcacattcccatacatccccactagccttcctgagaaagagtatgatcagatagggcctaaggcaaggcacaagctctccagagaggatttatcagccctttgacagtcagcagggagggaacctgaaggtcatcaggaaccttctcagcccagatggtaggaattcagtagagtctcggttaatttaatgccctaatgcttaaataacaactacatttcttctcaaatggttacctattgttttcttgaacacctttattgcctaggaacccatttcttaagaaatcgattaatccatttctgtgtagttgaattcccaattttttctttctttatgctcagtataaaggaatcccctctgtgtgtgtgtgtgtgtctgtgtctgtgtgtggtgtgttcacacgtgttcttttttccttgccattctcaattttcctggctctccttgacaaatgatactttacgccctggtcatctttacccagaaaaatatattttgtatgtttctttctttagcaaatttgtattgagcccactaactggcagccattgtttaggttgctgttggtaaacagagtacgagaaaaaaaaaagaatcccagttcacatggaatttaccttcttgtggagtaagatagggaataaagaaaataaatcagaaagaaagtcaatatgtcagatggtaataaatgctttggaagaaaatgaaacaagaaaagaaaacagaaagtgcagatacaagtacagaaaagttttaaaatattaaataggagggttggggaagatttcattagagggggatgtttgagcatctctcaatcctgaaagacaggaatatatgaactaattacttgaaacaagaatatataattaaccatttgcacattagctgtcttttttacctaaatgaaattccttatgtttttataatctttattttaatgcctactttctgactttaaattattatatatttaataaaagagataggtctttgtcattgtttttctactttgaaagaactgtgtactttaatgagattattccagttatctatggctgcacagcagcctccccgaaaacttaaaggctaaaacagcaagaggtttattatacatcatagtgttgtgggttataaatgagggcagagctcaggtgggtgattctttgtgctctgaggttgatgttgacagaagcttacagctgccaaatggactgatctggtgtggagggctggagatgctttcatttcgacgtctgccttggtacagttagctgtacagctggtctcacctgggattgtaggccaaggtgcttacatatggcctctcctgtgaaatagtatcaggtagtcagactttttatatggcagctctagagcccccagagaggatatctcaagcaataagtagaggctggcagtttcctaagacctgaatgaagaaagtgatacaatgtcaattctggcgtactctgttagctgaagcagtccccagattcaagggaaagagataaaaccccacaaagaatgtgtgatcattgatattagtttcctaaggctgccacaagaagttaccacaaatttattggcttaaacaacagaagttttttcttagaattctggtggcagaagtctgaaatcaagatgttggcagtaccataattgctccagtctctaggggtgaattcttcctcgtctcttctagtttctggtggatcctggtattctctggattgtggcaacataactccaatctctgactccatttgtacatcgccttcttctctgtgtatcctattctcttataaggaaactgtcactggatttatgtaccaccctaatccagtaagatattttcccaatcggtgtattaattacatctgcagtgaccctctatccaaataaaatcgcattttgaggtttgggattgacagagattttggggaaactctattcaacccactacaccatctatatagccttctacaagatggtggaacggtccggacataacacagatgatgcaaatatcagacaattaggtccacagtactagaatataacatcgtgcaaattgtgctaattgaaaatctcctgcttatacactatcgaggaaaccgattcttatattgttttctttttttacagtgacatgaaaaaggttggtgtcaccgtggttgggccacagaagaagatcatcagtagcattaaagctctagaaacgcaatcaaagaatggcccagttcccgtgtaaagcacgggacggaagtgcttctggacggaagtggtggctgtggaaggcgtagcatcatcctgcagacagacaataattctggagatactggtggaagttccaagtccaataagacactcaaatatgagtacaaatgccttaaaatggaattgaaaaactctttattttcccctatcatttattggatgggtgggtggggtatttttttgtaattgcttttttaaatattagttaatggattaaatttaattcttcagcgtaaaatggtgaagaactagcatatagccattgatcataaactgactatcataaaatcaaaacaagtgaaataacaaaatggacatggtggctttgtttaggtagagccacaaaagaaaagacttgtaatatttttatatacagaggaaatctgtaacaggtattttgtttcttttaaagcaagcaacacagaggaatttatacctcaaactatctggccatatttactaccttatcactgcattattctcttttatctgtttaaagcatatagagatgaagtttgtagttgttttaagtactacacatttttaaattgttagcttccttaagtatatcatgtaaagaaatgtcttaatttttgaaaaaagtacatatttattttcttttgaattgtttttattgttttctatttatgccttgatgatttaatatggatttgttacagccaagtgccaaatgctctctcaaattgtcagcaatttaactagacacagataataatgggtttctttcagattttttgaaccatccacttacatatatttttaaaaaatgaaatccttttcctgttcatacactaaccaaatctctcaaatctgttatcccaatcattgttgcctctccgtttattataaactgtatgctcacaacttagtgtaatataccagcttgtatgcaatggattttcaaccagataacatacctttcctgctctggtgcttagagactatcaactccctcctttagtgaaggagccgtgttagagcttccgagaatagctccactggagagaagtggaatcctatatagaatgctgcactaattgacaacacagcctataggccaatgcatgagtaaaaaaaaaaacaattactggctcactggctttgaaaagtcacttactattgttgctgaaacttgctgagctgtttatagagaatgatgataacagaacttttcctctgtatcactggtgtttaggtgaattaattaaacattgtgatcattagtaccaggtattattatctttaagagtcttccacttcaatgcacatggtgcagttttggtgtgtaacttagaaggattgaacttctttgaatttactggacataacattttcagaatagttggtcatctagcaaccgcctcaaaatgtgtaagcaggagagaaatttctcatcacagggatttagacttactattacataaaggctaactatgagcttgctcattaattttgaaaagatgtacctggtggatatctagctagtaatatattctgaagcaacattttagctctattgatactctttctaatgctgatatgatcttgagtataagaaatgcatatgtcactagaatggataaaataatgctgcaaacttaatgttcttatgcaaaatggaacgctaatgaaacacagcttacaatcgcaaatcaaaactcacaagtgctcatctgttgtagatttagtgtaataagacttagattgtgctccttcggatatgattgtttctcaaatcttggcaatattccttagtcaaatcaggctactagaattctgtattggatatataagagcatgaaatttttaaaaatacacttgtgattataaaattaatcacaaatttcacttatacctgctatcagcagctagaaaacattttttttttaaatcaagtattttgtgtttggaatgttagaatgagatctgaatgtggtttcaatctaattttttcccagactactattttcttttttaggtactattctgagcatactcaacaaaacccatgcatttcataaactaatagaagttgaggattgttgaatctatttcacttattttggctgtggtttccatctgaaagtagaggttgtatacaccatatactgttcttcattttattaatatttttctccttgacctctcataaatttactttacacaattcttaccctgtacatatgtaaacataagtgtacgattcttaaccatggagtagaggtactagaatgcttacggccatctctttgtacaggaactgcattgactttcagtaaacataaagccacaactcctacatgatgttatgtaccatatgatctgttttgtatcttaaatttgatttacatatattatttatttctggtaactcactcagtttatgctgtgctaaatatcaatcaagccatgtataaatgtgatatgattggcaatatgtgtttactttaaacttgtcttttcaaaatattactcagtttatgttgtacaatgtagatggcctcttactaatgtaaaatgatttgtagtggaaacatttatatttttataataaacataatgaaaatattttttacagattggaa

SEQ ID NO: 7 - DNA, 154264 bp, Homo sapiens
ctgggatagaagcggcaggagcagcgttggcaccggcgaaccatggctgggattttctatttcgccctattttcgtgtctcttcgggatttgcgacgctgtcacaggttccagggtataccccgcgaatgaaggtaagagcgggacggcctttctgtggtcggggacagcgaggggccatcgcgggtgaggggtcctcaggagcgcagggccaggtggtgcggggggagcccagtgtgaatggtgcgtcccgattcgggagaagggggctgaggcgaggggatcggcgaaggggcagcggggaaccgccggacagcctgccccgaggcggtgacccgtgcacgcggcgggtctgtccaagtttgtaaccaaaggccaaagtttatcagcatccgccagagaggcccgctcgaggcgccctgaggggatgcacgggagacaacgccgggatttaaaaaaaaaattacaagaaccacgtcctctcctgagccagcccggggcgaggggaaaacgcagcctggagcacagtgaaggcttggtgctcccggattctagcgaaagcctttcgagctctggtttctgcaaagtttcccgagccctgcgcttctcgggaccgggctgcggggcctgctccgcagcgcagcggtcgtggcgccgctcgtcaggcgccagtgacctgatttctagcacccggagtcagacacctttctcctcgccaagcccagcgccccgagggtgcgattgcgggcctgaggggcccgagctcttcgccccgcagacttggggaacccgccggcaagttgaacgcagtcgagttttagcttttcgccccagaattgcacacagtttagagctaacgtgcggggtcgacgggacccgtctgggtgctcagttttctgtgcatccgttcggacgtgctgggaggattgtatgtgcctgtgtgtctgtgtcgggaggtggggcggggcgggggggcggtgatcatttagtttctgagaaacccagggagaggcgaactgtgtgtgtgtgtgtgtgtatgtgtggtgtgtgtgtgcatgtctgcgtgtgtgtgcatgtctgcatgtgtggtgtgtgtgcatgtctgcgtgtgtgtgcatgtctgcgtgtgtgtgcctgtgtgtgtgcgcgcgcgtgcaactgcgtgtatgtaggtgcgcgaatgcctgcgtggaagcggacgcggaggattgtatgtctgtgcgcagatgtcctgagtgtgtgcgcgtgtgttcgagtgtatgctcgtgctctgttccagcgtatgctggtgctctggcctgcgtgcatctagtctcacatccgtctctcattcttctcctttccggcatccatctatctatccgtccgtccatccgtctatctatccatccatgcatccatccatctctccgtgcatccgtccgtccgtccatgcatccatccataatgcatccatccatatatctgtccgtccgtccgtccatccatccctccatccatccacccattcatctatccatccatccacccatccatccatccattcatctttccatctctccagacatccgtccatccatccctgtgtaatctatcgttttctctgttccgaaggagggagccaaaaaccaacttagccttggctgggcagccggtacccggagccctccagacggaggctctgagagatttatacacctgcccacagacatcgcttgggaggaaaggggccctctctcgccctctggatctcccatctccttccgacgtggcttctggtggttctggtgccatctcggccgtcgccgcccctcggtccctagggttattcattcccctgagaggaatcgtggatcccgcgttctcctggccacttcacacacttgttaggacgtcccctgagacctctctcgccccagatgtagagactgttttctttcttttttttaaaccccctctttttttgggggggggggagaaaaacttgggagcccaagacaaaaaggctctgagagccctaggctaatgttgaaggggagggagggaggtctgttcccctcccctcccccacctcccccttaaaaattaattcactttgttgctttctattcccatcacgtttccttttctctcttttaccctccctttctactccctcctttttttgtaaattgggtcttattgtttcctttgtgtccctaatccaccttacataaatccaaatggatgtagcgggcttttctctagggacagagagaagagaatggttgcggtgggggttggcggtggggagaggagaggagggaagggggcgggaactccaggcgggagcgacccagggaaggctctacattttaaaatcattaacagaccccaggaattcagactccccgggaaaagtaggggaaagagactgatttttaactccattgactttgaggtgaaatgagagggaaagtgggcagaatccaggggtctgggggtaagcttgagtgttggggtgcgcatgagcacggatggcggcttcccattcccacccctcccccagcctgaagagccagcctggctgatcaaattaataacccagtggttcctttgaggtgggcctttcgacccccaggactgcagatctcggtgggaaagagaggttttgaattcattgcgtccctttggatgttccccttacctagcgctcttctagcctgagcggggtaccgcagctcggtgggctgtcctcccttccccccaagctttgacgcactcaggtgtagcacaagcacactaaagccgttaggcagcactccatacctaaaattcaagccagtgatttcctacgggtggaagacgagtctctgattgtcccccaacacatcttgagaaagagagaatactttcggtacgtttgcattctgattctgcacgtctggcattccctctttctgaaactttgatatttaaaaaagcagcggataccatattcagggactatttacttggttgtggaagggaaaatgttagggagagccttttcctgaccctttggataggatactctctgatagaagagagaattcacttgtggctctgtcaccctgatgagttatgtggtcatctgaaacttgcaaaaacaaataattctagtagataccagacagagatgaatgcagattttgctctggagtgtaactgctctacatagatgtatttatctttttgaattgtacttcagattctctattcatcctttttagaaaaatgaatcaagtgagtcctaggatggaattttaaatgttaagcaagttgaataaataagaacctgcagatttaaagagggggagaagatcaaatgagtaatgattatttacataagtgagcccaagtttaggttttgatcagtgttggatatgcacagcctcagcacatatggaaacgctcaggcaaatggtttttgtgttattggctttttgcaattggaaattcatctatttttcttttgttttttgcagttaccttattggattccagatctgttcagggagaacttgggtggatagcaagccctctggaaggaggggtaagtcctgagttgctctctgatccaaagggtaaaaaaggagtgattagcaactttctgagagtcctaatggcttgattcttgttgattgtggtgagggggtcagatttccgctgtggcctatgaagtgaattacgctttgttggagaaatcctatactccctttggataactctgtcatggaagaactagaaaccaaaagggcagaaaggggtttcaaaattaggagactggtggaggcacagacttagatgcctatttaaaactaaaataccaacaggaaatatgatccggggaccaaattagaatttatgcctattactgtgatggccatgaagtcctgacaaggttaatttaagagcaattgtcctgcttccagatgaaaaaaaaagaataaataaagatatgagagagaagacatttctaattgtacctgcatgaactgcaggaaggctctgtaccttgctctcactcttaaatcagctgctgttcttttgcacactgagagacagtcatgtgaacttgtgtccaaaaaaccctaagcctgtgtattaatggtgctaaatatgaaaagtttatgtgtctgtaatcttgaagaatctttggggattgagtagtctggattataaggtctgaaaaaagcatcacttcatttattctcaaatttgtaatacttgtcattactgcctccatcttactaggtcaacggccacattctcctactccccctaaataaccagtcagaatgaatcagctttggaaagaaaacagtacaacatgtaactgacttctgccaaactgaaataactctcaaatccttttaaaattaaacaaatcatcctaccttcacaggcttgatagtttatggctgagtccattgattaaaaacaatgggggtgaaagattaggagtttttactaggcaaaaattgtaatgctagaacctggcgtgggctccacaccggtccattgaataaagaatgaaggattttaaattaaagattcatagagtctgctatcaaggacatatttcagaactaagactaagcaagaaaataatcatgaaaatggagaattttaggctgtcttgttgcaaacagattttgtaatccacctgaaataaaacagattgccctgtcttcctattttttctgcctgaacttgactgccattggtttgttctctcctgaaaaattccagtctgcccttaaaaccatctttttaaaggagggaggagtgattggcaggcctctggcagtgtagacaggctgtattcaccactgattgcaggcaattgccctcatcctttgaatgtgaagaaaggtacggctttatcttggtgagagtcagactcattgttaatcctataccctggaaaggtcactgattcaggcgaggctttcccaggctacatgtaccaggggtattgcttggtaggttaaaatgtattagaactgctggtaaaattaaggatggaaagtgtcagtacttgtattaataaattcagtgagccttatttttcttactggctgcttttaagtttgaagagagtatatacatctaatcaaattttgaacctgacttgtttcactaaatatatgtgtgagctatatgacagcaaggactgacacattttagggtacagtccatagtctatctagtttctggaaagcttttattgcaatttaatatgctgcagacatttttttcttcttcttcttcttcttcttcttcttcttcttcttcttcctcttcctcttccccttctccttctccttctccttctccttctccttctccttctccttctccttctccttctccttctccttctccttctccttcttcttcttcttcttcttctccttctccttctccttcttctccttctccttcttctccttcttcttcttctccctcttcttcttctccttcttcttcttctccagagctgctgaaagagcacctggtcactttttctagacacaaaacttatcttggttgacttgaggtctatttaaaactatgcagagctgactgtatacgacccagtacttttaatgggctggatataagcaggtttttttttcttttccttaaatattaggcatgtaacattttaagcattattgtaagataaataattttatttgtatataaaagaattagtcattccaaaatacacagtagccattgagaaattgtgtcaagttataaagtttaattaatttctagattttataattgacgaggactttttcaggattagagcaaaggaatgaattgggtatctgtcaatgaggaatggattgattgtctttaaaaagttctttctagctgagagtaaaagcatattgagtcttgatcattctaaaatctctgcttgcagttaggacatttaatgtctttattcactgttaacttgagatagtaatttggtctgataatgacatttatttcttgttgttatgtttaaaaagaaaaaaaaacaacttgatttgacaataccaccaaggaaaatataaattagaatcagagacaatccattgtttgtctataagaacaactaagcaagacatgagaattagggaaagtgatggctcctgataacatcgttgtagccaaaagctactttcttggtaatattcacttaaaagagtatattgagttgctgacactgactgtgaaatataaaactaagggaggatttgtcactgttccagtgaattgatcagtgtggttagacaattacgttcaggctgcaaagttcatattagacctgaattatcctgcatgaactctgtagagataccctatgtgccttcattgacaaatgtgtttttccaaattcccattgttctgagaagagaagcatgctgagtaggtgtttttgaagatgggaatctatttttggatttacatgaatttcctaaaataagtaaattactggtgattttattgcttactggataaaaagaaattttcatcaccacagggcacttaccccctcctagtttcaacttttataatggtggcagatgaaaaggatacagaattttatggcttatggtccttcacatagtaacatttccatccattaagagtttgccagtgcatagttgggaaacctattaaaagatacattatgattctatgcacttcactggactgcatggagctttacctggagctattacagaatacaattttttaaaaaaactatctcttgttccttctaattatattcatatgtttgttaaatacttaagctgatttataacagatctgtatcaatgcattactgtagatgttaatgaagaatttgaggctgcctaccagcttagtaggagtcccaaaagttttgctgcttttcggattatttttaaaagctataatgacagtgaaacttttagtcacagtggtagacgcaagttgtcctaccattagattctttgtgttaggaagtggaatgcaaagaaaatgctaccatctcctttcattttcttgggccttcagtcataaacagcacttgctattttatttttaatgtccacggaagagttagaagcaaagcatgtctgttttctagttttgttatttgtctatgttttaaaaatgagaacatgtacaaattttttaattgaatacacagtcttgaaaagttgtctactgttataaatgatagcatatttgagaaatccagccataaaatttactccctgtcttcctaggattactgaaaccagaatggtgggattttcttttcacctttaaagagtagtgagggtgccaaaaaaatcaattgccttttttttttttttttttttttttgaggtattagagagcaaagttctgacaggagcactactaattaactgataattgtcttcctttggcaagctctgctcttcctgcccttaatttgcaggtctctgctcagtggttgaaacaatacccatactagtttttcctttatgagtaaatttgaactgttgccacttgaaattgtagctgttgtaataggtgaatttgaggttgttggaccaccacaaggaactgccgagaactcacaagcagtaaatccaccattgcctctggatttcaggcaaaagattgaaacaattaaacaaacaaaaaaaaaacttcctcaataaaatattgtcttatctcccataagatcctttattagtgatgattggtgctcagtagtttgcttcattattgaaagaaaaataatcaggtgtcctatgagaataaaatgggattgacaaatcactgcatgatgaaactttgtagttgatacatctgctttggatctttgcagtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaagatgtgccaaaaatgtactgtggggcagatggtgaatggctggtacccattggcaactgcctatgcaacgctgggcatgaggagcggagcggagaatgccaaggtaagagggtccatattgcagttttttcactggggcttagtgcgagtaattaaatcagagatgagactaaatggagtaaagccagtaattagtagcccctgtgggatgtggtgggacacaggggtctaatgagtaagtgctatagctccaggtggcaaagctaagacgtttctaatactgacaaaataaatgatgctgctgtaatcagcagaaagccaaacacatttgctaacaggcacttatatctgaactggcttgatgcgccctctgaaatgtaaatgaacaagctgaagaaacagccttgattgatccttacttaaagagggcggacacatttttgagccatagttttcctgtctatggacttggtaaaatgacaaagattgttaaatatctcccgtcttctgcataagtgcgtgaatgatctaaatgtgaaattaggattaagttgttccagttccctcccactgactaaaatcgagtgaagaaagtccattttttctttctgccttgtggaccggtggagatatgacccaacaaagtggagggacattgcttcaagtacattctgttccctgaacacccaccgatgggttctctaaatgaaattaatcttgatgaaagacctctttatttctcttaggaggtggtaattaagcaagcaagagtcttcttatttgatctgtggtcagaagcaatagcaaattgtgacccaatttggtattgatttcagttattgagtttttgaagaaatctatgtatttttatcacattaattactacttaccatattactaagtggatttttttttctcacctcaggttcagtgtatgcagttgattcttgcttttttaccccttcctgtcagaatactggggagtgtataaagtcctttgctttacagaaagtttatatctgagtaagagatgagagtaattcctatttatacagattgtttgtcatgtgtgaaataaggctcaaaaatatcttttattccaagtttttgtcttgcttgatacttgtttttataatgtagttatcaacagtctgcggctgccaatccattatggttactacaaaatagttagaatgtaattctggtctcatctatggaacaatcagattaatcttttctctgggtaattgttgagctgtagatggcattgccacatggttcatctgatttggtggttaaagggcctgaattaactgactgccaaacaatttgtctggcatttcaaccattctaatgacagggtgggattaactatggggcaatccacttgattgactgaaaatccagttagaacatgaagaaaattgcattttttggtgatttggtgtcataaagttacacgttactccattcatagtttacacttgtctgaagtggcattcctgcttagctatagttatttctaggagtaactaacagtgaatgttctttcattttgtggtaaatagaaaaaagagtggctatcttttctgttgactcagtgttaaaaattcaaaaaaaaaaaaaggaaatgtgtaaatttaaaagtttacaagttggaatttaaggatttttaaaataaagattaaggcctcgatttttggtttgctcttgacttagcaactactagataagctgtactgaattggtaacccaaagtatattctggtattaatataagaaaatatgtgagtgcattgttactggcaactaaattactatgatcatagcaggaacagtgaaatgagcagggcaatgacatgccatcacattttagagtaaattattctgccttttccgttttgtaagacaggagccgcacatcttcacatgtcaagattcttatatatatttttaaaaaaacaacattggcttccatttcctgctaaaatgttcactctcagcattagcacatcttcgtgtatctaatgtcattgattttcaattgtcacagagcctagtaactcatacattgctacattgtgaaactccttgacatttttacaaccaaaattagaaagaaaagagaaaaagatggtgggcaaagtgaatataaaagcaatcgaacatttttctggtttgctttatggaaatagtcttgggggatccagttaatcacgtgcgtcctcgaaggggaggaatttagggtttcaaatctagtccacttccgagcaagctgttcctaacatgaggccagatatttcacagcagaagcaggtggattgagtcgtttttgagaaacttcagtgttttcaggtgtgtcaaccaagtttgtttttgttttttgtttttgttattttgcttttttttctgctaataaaatgattaactctttcaagacactttttgcacaagaccttgcactttggttgtttgtttctgttattgccatgtaaaaatttctgatgtagttaggtaagaaaaaacttgaatgacaaaggattccaagcttgagtgagactttatttatttatttatttatttatttattttgagatggagtctagctccatcgcccaggctggagtgcagtggcgcgatcttggctcactgcaagctctgcctcccgggttcactccattctcctgcctcagcctcccaagtagctgggactacaggcgcccgccaccacgcctggctaattttttgtatttttagtagagacggggtttcaccgtgttagccaggatggtctccatctcctgacctcgtgatccacccgccttggcctcccaaagtgctgggattacaggcgtgagccaccgcgcccagccagagtgagacttttaaaagatgacttgagactctaaaagtcttaggaataataaaaacagttggccctatccttgatatcatgataggcatcaagagtagcacccaggcacagtggaaataatatagagacgaggaaagatgtatgaatttggtcacttagctagatgaccttgagcatgtttcttaagccctgtgagccttggtttgttcatccataaaatgggatgataatagttatatttagtttacagacttgcaatgaggacttggggttgtaagattggtaaaagtcacctcagagatcatgcaacaacttgatactagcatttctgttgtcattgtgctcttcccaaggtcatagctattgacttttaagagcgttgagttgaaatagtagaaggaaaatccatcccctgaccactccttgatatcaaggctaaagataggaagcatctctctcctttgccctaacaaataataatatacgttttcacactttgtattgaaaatattatatggagtatgtcatttttttttcctcctcgataggaaagagaaacttcctttgaacgagcaaaaagtgacttgtgggtaggacaagaaagagggtgtaaagaaagcttaagaaggaatataaaggaaaactggccaagtcttcagaactctggcagcagtttcctccccaattgtcttttcaatggttctactgtggcaggacaaatagaagaacaggtgaaaggtcacctacttcctcatccatcttccttggggtccgggaggtcagagggaagattgattaagatcttaaatgtttgacaaaggatccttgggcaaaaatgggcagggcgggcgggggcctggggtgtgctgttgtttgactctaaccctgatcatccactgagtcgtcaaaggaccttggggacagaactacacttcctcttgcagttcctacccccagcagtacatgctaatggagaggaaggatgagggcagggggatggtggctttgccctctgaagcagaggcaagttcattctgctcttgaataacattttctgaaatgatttggcttggtctcagtagaacaacaatgtgtatgagctacttacccatcttctcaaggagaatgtatcgcaggagttagcagccctttgaacttgcctagtgattggatgcagaggataatataatgattctagttagtcctgcttccaggccacatcagactgttggaaaaaggaaacaaaatccacttcagacatctccttccggacagacatacccctaatgaagaaatgttccagatgttttacaggactgttttcattactttagaaatagtaagcagaaggaagagaggaaaatattccattaaatttttttttaatttattttttattatttgttttttaacataagagatgaagtctcactctgttgcctaggctggtcttgaactcctggcctcaagtgatcctacctcagcctctcaaagtgctgggattacaggtgtgagccacctcacccagccaaaaagattcgttattagtgtattttttgcttaattaaaaagctgaaaaatgaaaggagagctccagattttctctttgggaaatactaatcagcagttttcagagcatacatataaaaaataataccaataaaaacattcttttggagtcactcttaaggccaaatgattacaactatgacaaaattaagctaggtaagaatcaagccttgctgaagtatacaattttgttgtatattgaggtcatcagtattaaaatgtactcatatcaacaaaaggtatcgtattaaaagctttttaaagaaagaacaagatagaaatgttccaatggttttaaaataaacagacttgtgctctgaaaagaggaagagagctatgtcaaaaaaaatgatttcttttttcaactatactatagaaggagcttaggagaaagaagtaatggaaaggaaatatttaaaatctacttcacagagatgctgcttccatatcctttgcactgttgaaatttttcctctacctttgaatcgtatcattaagaatcaattgcttgaatcacatggctgcttttatctccggctttgaagcatggctgtgatcattgaaaaaatgtaattctttatctataagagagcagcgtttaattattgtcctttttctgatatacttttttttttcctctttgtgtgaccaggctgcctttgtgagtgtgaatcatgcaatagtctctatttggggttcaccaaaacatcgcatagaaatcatctcagggatttttgaatatggtattcaagatttgatgacttattttagtctaactgagcttccttgtatctttcagaaatgaattaacacataattattctgttaagatctgagcctctaggaaaaagccttcttaagtggtttttcagttactgctgtgcaaagcaggggtggtcatgatataagtttgactttcacataactgaactttactagttaatggcggggggtgggggaacgggtaattggtaaatttaacattagcaaaggactgcatgcttgtcagataaatttctcatatagaattacataaagtaaaaattgtaagtctaccattccctgcccacacacacacacacccacatccacccatacatacacacacacagttttcaaaagcttactccaacattttacaagttaccatttttcacaatttggcaggcaactcaaatatagccatatacatgtatttttaaaataatagatggaatcatccttgtaattgtcatcctgtttttatgatgcttgactgtcatagatatcgctgtatattagagaatatagcttttcttaattctccttcattgaagatgaatattctgtagtataagtataccatgctttatttaatgttttcgttattggtagctatctaggttgtctcagtatttcctagtaatacttttaaactaacacattaatgtgtaatcatacatgtatatttttgttaaaacattgaatgattaaccttgctttgctatttttctgcctttatcttggacatatgaatttagtagaacttccttatgagaatgtcagtggggggagcattaggcataaccaaagtagtaacatcgattatttggtggagttatgtttcatggaatcaatatgatatgttaaaatctttgcatgtgactaatgtattaatgaggtccttgttcatgatttctactcaattgggtcctttttaaatcgtgtttatgaatcttctttacatctgaaccttcaaaattctctgcagcacatgaagttaacatacagttagcacaaaatggccaagaactgcctttggagttgagccacttaatcagatgtgcaattgtagacactaacttagcttccctaaactcaagttcacgtttgcaaattggtggcaatagtatcttattatatatgacacacatatatgcatgaatgtataaagggcctggcacagtgcctagaatcattaaaatgcttagaaagtgaaaattgttactcttatttttattgttgttagatagaaatatggtgacaatatgggctgtttgatcaatccaacaaagaaaccatttcatttaggttccagagtagagagttttttgtttggttggttttgatcttctgaggaggcaatggtgacaaatacagggaagagtgaagcgatggtaccaaatggctggtcttgtctacattgatccaatcctctgtgccccaagtcactgtggttctccatgtggtccagctatgttccccaagaccctttcatgtggtctgcaaggtcaaaactttcttaataacactaagatgttatttgccttttttttctaattctctcatgagtgaacagtggagttttccagaagctaactgatgtatgataatgttattaagttgaatacagaagcaaatacagtgatcccctttaactttggacgatatgttccaagaccctcaatagatgctgaaagctcaaatagtaccaaacccttatacattatgttttttctatacatatgtacctatgctaaagtttaagttatagattaagcacagtaagagaatgccaacaacaataataaaatagaacaattataacaatatatcttaataaaaattatgtgaatatagcctctctctatcgttttttctatccctttctcaaaaatatcttactgtactgtaccttcggtaggcaaaaccacagaaagccaaatcatggatatgaggagactactgtaaaagaatctggttgtcctctattaagccagacattcaagaatatgaaaaaaaaaagtagtgactgggcgcagtggctcacgcctgtaatcccagcactttgggaggctgaggcaggtggatcacgaggtcaggagtttaagaccaatatgttgaaaccccagctctactaaaaaaaaaaaaaaaaaaaatacaaaaattagctgggcatggtggtgtgagcctgtagtcccagctactcagtaggctgagccaggagaatcgtttgaacctgggagatggaggttgtattgaaccaagatctcaccactgcactccagcctgggcgatacagcgagactctgtctcaaaaaagaaagaaagaaagtagtaaaacaatgtcacttttctcactaagtttacttttgttttggacaacagtgtttaaaatatgctatttgtgttaacatgcaatgcgttaattgttatttttcaatgaattaaaaataatttaaaaatttatttttcagtttcaatttgtattggtaaatattagtagttataactcacacacacgaaaacattctcaataatttttgagagtataaaatgtttgagagttcggttctgaggccgaaaatgttgagaactactgcacctagtccatcacttttcagtttctttggaaggtaacacagactgcacttctgcaggtcatggagaggctttaaaaatgaaaatgaaatcaagccctaaaaactttttcataatctgggagacttaggtagtttagaagaatgacattttatttactcaaccctttagacatttctataaaattaggcagcaatttatagctcttggctttttaaaaactggttatctgtgtccaataacatggctcagtgctccctttagttttactgtgctcgtgagaaggaatgattaaagaaggcctcagctgtcccctgtaccccgagagactgtatctcacttaaggcataaaagctttctccctgtatcctgttacagctggtacctctgagctgttttggggaggagaacaggtgaggtcacttggttccatgatctggagggtaattaagaatcccatgactaaatgaacattttatgaatattcagggtctatttctttttcctgggaaacacacatgttggtactgcttacaactccctttggagacctcagccttttctgggtgaatgcaggtcgtcagctgtctgcccagccctgcagttccaggcagcagattcttcatttgcatattctgtattcgtcctcatgcaaaacagcacacccatttccccctttcacaaaggcaatgagggcttcctttggaaaccccagccaaaatctccttctgtttatgcagagcccaatgatttagacaccatgcaaattaattcggttttgatttgaatgcttccagagatcaggggtgggaggcagagaggagactatttgcacagggctctttttatgcacctctgcccccagtgtggctggttgtcactctccggcccccctgccccatgcaaaataacccaagtccctgctgctcatttcattttgacctttggaaaaggaacccagccttggtgaatcccttggcttgtctgtttagtgacagcttcagctggaatcttgctgttctttctgaggtgggaggggatggcactattcagattatgctaggaatgttcagatgtgtcccaacaaagggctttaaaaaattgtaaagtaaaagatacaattctttgaaaaagaattgtcagagctcaggaagttctgaaaataggccttaggtcactaatgggctggagtccattcatgccatcagtgagtagatatttaaagtctatgatgtacaaatcaccactgggattttcatctgtgtttcttcatctatgaacgaatacatcaatcttcatacctagaatcacaattaaaatttcatattttcacttatgtccccagataaaattctttaaaatgtgtattgactataattctgtttcttattatatttgtggattcactttttgttgaatattgtcttttgtttctgtctccctcctccccactccccccagtgtctccaaatttacttattttttaaccttacctttattccttctagaatgggaaggcaagcgtactgcatattttacccaacaaacttaactctggttgaaaccagcactatcttctgaaaggccacgatcatatatgcattctataaactagaagaagaggactttgcatgaaatgtttttgaagttcaattagacttgagttcaaactaatttcacagagcagaaaatgggcatagctagacgttgcagtctaattaagtaaaagcaaagtcagttaaaacaacatctaaatgtggaagagctttggttttgctccacatggtctgacaaagtttgatgatgctgttcaaagtccatttgggatggattattaggattaaagagcagcagaatgctctctgtacatggtgtgttccctggtgtcattagcggatgagaaaattcagctgcttatctggctcttgtttctcaggatggatttaaacagacccacacttctcaaaggtgatcttactaacctcttcttaataagttacagatctcaaattgctcaaaatccttaaaataccatttgaagtaagttgattgataattatcatttcccttccgtttacagatattttctgcaccagtacaaagctgtggtacagtttcttaattacccagataatcctgtttgcttgtatttttaaactatgaagtgctgggtaattattcaattcttaatagaaggcaaatggcaatgtaaacaataattaggatgttagacagactaatgcgcttcaaagcaaattggatttttttcatactgttcagcttgaagtcccataaagctaacaatttagaagcaaggcgaaaaaggttccatgttgttcatattttatggcgttatctcttcatggcttgtttctgtgaatagcagtttgccccaatgaagctgcctgtgcccaagccaaatgtttctgtaacaatcgcttccctgctgtttgacatttggctatgttctcccagggctccagattgggcctttgtctgcttcagatctgaggggtcagaggttaacagaatactgatttcctcctataataccatggcaggtaaatatgggccaacctcatgatcagttaagactcagctcagttaggaatgctttttctcttgggcttttgtccttaagaacttccctgatttaagacttcacgtttcccagctattgctttccacagtggattcttcattaggatcgcagctgtctcttttatgtgacttcttcctttaataaccgttcgcaactaactatccccagaaatacctgagctgaaaactacaagcaaattattgcttttgatgaatgaattttacaaactgaatatggtaatactttgcaatctttaggcccttaattatgtcttgtagtcttatccctactgtatgtttcactgatgaaataataaactgataacaaaggcagtaaacaaagatacttttataatgtggcaattccccaacccctcctttttcttgtctagcctcatgatgtgttgccagttagaggtgcaattaaatgaacaatcagttttattttccattttcatcacttatggagaggcccaagtattcatcaatatcaatgttattaatgttttacatcagtttaattatatcagccttaatttttcttccatagactaatgttactaaataggttgcatcttaattggttatgatgcattcacaggctttagacatttaaaatactcgatcaaatttctcgatcaaaattcatcaattaattttaggacatctttctacatattagctatcctgtttgtgtttggccaacctctcttgctttgcactgtgaacttgaggcttggattcatttgttttcagatttaagtgtttaaaaaagacatctccactttgaaaaacagtttccttttgaagtgcccagcctggcaatggctgaagcagccccaggcaaattaacatgttaaaagaatggatcaatacctttctggctcctttaccctcctcgcactcttccaagggagaagagttttgaagaaccctaggaggcccttgacagaggtgccaggaggcttcaagaggactgtcagtagcccaagtggggaacattgacagcttgatctagtgcccagatcgcttctccgctggccatttgaaaatggatgcaagaggaattgacagcttcaggaaagctttagccgttcatgtaattatggagaggattagaagaaaagtgttgggtgacataagagatcaatacaagggcactagttgactgaattcacctttagctgttagggcactccattttgtaatatttagcctgtgcttagagaagaatgtttgataggcttgtttatttttttaggggttgtgtagacctatgcataagaaaaagaagacataagcagcctctggtttttgagcgtggacttgtagataattaacaatgtaatgcttccagtccttagggtgcaaaggtactaattaactaatgggagagattgagatttcattactgtgttctttaaggaggtgccagcaaagaagtgcagttgaaagtaatatatgaatattcaggtttctttttcaaaccctttcttttagaattgcctctctgcttgtatcctagagtttaaaattagcactgatacactaaaccaaggtaagagtgtggttgtttttgtaagaaaaaaaaactcatgttgatggagaagtgaaaacattatctttgcatgaatgaaaagcgtctttaaaagatttggaatcaaccactgaatggtctcaaatgatctgacttttggaagttttcctccataggataaagaatggctagtgtacttaactaaaataagcccaagtacctaatttattctagccttcatacatgattctgggattctcttgtacaacatgttggagctacaactttttcaataattttaaatggttactgaatatgacaagaatcctacactataatttcagcaattgtactaaaactttttaaaaagcattgttagatctttcttctagagaaccataaaatcttttactgaagagaagtaatgttttaccgtatgaaaatcataacttttattgcaactttgaaaactagatacactaaaaagaacccctccccaaaaaggattgttgacttctacaagagatagtgattagaaaacacaacccattgagtttttccaatattttcaattatatcttctagctggttatcactgatctacaggaaagctattgatttttgtatgtttatcttacatccaatcttcttattgaactatcttgtgaatactaataagttttcagttaattctccggagttttctagagagcaaatagtttccattgcaaacaatcatatatgtatttttctcttatttaaaaaattaagcctcttatttcaaacttttatattacaacattggtcagaattttcagaccaataataaataatagggtagattgtgaacatccttatgaccaattttaatggatataacttaactataatatcagatctattttcttaatatcatattaattttaaacacttctcagaggagtgaatgttgaattttgttaaatttacatatttatcttggttatgttgcttttttggtttgttgtattttgtatttatgagatctaatatattagtagattttttctcgtgataaaccataaactctctttgcatttgtagaaaaaaaaaagccttattagatagcagtgaattttgacaaattcttttgaattcagtttgttaattgaaaacagtgattaggagccagaactttggaataccaactgaattttaatctcagctctgccactcactatgtgactatgggctagttagtaaactttagtaatttggctttctcttctataaaatgggaataatgatacctattgcatgggtatacttagtgttaaataagataatatatctaagtctcaacaaggaaatggtgtctattaagtgttcagtaagtgtcacaatttttattgtttattttgaatttctaataaatatccaggtgacattagtctacattctctctctctctctctctctctctctctctctctcccctttcctcatcaggttttggtactataattgatttataaaattaaaatagttttacattaaaaaattagcactgtagaatgttaatgtgcatgagaactatcttttctttgcaaatttgaaagattccaccattaacactggctctggactgtgcactttgaattggggcacttttctctatatttgctagactttaataaaaagtaaaataaccacaacaaagaaactatctctcagaccttgttcagttgcttttcaaatcacatatgtagattttccagcccagcgtagtggataagttctttgatttggtatctttttagcctctgtttcttttacggtgaacagcaaagatgacacattgctctcatccataattacattattgaaatttctcattacttgtgtagtttttgtttgtttgtttgtttgtttgagatggagtctcactctgctgcccaggctggtgctatcttggctcactgcaacctccccatccctggttcaagcaattcccctgcctcagcctcccgagtagctgggattacaggcacatgccaccatgactggctaattttttttagtatttttagtagagatggggtttcaccatgttgaccaggctagtctcgaactcttgacctcaggcaatctgcctgcctgggccccccaaagtgctgggattacaggcgtgagccatgtgagccactgcgcccggctttgggctttgtgtagatcttaaacatgcgaattaaaggtaatgggtttgttaaactcagttagttcataggcatggtagagctactctttaatcaggagccctggctgccaatgagaattctggttgagaaaatacttaatatcccattaggggaagctacttttcactgcagagtgaatgtggatgcagcctctctgagctgtggtgctttactctcctttttattgagagaccaacagccagagagagaggggagagtgaaagtgagagcaagaatgagagagagagaccaagaaataactgtttggagacacatctggtgctccttagatcagcaactttgacacagcaatttgtaaatactttacattggttttgaggattggaaagtttcatttttcacataaccacacaaattctgtgggccacagcaggcaggatgaagaccagaggacaaacattcactggctcagtataaagaagaactgtttagcattttgaactaggcaagagtagagtgtgatgctttttgaggcatattttttggatgtgttcacattggctgcatgaccccagggtacctaacagtgaaagattggaggtcctgtgtttcttaaaaggagcaccactggcattttggacaggatgattcttcattcagtgaaactccatgaagaatggagttttacaggactcccaagtggctgggactaccggagttatagagaatttagtagccctagtagtccctgagcggtaaatcctggtgtcgtcctcagtcattttgacaggccaaaacctgcccttgcattttgaaatgtcctgggatggatgctaatctcaattatgaacttctagactatgaggttactaagattctaagatagaatgttgagtactctgctttgggtatttcatatatccttgggtagacaatctaggtctaagatcttgtaacatagaaaagatggagaagctcttccaacaatcccagctagccatctctctttcttatttttattttccctaaatctaagagtacgtcataatatttcaaaatcaatatcatgtttcctccatgtattagtctgttcttgtattgctataaagaaagacctgagaatgggtgatttattaaaaaaaaaaagtggtttaattgtctcatggttctgcaggctgtacagaaagcatggcctcagcaactgcttggcttctggtgaggcctcaggaagcttttactcatgtcccaaggcaaaggcgaacaggcattcacatggtgagagtgggagtgagagagagaaggacaacgtcccagactctttttttttttttgagacggactctcgctctgtcgccaggctggagtgcagtggtgcgatctgtgatcttggctcactgcaaccttcacctccccagttcaagcgattcccctgcctcagcctcccaagtagctgggactacaggcatgcggcgccacgcctggctaatttgtcccagacccttttaaacaaccagatctgtgtgaactaactgagggagaactcagtcatcaccaagaggatggtgctaacccattcatgaaagatctgcccccatgatccgatcacctcccaccaggccccacctccaacactgggaatcacatttcaacatgagatttggaggggagaaacatccaaactatatcactcaataaacacaaattgaagaagataggaaatatctttgggaagaaattattaacgtttcacaaaagtatctggaatgatgaccatcagccaagtgctctaccagttttaatttatttcatccttaaacagccttgtaagtcaggtactgttattatccccatttttacacatggaaaggccagggcacgaaatgatggatgtgtttggccatgtatactgcttgacaatttgaacccagatagactggctccagcttacacacttgagaactgttagaaagaaactttcccccagtgccttgcattcttatataaggtgagaagagtatttaaaaatgcctgagtgattgacttgttaagagtgccccgtaattattctaacatttttcagatattcacctgccaatgggtggcccttgtgttattttgaacggccttacaaagagcaaaatgcagctgcaaggctggagaccttgtcaaagagtatattactgggcaaattatttttattttgactctgtatcacagcagaaacagatgatcccttttcttttcaacttaagtaattgggaagttacaagcatagacccaacttgagaaaagacagaacatcatctcatcttagcaggaggacagcttaaccaaatgagaagttttggatttctctaatgcttctgtaataaatctagagagatttagaaggaaaatcaatcttaaaatgagaatgaacttttaataatctaaatgttgggtatgtgatttttagctgattcaggtagaatatttgttaaacgtttacagaataaaacaatggcaatgaaccaacctatttggaaagcaatccatttaagtaataagaagaaaagggaaaaaagatggaagaagcaattgctgttggaggtacttgtcacttcctgtagcatccacaagtactttctcaccttcccctgttgtattgctacctgtggcttcagtggaaatgactcacctttcagctcagtagagccagtatatcctgaattatgatagccacaaaaatttgtccccccccttttatttttttagcctcttagctattcagagtcagattttctgtttcttgtaacacaaccctaattaatacaggaggcagcattattttaacaggcagactagctatctatatacaagtatttcacatatgaaacacgatgtttgcccagggtgagtagttgtttttccaaaagatttctttatagtactataaacaatggggacatcttaaatggttctttattgtcttttctcagccttatggcaagatagaacagtttgagtcactgacagaggcagagggaaagcctcttctaagccatagcttagtgaagcaaaaaaatctctctttatagccttggagaatatttaaatgggaaggaccttagaaatcctttagttagttcatgcttctcactttacagatgaggaaactgaggcttaaattaataaaatatataataaatatcagatgggaagaggtggaggggaaaaaaggaaataaaagaaaactgataaaaataaaaaagaaaaaagtatataataaatattaaagactggtgctttaattccggattttttgagtcttactttcttggtagtgttaaaggtagaataagctcagaaaacacatgggcagccgaaggcaaagttgcatctgtgtatctttgaaggaggccttgaggagtgaagtctcatatacccaaacctactcccaacttaagccttcggaattagatcaaacttgttccctcaccacaatcactggggtttcagctgccccctcccccatccccatataggcttgaatgcctggatatatcgtgtctatgccagtacattctgaggtctccatgcctttccctgaactgttgctttgcaagagttcacagtctaaggtgatgggcagacctagaaaaatgattgtaatatgttataactaagttcaggtaaagccctgggggagggagatgctgagtcctgctggggatgaggtataaaggaaggtttttggaaaattaaacaatgttgaacagcagttgactttcaactataaacctttcctaagcatctgctcagacaatggaaaggcaaaaatgcctgacatggcctttaagtgtagaatcttgtggattaagcaagtgcattccaggtcaacagaagagggacacattgtgtgcgggtggtgtgtgtatgtgaatgtgtgtactgccgggagcccaccaatggatacagtggccattggggtttaggggatgagtgacagggaaagctgtaacttctaagttttaggcttgatctattggtgcatggttattccatccttagtttcagaaaatccttgaggaggaggtaatttttaaggggtaggggtttggcatggcaggatagaaggtcagtttaatttatacttgctgaaagtagaatatataaacggctgagagtactgatccaggaaaggagggtggtcaccttttgttttgttttgttttttgttttttttaagatggagtcttgctctgtcgcccaggctggagtgcagtggtgcagtctcggctcactgcaacctccgcctcctgggttcacaccattctcctgcctcagcctcctgagtagctgggactataggtacctgccaccacgcctggctaattttttgtgtttttagtagagacggagtttcaccatgttagccaggaaggtctcgatctcccgacctcgtgatccgcccacctcgacctcgtgatccgcccacctcggtctcccaaagtgctgggattaaaggcgtgagccaccgcgcccggccatacctttttatttgctttgtaattctgaatttgactttgtagaaaagcaagttttgagaggctttatttagattgatacctttgggagacttatcagtcagttcaggctggcataacaaaaaatacaatactacagactgggaggcttaaacaacagcaatttattttctcacagttctggaggctgaaggctcatgatcaagggttcatcagggttggtttttagtgaggcctctttcgtggcttgtagcaggctgccttctcactctgtcctcacgtggtcttttttctttagggtagagtcgagagagcaatctctggggtctcttccttttcttgtaagggtactagccttatcagaataagatctcacctttatgatttcatttaacttttattcactcctcataggctctgtctccaaatatagtcacattgtggggttagggcttcaacatatacattttggaggggggatacaattcattccccccacattcatgtatttcttcttttttcataaaaggttgtgaacaagcctgtagcctgtagcgtggtggcctgtaatggcagcactttgggaggccgatacgcgtggatcacctgaggtcaggagttcgagaccagcctggccaaaatgttgaaaccccatctctactaaaaatacaaaaattagtagggcctggtggtgcatgcctgtaatcccagctacttgggaggctgaggcaggagaattgcttgaatctgggaggtggaggttgcagtgagctgagatagtgccattgcactccagcctgggtgatagagtgagcctccatctcaaaaaaaagtaaataaataaaacatgaaaaaatgaaaggttgtgaatatgtggcagatctataagacttagcctttgtatcaaggtttctgtgttcacacctgtgtgggtttcttgtgataacagtgtagcttggtacgatgatctgaatatttatgcccccttcgaatttatatgttgaaatcttaaccaccaaggtgatggtattaggaagtagggcctttggttggcgtttaggtcatgagagtggagccctcatgaatatgattaatgtccttataaaagggaccccagagagctagctagtcccctttaccatgtcaggatatagcaagaaggcactgtctaggagccagaaatcgagccctcatcagacactgactttgctttgatctcgtactttccagcctccagaaccgtgaaaaataaatttctgttatttataagttacccagtttatgatattttattatagcagcccgaacagatgaagatacatggcatcctaaagcttccacccccgtgaccaggacttttctggatgtgtgaatcttgtagaagtcactttatccttctaagccctgtattccttgtttgtgaaatggagatcatattatatctatcaatcatctatgtgttttagctgattaatatttcactagactttaacataatcagatttattattaattgtactgtggttttattgtgtgcgtagctgctaagtacagcatagaaagcctttcttagtaaggtaactaaatatggcttagagccatgttgaagcgaacttatttatcataaggttatcaggtttagtaaaaaatcgcaaattaattttgtatgtataaaaatgcggaatacaggcaagtataaagataggcaaaatcatctataagcttaccacataatgagagccacacttattttgctttttatgcttccagactttctttgatgtacacatatacaccacaaaatgagttaatgatcatggagcatgatcataaaatcttttcagatcaataaatataacttcataacattatttttaatggctacagagttttctgttgcctgaatgtaccacagtttcttcaactatcctctattgttggacatttaagatgctttcagtttgatgctttcaataatgttgcccttaatatccttggccaaagttttaaaatgtagccttaattattttcaaataattgccaagttgaaaaatatgcattttttagaaaagcttcagtacatactgaaaaaggctcagttttgagacacatgcttcctgagcttgaaacaaacataacgagaaagagcatacatataggatcattatatgttaatttccatgcaatactcattaatgaaatgaactccaaagtggaggtagttttactcattagcacttgcatgtgagaaaacttcttttaaagttttactttctcaaggttttttgccatcaaagcctttcttttcattctaaaaaatcaattaattttaacacttgttttaaacaaatgtaggattctttggctacatctgttggcagctaccctttaacataaagggttatgtattttagtctcctgatgcaaattatcgcctctaactctactgcaagttttccttcccactatttcaggaacatcattgctttcgaaacccaaagcaaaactccctttcaaaaaggcattgttaaagtgagcttgatgaggctgattgtttttatataatggcttggacactgtagtcttacaattttacagaatgcctttagggtttcaccaactggaaaggaaaatgacttcatggatgaagtatggactttaaaatatttccccatacagaaccaggagttcaaatccttgtagagttgcctaattccctttctttatgagttcaatgcattgattgctgtgtaatcaattgtttctgtgaccttgaaattcatcttgttagactcctgagctctatcaccttgaaactgggtcatctaaatgcctgtactagcagtccataaacttgtttcccagctgtaacttatacaccatggactattattaataattatccagttaagttttgcaccttcttcttaaaaaatatttttggcaagttatttttccaattgtttgcacagattgttgaacaatgcttcactctttctttctcaccttttcctagtccttttgcctctcccttctctcctgcctaccctggcctctggtctggaagacattgtcatttagaaacagagtagactttccaaggtcagtgaaaccagggatgtattttcttgaaactaaagcattcattctgctttctgtaactcttctcttcagcaataagagtataaaatcatatttttttgatttttttctatttattttatttatgaaacaaatactgtttattgtagaacatttggaaaatgcagagaaagaaatgctgctgcatgcaaagtaaacctgaaatcacatttggtaacgtctgggtgcctatcccctgtctcattgctgtacttgtaatgtacaaagtataaatgcaatgtacaaaatataaagagtattactctgtttgggtggtggtgctccccttttcctctctactgctggtccagaccaaggaaagtggtttgttggtaacgtcagaatcacctaccttgctgggtaaagcattcatttgctgttttagattgcatttctgttttgcttgggttgagtactgtcatctgtatgcctgtggagttacagcttcccacacactttattggcccacaaactacagctacttctgtccgcctccccggctcaacattccagttccccattaggactggcaccttcggctgtaactctgaaatcctctatgaatgagctcttgccattcccttcccttagggtgctgcaccctgtttctcaatcccacagaatcttgttctgaatcaccaggagcttgaatttggcttactgatctgactctaatatggtaccttcttaggggatcccctcgctgcttcggttctctgccctctgcctagatgtcctgagagcttgatgtcatcccacagcaagacttagttctcagtccaggcaaagtggcatatgcctgtaatcccagcactttgagaggctgagatgtgatgattgcttaaatccaggagttcaaggccaccctaagcaacatagcaagactttgtctctacagcaaataaaaaagtaattagtgatgcgtggtagtgcatacctgtggtcccagctactcaggaggctgaggcgggaggctcacctgaacccaggagtttgaggtggcagtgagctatgattgtgtcactgcactccagcctggaagacagagtaagactctctccccgccataccctcaaaaaaaaaaaaaaaaaaaagacagttttccacaacattttggacactgaattggccctacatcagtttcttttaatgtaatcccccgaattccagcttcttcccatctccctctgttgcctatgtcagtgaggtttcgacaagcctgtacagctctcccgtcaaagataaacagtaaggtctatgtcatggaaagatgagtccttaataaaagggagtccttagtagagggaatccttaataaaagaagcttcagctgttacccctggctggttatccagttgcagggactggaataactcctggtcccttataattctgaggttattgcaattcaacagtgattgcctttcctacttcacaggcaatgaaaagtttcttactatgttcccagtcccgtgcagagcatgacttggtacaggttttgtggtgtattcatctcttgaaaaaggttgtatcagtacagaaagaggggaaaaaatgagttgatcaaaactggcgtatttgatcatttaagttgtattggccaaattatttgttacatagtaatcctgtttccttctgtgagatgttatgacaactgaggacatgctttgattcactggctgcagtgcagactagttgggtgttcatttgttttgttttgcacgtggaaatttaagtaaccacaacagcagcaactggatattgttctttgaatagagagaattcattgaattaaataagaaaactgggctgggcgcggtggctcctgcctgtaatctcagcattttgggaggacgaggcgggcagatcacttgaggtcaggatttcgagaccagcctggccaacatggtgaaattccatctctagtaaaaatacaaaaaatagctgggcatggtggcacacacctgtaattccagctactcaggagtctgtggtgagaggattgcttgaacccaggaggcaaaggttgcagtgagtggagatcgtggtatattgcactccagcctgggcaacagagtgagactccatctcagaaaaaacaaaaagaaaaaagaaaactggcttgtaaagatgcacaagtgccaagtgccaataaatgagtgtaccaacacatctttcttcttctatctgctcccctcctccacacccttccagccttcattgtattgggggattacaagtcttcctaaatctgagtgttgatcctgtgatcactcctactctgaaaccaccattggcttttaaatattagctcttatttctaccactactactcccgtgactactccgcgttactggggccctgtgtcaaagctctaacgtcggtgagaggagtttacgctgtattttaggataggtctccaagctctttcttcaaagctccttcactattctaagaatctagctgctgtgcctttttctacacaatttaccctgccccaaaggccctcctgctggtcacaattttgcacattccacaaggttctacagaagcatcatttttttcttctctctcctaactcccaccagcattttgattgcgttccttcatgtcacttatgctgtgtaatgccatcttatcggacttgttagggcacagagtacagtattactcagtgagtaattgttctgccatttattagctatttgacttcaggcaaattaataatttttctctgtacttggttttctcatatataaaatgcaagtagtaatagttcctacaacatcagcttgtcgtcataagtaaatacgtgaaacacacatgaaccgtggctgggacgcagaaatcctgcaatcaatattagcgcttactcctactcctgctactgctgctactactcctggattgtcatggccctgtgtcaggaccttgaacttggtaaaaggagtgtaggctgggctctagaccccactttccccttcagttggatactctttttcagtgaacaacctgtacaactatatatggcagttctgtaccagaatctatgcacttcccaggctaagtctgtatttatctttgcattcactatagcacctaaaacaatacagtacatagagtcctattcagtcattgcacgccacgtgtgatcattgaaatgaacgaagaaacaaatgtaaaaaggaaaatgtaaaaatgtcaatatggttttatttgtaagcagcccattgatttttgaagcatactcaccgaatacatcatgtattttcagtgagaaagcagtatttgtcacaatactagaaatgtcataaatttaaagagtaattgagtctgaattttctgcaggtttatttactagatcaaagagtgacttcaactttcagtgcttattttatttgccagcataaacttacaggttcagtcaaatgccaagaaaataagttaataatctaaattatgcagattctggcaaattctctttcttttgggggagaaaaaaagagagagctttgagtttttatctcacttcagcaaatccaactgactataatagtaagaataaaactctagcaattaatctaatagctctaggctgctagtcattccagaaaagtgacattacacagaatatactagttactctcattgcatgtcattgatatataattcaattgattttcacattttttacactccaaaatgaaatacaacttttgtcatgtcaccagattggaattcattgacaatacattaacatgccaaaaataatattacacacaagaataatgtagaaataaattacaggtagagcagtatccctaaggagattttcatttgtgtcctataacagaagacttataaccctactcatacatctgtttcatcccactacgttttagactcttcgttcaattcaataaattactcattttgccacacactcagcactctgtcagttttgctgggcagtatacttacacaaaagagtctgtataattctaaagtataaccccccctttttttttagcaaacaaatacagagactttcatgcaaatgaatccttgaaaaagatagtctggataactgtaaggctgccacaacttttgtggaaatgttttggaactgtcttcttcaaaatgtctgggaccttctttttattgataatctcctcctcctccttcttcgtcatcgtcatctttgtctttcttcttccttctttcttcttcttcttttcgatggaatctcactctattgcctaggctagagtgcaatggcaccatcatagctcattgcagcctccaactcttaggttcaaatgatcctccggcctcagcctcctgagtagctagggctacaggtgtgcaccactgcaccttgctaaatttttaattttttgtagagatgagtggtcttattttgtggccctggctagtcctaaactcctggcttcaagcactgttcacctccttggcctcccaaagtacttgcattacagatgtgagccactgtgccaggcctggggccttctttttaaatgtgcttagttctgaacaattttgtcccttaaggtggatttaatttttggaaatcaaataattcactgaccaggctattgataaatgagatcagccatactgggtaatattgggttttactcaagaacaatgagtgattgcaaagtaacagactatttttaggagtgacttttaaattgctttgagtgtactttcaagagaagtatttggagcactgagaacataagtggaagaagaatgtggaagatctccagcatccttggatttagctgtcaattacaatgctacttccatgagagaaggctttgttttttgggccttgcttgttttttgcaggactctcagagcctaaaactgagcctgacacacagttgttattgaaaggaatgaatgaatggattaaatgcaacagttcacaaatgcattcaaagtcccacggcatagagatttctctctctctctttgttttagcctttatggcattaatttaaaataatttatgttaaggtcgctatgtatttacctgatgagaacttggctttgtgctaagcactttattttcagtatttcattgtgtcaccatgacttggtgaaatagtgactgtcattatcctcttttcatagatgaggaaactaaagcccagagaagctaagcagcttgcccaaagtcacacagctaataggtgaggagtctggattcaacctgcaaagtctggccactgaccaagccttcacccttaactacaaatctgggctgcttttcagcacatctttgttgtcctgatttggtcatattctcacattatgtttcaatcattctaaactgggtatataataaccccctttgagagacaagggaattgaccaaagtacattgtttagagggattttctgaagaatgacttcatggatgaagcatggacttattattacctccttatggcctctgtctccaaatgtaatcacattgggggttagggcttaattattgggaattaatgaggatttggggaaacatctttcaagaatgccagggtctagtgcagagcatcgtaaggccggtaatctggagggcagccttcagtgagcaggttcgcattctagtacagggattaaaaaccatttctcatttaaagcccacatttccaaaaggcttataatctttagaggaatacaatacaagagggtgggagactgtttctaatttttattctgaataattatctgatctgatcatggacaagttccttaggctgccacattagtttcctcatctagaaaatagctaactggacaaggtcatccacagggtgcccggtagctcttaagtgtcaaaatgagtgataagataaagtgctcttttgccaaagataagaaggactatctttgttgacagttatctagaaaggcttccaagaataggaacttggtaaactgtagttaaataaagctggtaaaagaggaatgaatatcccttgagccaagaacaggagttagctgccacaccctggggttgaagagactgggtaggtaggtggagctgagttttgaaagatttttgaagagcagaggaagagtttggtctctacccctggctcgttcatcagatatttcttgattgccatctatcttccagccattgagagccattgatcatgtaagattctttccctactggagttgggaaagatatttcatccaaccaaagggaatgtgcccttgatatgaagatttgtaatgtttaccaaaaaatctttgttctaccactttaggcatagaagaagaagataagaaaagcctcacagtaaagttgacttgcaggttatatttaaaggatgattgtctttatttgaacaaaaggagaaaataacaaatccgttgtttgaagaggaaaaaaaacagaaaaaaagaagtgcctttgatttggcataattgatgctttattgctttgtagataggtggtttagggcattggacaaaagacgataatgtttatttagatttgggatttgggactgttctagaaagtcaatatatggttgttacttttagtagctgtaagaatggcataagataacttagtggaaggtaagtgctttctgagcttttctgtctgatgatgaaccctagtggttgcaaaaatgagtttataccttagaatcatttgaggtactgattacaaatgtacacttttaacatcaatcctcaagactttagagtttggagtctgtgatctgaatttttcacaagctcctaggtggttctgattaatttaggttgaggaacagcattttggaagccacaggtaaacttgtgtattgcccacaccactaaggctgactctggatgacacccagttgaaagtgatttccaggttcccttgctaagtaaaagatccaagagagagaatagtgctgcttatttctttttaactggataagattgaaaaggtctgtggatccaatagcgatggagaacgtgcagaagctgcaccccgaattgccgatgaagttaatcccagacagctagaaattagccagtatagcacatatgcttagattggatgctgtgaatatatgctttctggtcaacaaaaaagttaaatcatgtagatgctcaagtgaagagcacctctgtcgactggaaagagttgagttatttaccttttttcccccagaaactgtttcttgaggtggaaaagcaactggaagtacaactacacagaactgaaaggctattgagtttgattatgggcataaaattaaattttcagctaaatgtgacagccctagtagaacaaagaagaaccaatcaaaaagttattgactattgagacttttagacagagctaacaaattgaccatgggttccagggatagtcacagcctggaagttgcttattctctttcttctaaaaggtagggaagttcacacaaccacagccactgtagccaggccagggaagaaggccaatttaggcatttaccagcatgtgcaagatgcagtttttcatctgagggggtgagaccttttctaggtgcctgtgttagaacttggagcacttgcaggtaatgagaacgcattccaatacaagaaaaacctatttagggcagtactggatatggattagccaagaagatccacagatcaaaatagaatccagggcagaaacagagcagagaaatttcccagagccacttatgggtaagtggaacaccaatgatttactaattacaggcatgtttttgcacaaattcattttttagtaaacaagatatgctttatgctacttgcaggccattcttaaatcattcttttgggaatccttataaagacatcagttaaaaatctcatctgttatccttcaagagaagtagttggcatgatttttgaaattgagtccctgcctacctagattcaacagattaaatatgaattatcagtggataattacctagggctgttcttatatgtatattttatttccttaagtgtgaagcacatggagtgtcacgcagatgtgggaaaaggtaactcacaaggatcttttgcccagaactcttctggtagggcgctgctggctcttccagtatgcacccaaggtggcaaagagtctgcctgtcaatggtatccagaagtgacagtggggatagccctggagaaggttgtttggattttcataagggagagattctctctctgatctttataatctgaatcctaccctcacaggctttttttttttttttttttttttttttgacactagtcacaaaattaacagtcaggatgcttttgaaatcagaacaatttccctggaggaggcacagcccccggtaccatcattattatatatgttttgaaactccatagactggaactcgttcagcgtgctgtaatctgtgtgtttagaagctgtattgactttaggagtcacacagatgggtgtagacccatgtttcaacatttttctttcagggacacacctttgaaattctgcttggaacatatcagcttcctcctccctccgagtcatcagccatctcagtgaatagcgcatctgcatcctttattgatacatacgggggcaggggtgagggcagttactgcctctgcctctgttttctcattcaaatattagcaaaggtccacaaacagaaatagagaaaccagattaaagaggacagattgtatttatggtaggctgtaacacattttgatcaacaacaacaaaaaagtttttggagctatggggctgcctgatggtaggatacatactgggtttattataatgcatgtacattgttcaatgtaactttcccatcatttttatgccaaggccatatgtatggctcagatgaaatgtaactggcaatttttcattgttgttgttctttatttacctttctcttttaatcatctccctgttccaactaaacaaatcacccccaaaagccagtgattaaacacaagtgagttcaaagagccaaggcaagtctgcccaagagtggccgactccccctacagaaggccaagtctgccaattgcagtcttcactcagagcctggtagtaaaactgctgagaataaggtggtttcagaggcaaacagtcacctggcccagagggcttctgcaatggagccccctcagaagggctaggctatgtgagaagtggtgggtgttggccgtgtcaaacagctccttccagtaggcatccaggaactgagtggtgtgcaccccttaggaggccaagcctaaggcaccagctacagacaaggtgcccaggtggcagaatgcagcccctggcccggccaaggctgtgtggatctataacagacaattttggcatgactgcattgactttcactctggtcttctgggttctaaaatgttggttccttaagtaggaactaaaagttaatatctgcccttgtgatgactaggaatttggttaattcatgtgcctgcttagcaaattaaaatggccagtaatcagaactagaatgttaaatctcaactgatctgagtttttctcatcttttgatagaataaattgaactatctggctgggcacagtggctcacacctgtcatcccagcagtttgggaggctaaggcagtcagattacctgagttcaggagttttagaccagtctggccattatggtgaaaccccgtctctactaaaaatacaaaaattagccacgcatggcagcacgtgcctataatcccagctactctggaggctgaggcaggagaattgcttgaaccctggaggcagagcttgcagtgagccaagatcatgccactgcactccagcctgggcgacagagtgagaccctgtctcaaaaaaaaaaaaaagaataaattgaaatatctgtgtgacaattgcctggtgtttgaaattccccttttcaaacatcccagcatatttggtttgtctcagtgagctctcctttgaaagagcactggctactcccttggtaaaagaaaggggtcagtgatggggctgcaggtccttgttcctgacacgttttccttgggaaattcagtacaaggtatttcgtctctcattcagtcatccctttgctcagcaaatatttgtctttaaagactctcacgttctctgagaaaaaaatcatggccttcgcacaaaaacaagaagattctatttagatttgaataactaatgtaaacaataaaaataaaatagacatttacatattttatctatatctagatacatagaaattaggccgaatgtatgtgtgagacagatagatgagtataactgttttcatcctatttatattggctttgttcttcaaagaaaaaaaaagctttttagatactacaccaatgaagaaaaaggtatcatctagaatcagccctgagatgaaaaagaagtgtgcttatttatataggaagtagctttgcatacttttcctttctgttattgttcaatcttgaattaaactgtcttttatttttctacttccatttgtgattactatgaaatttctgcctaagggctgccaggaattttgtaaaaattaaacaatacaaaattctttgaaagaggattttgagtcccaggcatgctgactttttaagctcaaaaagtacgcgtggcttttgcaagcagaagcaagtcctaatgctttgaagaatgtaaaatataatcagtatttcagaggcattgaggtggttaatctattaatctatactagggtaataaacctaccagtataaacatctgctaactagaatttggagctctcaccttaccttagagagaaagtttaacctaattctgcagtttcaatactaatcatgggttagatttttttcattgtagatctcacttgtccttgctttcttgagtagtcttagagcgtatttgtttgctgcaattaaagcagccgtagtctgattattttcttaacttgattgtaactgggtacacttggctgatcatgtgactctctaaattagctgttataagttaattcccaagcctttgaggtgtcaactctgtcctcagccacttagagctaatatttgaaggacctccagggtacttggagggggaggtggtggtgcttcaagaatcccatttgcccacagcacagtggaggagtacgatctgggctgtgtaggaggtgctgatttttggactgaaaaagcactgaccccctgcagaccacgatgtcctgctgtgattcttcccttgtttgaggcagggctacagatacaccccatggagccagagaacagaattccatgtgtcccccaaacccaaatcatatacccaaagccctcagccctcagatttaagaattcctagcctagtagctttttcgggtggtttctctgctcccaagaaggatgtccaggaggtccatgggcccccagtccccctacttcttgcagggtgctgccctgtggcagagccacctctaccttcatgcctgctgcagggattcacccatccttaagtcctccagcccgttgctggtttgctccattctagaatttgcttcctactgcgcgcaaatgtttcatgttagagaatggtaactgccatctctataatggttaatgccgaacatgactgcagatgaaagtaacagtgtgatcacatcctttctcttcctgttctgtggcatgagtcagtctctttgccttaatgtttatacagatccttaataacaaataacagctgatggcgacttgctgagacatgtacaataaggaaagaaattacatcgtaaaagatttgggctttgtcccaattttttttttaagagaaaaaaaaaaaagcagggagagagaaccttgttctaataaccagtttgtgcaacaatgttccttttttcaaatctaatgagatctgatccccacaagtattatgatttattacctgcccctactggactgtttgcgttgggtgtttattatttggatattcggttaacataacacttgaaataatttcgctttctgaatctgctcttctctctttttcttgggtggttttgtggtaggtcggacatcctcagatgaaaataactcacaagagagccctttttctgttatcagtgttctgtcttcatgtccaggaaaatagactcgtgggtttcctcaaatgtaggggaaaaacaaaagttgtttgctttgtgtctaaaagttccatggtgtcacacctagaaaccctcggtgttggagactggtgcttcatactccattgtcagcaactttgcagaaagtgttgtactaaagctactacagtgagcaagcttatgcccttcagcgttgtctcaaattttgtttttaagtccaggcgtaaagataacatgtgataatgacctctccatttatttggagtcacagatttgatactggaggatctcaaagcattaggtcaaaataattagctctgtctgtagaataatcaactccctctctgcctggatgcaacagatttgtaaccttgttttaaaagctaggcgtttccattggtacaagtcagcgtgtttaggtgtggagagagttggcagcctgcagggaggggtggctgtttcccagaagtcacaattcctggtggagagaggaagctgtctactcagtttccctcctgtgctttgtgaatggtgaccgccccttctcccagcctctccagccttcctcaaggtggggcaaaatcagccccctgcagcaaagtccctttccttccttcctgtggagacctggaatttttcagtgctttcactactgaacatttctgaaatctttttttttctgatgtcaagcaacagtgtcatgtatgtaaattatagaaaatttagaaagaatagactattgcagtaaaggaaaccatgcacaatcctcttactcatggaaaacatctattactatattgtatgtactcttggagtggtttttaaaatttttctttaaaactttttttggcatatacgtagttttttgttgttgttgttgttgttttgttttgttttaatgatccatgcatttgatgtatttgagacctgtaaatgccactttgatctttatctggttgtgttagagagtatgtcggacagaggataagagcatgcctttagttgtgtgggccatttatttatttgaaatctggaatgtagcctatttggtgatggcacaggagggcatggaacccagaagccaaggctaaaaaatgtatagaagtggcatcagaggatggggaaatggtgtcagggaagcagcacaggacctagaatcagaaaagccagtttctgctcctgctggctgggtaatctccctgaaactcagtttcctaatctgggaaaaaggagaactcctaccttaccagttgtattgatgattcagttaattaaatgaggtactgtttaggaaaatgctttctaaacaagcactgcaagactcagataataatattataatgaaaaagttgttcagacttggctgtggtgattcaaagggaataagattaaggtgagcagttggtggctgggatttatagtcttatgtccatgagcagagaaaacgttgaattggctgctcgaattttgttgttattgctgttgctgatgcatctaatggttaatatacacttcctgtttaaatggttaccgagcctggattattactagggaggcagcgtagcaaggctagtatttgctattttatgctggtcaccctgtcttcttgagtctgtgtattttttactcaatgagtacattctcccacaatgctaatatgtttgctctttcacctaagagacgcttatcagacttttactatggattacaggcctttgtatcaggaatcttgctgcatttacacaagagagaatgagacaggcataactctatgttttaaacaacagataaggtttgtctgctgtgtgcacagagaaggaaggggaggggaaacggcggggttgggggtggttaggtaggggtggggcctgggaaagatgtataaacacttttaacttgtgaaagaatgtctttgtctctgctcatgagcctcagaaattggcgaaatattaaaaggaggggtttgcagggcagcttgtgagctctggagtcagattgccttggactccaccctgctccgacagttccttagccatgtgacagataagttccctcatctctttgttcctcaatttcctcttctgtaaaatggtaataataatacaatgaacctcatcgggctattgtgagataaatataaaccgctgatatcttcagaactgatccaggccaatgttatgttgaatccttaagaaggatttgagaaggtggccctgaggaagcacagacacacgctcttgccccattgtctgtaactgcccagtgtcgggcagaccccggtggacctccccggttgctggggctggggcctccatactcagctgtaaatgaccaggtgacaatgagagtggactctcagtgggcctcaccacaggagcctctgtcatatggggctgaatcattgtcctgtatctggagattgtgaaggtctgtccagggcatcttttgaggaactgtatctatttcagctacctctttagttttctatttctctttttctctccccttcttcttaatattttctgatgagagactcggcaggtgaatatgtgcacgtggacattaatcagaggcacttgtcattctgaagaggcctcaagagccgaacagggttattaataagaatcctctaaaccaagagaacatggagcatgttgaatttatccaatttccacaacgttctagtttattcctatgttgttgtaaggacaaagtagtagattcagattcttttttttcctttagacagagtctcactctgttgcccaggatggagtgcagtggcgcgatctcggctcactgcaagctccgcccgggttcacgccattctcctgccttagcctcctgagtagctgggactacaggtgcctaccaccacgcccggcttaattttttttttgtatttttagtagagacgggggtagattcagattttaatactgctcattttaaacgtgtttgtgtgtcaattttttttttttttttttttttttttttttttttttttttttttgaggccgagtctggctatattgcccaggctggaatgcaatggcgcgatctcgatctcggcccactgcaacctctgcctcccgggttcgagcaattctcctgcctcagcctcccgagtagctgggattataggccctcgccactgcgcctggctaatttttgtatttctagtagagagcgggtttcaccaagttggctaggctggtctggaactcctgacctcaagagacccgcccacctcggcctcccaaagtgctgggattacaggcgtgaaccgctgcacccagccatgaatttttttttttttttttacactagattgtgttgtttcctgagcacacaggagaaaggtggagacctttgagacgtgtatatcaggctcatgaccttcgagggacacatgtatcctgcctgcaaccttcgaggcacacgtgtattgtggctgtgacctggaattacactgccttacttcaaatcctgacactgtcacttattagccaaatttactcaagcaactgcttaactgtatatgccccagtttccgtagcttaaaatggggataatgtgtttccttattcataagtgtcttatatatttagtatgattatgtatataaagtgccggaattacactgccttgcttcaaatcctgacactgtcacttattagccatatttactcaagcaactgcttaactgtatatgccccagtttccttagcttaaaatgggaataatgtgtttccttattcataagagtgtcttatatatttagtatgattatgtatataaagtgctgagccataattcttcaataaatattagttataattatttttgaaatgtgataaacctcaattggactcctgctttggctatgtaaccagttggacctttgctaaacctcaattttttttatctagaaaataaaatgggaaacacagtatctaatagagagttataaaagaattatacattatttctatcactctggagacacagtccctaaaagtacttggtagaccctttcctatcctcccagcttcttttcttggcaacgttttattttttttcagagaatctcagttcttccctgtaagggatataggctccaactttgtttcctggagaggactcaggtagtggtgtattgagtgctggtgccaagtactttgtgggcagtttcttattattattcctcacttaatatcaaccccattttgctgaggaagccacagctgagagttaagagccacatctcgcctgctctctcaagtggcagcaacatcattcaatgtgtttgtctgactgtcgagcctgtgtctaaccactgagtcgttcgtcctccatcagatcaaacctgggaaaggcgtgacagtgagcatcctcactgccggaactaatggcacggaatcaaggacatatctctctctctttccctcatcttttttaaccgaaaggaaatttacggagcatatggtaactcgttttcctccacagctctactatccagaccacgagtcagaaaattaaccttttaacttaatctacatgttgtgcattgagtctcacgcctgttttcatctgcctaaatggggagttccacgcagcgtgatgggtgtcctctctgtgctcacattgccggggacagatgatttgcagctgctctgtcctgaggccattgtgaacactgaggtccctgacaggttggtctagtctgcatcgtcaatttttatcacattcttttatgaaatagaaatttctatcatgggcatgtaatttggtgagcattgcaaatagtaaactctttcaaaaggctataaaattacatatttatagatttataaaaattgcctctttttttctctctccagcactccttccaggtaaataagacaataggatacttttgagaacttaggagttataaaaatataattgttacttggaaaacttcattttaaatctctgaattgggaaacacataccttaagtatgagcatgtccattttaattcatgagcagtagccgtgccgtagccatcacatcaagcttttgggtgctaataagcatcaattgtgtggcaactaatccagctggtgtttagtaatgtaaatggagacgtgagatgtttttatatgttgtatcttcccaggttaagtcaagccgttaaagcatatttgcaccttatgtagatgattaagcatttggtaaattctgaaaggtcactaagtacaatgtacttccttgtcttccccaatttgccttttcatttgacataggctttgttaggaaattacagccgcttttcccaggtgacattcatccccatgtaacactgattgtaagtctaactaggtgggttctaatgacttctactaagatgtaacatggaccaaccactgcctacatcctcattctcattctcatttcagcaaaaagtcctgaaaagataggcaaacactggaggaaccatagagacgtgtcatttaccactttccctcttgactgtatataggtgattatgctttctcaagtttcacttgttctttcttttaccccgaagcctagcattaaagggtgctcaggcagtacctgatgggttggatactggtgctaagaagtggagttagcatccggcaggagaggaggcagcacacggacgtggctggacatctttgctctggagttttctcttggcatctgacttctgctccgctacttcatgaactttgcattgccctctgcaagtccagcatgatttgggtgcctcagttttctccattggaatatatgtcatttttttcctctccttcagaacgtttctcaccacaaggcattttatatatatatttgttttgctttgtttgtttctttccactcccctctttttccatcaatttaacaaaaggggtttgaatttatcccagcacctaggacataccaggtgctcaaaaaatattctactgagggccgggcacggtggctcatgcctgtaatcccagcactttgggaggctgtcatttgagttcaggagtttgagaccagcctgaccaacatgatgaaaccttgtctctcttaaaaatgcaaaaaatattagccaggcatggtggcacacgtctgtaatctcagctacccagaaggctgaagcaggagaatttctggaacctcagagatggaggttgcagtgagccgggatcacaccactgcactccagcctgggtgacagagggaggctctgtctcaaaaaaagttactaaaaaatattctggccaggcacggtggctcatgcttgtaatctcaacaatttgggaggccgacatgggcagatcacctgaggttgggagttcaagaccagcctgaccaacatggagaaaccccatctctactaaaaatacaaaattagctgggcgtggtggcacatgcttgtaatcccagctactcgggaggctgaggcaggagaattgcttgaacttgggaggcggaggttgtggtgagccgagatcgtgccattgcactccagcctgggcaacaagagggaaactgcgtctcaaaaaaaaaaaattattgactaaatatattagttagccaattaaaaatagcccctacttcttagcgttgttgggggtatcaaaggaattaatgaaagtgcacatagagagccccagtaactacttgctattcttattacccaactgatcgccagtgttctcttttgtaagtgaggaaggtatattggaagtactggggttttcaaatgctgcataaggacagacagtttaaaaaaatcttttggctgggcgtggtggctcacacctgtaatcccagcactttgggaggccgacgcaggcggatcacctgaggtcaggaattcgagaccaattcgagaccagcctggcgaacatggtgaaaccccgtcaaaaattaggtggatggtggcacgcacctgtaatcccagctactcatgaggctgaggcaaaagaatcacttgaacctgggaggcagaggttgggttgcagtgagccgagattgcaccactgcactccagcctgggcaactgagggagactccgtctcaaaaaaataataataataataataataataataataataataataggattttatttttattgttgcctttgatttatggcaagttgcttttgacatatcaagaacataattgaactctcagaaggtaaaactcataaaaatgaagcataagtaaatgaagtgtgggaaaccttgtttgaaacacattttggggtgagagtgggaatttattaggtaagccagttcggtttcagagacaccagtttcacttagtgttcaaatccctgtaataatgagtggtgtcgtgtcaagaatctgttaccgtatatcatttataggttggtcattgaacaggtgtttttagctaagttttgattaattgtgcctttatgcactggaccaatcctacagcttaacttcgtctttgtcacttccctgtgcagttctcaaagaattcaaacgtgtgatattgacaatccaagactctttttccaagcctcattttccttgataccctatctgatggctggaaattctgctttctcttgggtttcttcatgcaccttccccgttcttcaacgatgaatgtagcattatctgtaacactgggcctcaaatttatctggtgcctcacatgtatgggcataactggcaatgtctatatcaagggaaaatggtgagaattaaatgagaatgcatatttgaagtgcctggcctagtcccaggcagtgctcagtaaatgctagttcccttttgctctgtatttccggcctattttgggttttttgtttatttgtttttttgtttgtttgtttttaatttattgagatggagtcttgctctgtcacccaggctggaatgcagtggcacaatcttggctcactgcaacgtctgccacctgggttcaagcgattctcatgcctcagcctcccgagtagctgggactacaggcgtgtgccatcatgcccacctaatttttttctatttttggtagagactgggctttgccatgttggccaggctggtctcaaactcttgatcttaggtgatctgcctgcctcagcctcccaaaacgctgagattataggtgtgagtcattgctcctggctttgtttgtttgttttgtttttttaattccatattctccaattacctctgacatatggtatttacaaggttcttccttaaactttttctgaatctacagttcatgaactcctgtgacacttacgcttttggcagatattttccaaatctctgcctctagtagtgctgacctccagacctgtctctccaattgcttcctgaacatctcaactcaaacatatcatgacccactagctgacctcatgcccttccttttgaaactgacatgtcttcctgtcttccctattttggctatagcatctctactgtctctggcatttggtctgggaaacttaagtccagtttcaattctactttttaaaatatcctgtaacatctaaatggaaatgagatcctcccgttgcactggtcttagatagagctttcttcctttccttactcaagggcaggtttggaatgaagttggattctagaagttaggccaagcaataattagttcattgacattcacaacagtaggtaatagagtccgagggttgagaatagggaagaattcttacaagaattatccttgggttaacactatatggtccaagccttgttgtgtatgaaataatcagaatttcataatttctgtttcttcaaaaagtagttttaaatgttgttttctaaaaagcgtcaaagggggcgcaatataacaaaacataagttatagccaatttcaaatgcatgcagatcctaccatggttaacaaaatgcaaatatattttaaagacttattgaatgtgtagtagccttttgtcattctatactttttctaaaaattcatgctaaaagtgcaactggcagaggagtttcatgaaactcttacgatgttaccttatgaaatatgaatttcaagaatgattgatgattttcatttgttcagcgtcaccagctcatagaaaacaaaatcagagattacatgaattttcaaaaataggatgtgggggaagagaaagtaaaattgaaagtctctaaacacttggctactcagtttaaaacttctgcttcctaaagatacatctattatatttaagataagataataggcactgtctgtgtttctctctctctctctctcccccctcttgctctctctctctctctctgtgtgtgtgtgtgtgtgtgtgtgtgtgtgtgtgtgtggttagaggaaataagtcttacactctgggtctaccagttgcctactggataataaagtaaataaatatatgttcaaagacacatatatgtgtttgtatacagaagtgctgtgtatacagaaaacatttgaattctgattccccagtgtagcaatgcttgatagaaaaggtactggctgattttaggctgtgaagagaagataaaatttcattatttgtaggtgatgggaagtgtttaaagaacaatccaagtgagaacaactggtactctgtctggtttgattgaagtgcaggatgtttgagggacaaattggggctggctatgagaggctttgagcttctctgttcttctggttgaatcctgtggtatatacagtggggatcattgagagattttcaatacaggaatgacatgatcagcatgaacatcatactttttaaaaattacacaaaatgggtgtttaaaagttaattttaaattttgataatggtcagtaaacgaaatgggagaggaagcaaaagagaaaagaagagacaccgagaaactacagaggaaataaagaggtctcagtccagagggagagaaagggcgaggctaggactctaggttgcattggaggtaaactgcttttgtttatttgggctgtgagtatagaatgcttctttgccttgcatttgaaaggctgatttggttattctaccactatgtacaggcctttttaatgttctttgtttctaaaccctgagtagctcccttgctaggggatagtaacttgtagggctgactttgagtggcagaggcagaaacattaatatcatccatgagcagagtctcccaggtagcatgtccttacattaggttggttgttgcaaaggtaattgcggtttttgccattgaaagtaatggcaaagatcgcaatgacttttgtaccaacctaataactggagcagaggaaaagaagttctgttggattcgtctgaagagctgaaggaaaggaactgggttttctcactgttaattgcccctttctcatctcaacctggctcctttcctcagattcttgctttggaatcaccatctgttttccactccacagagctttgggaggaatgtcagctctgttgtctccgacttaaggtccaaatgccccttttcagaaactgtccatcatttaaagttcgacgagaaaacttggacttgctttgtggccataagaccctatattttcagatttcctatagacgatgttttgttatatcctgctttaaaaaaaaagtgtttaaaactacatttatagccaccctagctgttgcactgcactgttttttggttaaaacatgcacctgctttgttagtaaaggaacctttgccaagtgaattgtatgtgggagggtgtgactaactctgcaaagggacttatctcttatcctatctgcctgagctcccaaggctgcctttgataagatttatttcttcttgcaccagccccacccctccaacctttactgctatctttcctctgaaaattattcatatctaaatattttaacttttcaaaactactctgctctctggtttcatattttgttgagtgatctaacccttcctctgggagacaagtgctcccaagcaagagagcattacaattctgcctcccctgctcctcccaccttttaagtattatcagcagacctgcttgcttacccgtgttaggattgtgctgtttcctttttggcaagcttcagccaagcccataatgttgcaaggctgtttgaagggaaatgtaagtcacaatggcaagaaacatagaaacagaaaacataggaacagaaaaagaaaagtaaatctgaaatgatcttcgtacagcttggttcacagcaaggagtggtctgagttgctttctgtgtctagacatttagatgctaaaggcaactgtgtcatcattcattcattcattcgtatacttagtctacatatttgtggtgagtagccatcgttacaggttacaggttaccaaatgttagagatgtaatagtaaacaggatgggcgtatttgcagctgctatggatctgagagtgtgttctgcaaagggtgatagacatgaaacctcaaaacacacagttcatgactggattacagttgtgcagcaggagcgggtaaagagcggggtctagggaagagagatttcctaacctagactacaggcatcaggagaggattcttgtttcttacaagctggaggtgaggaccattttgcattggaggataaggactgagctcttaaccacagaagccatggagtggggagggggaagcatgaacagtttcagatctgaataaatccactcaatttctcagttttcctgaaaaccagctacctattttctgcctcccaattagatgaaattctgttctgggaggaaacaggaaagtaaagacctcagttgtaaaacaacactgcgctgcccacaccagcagctacctaatgtcaacctgaaacctcataactcacttacttcaatggctgttgacaaactcttgtcagctgcacccttagttccggtttgaatcacgctcaggaagctggcccctcggctggcttcctcaagttagtgggtgctgtcatgcagctgctatcaaggtgtggcccacttgcaagtggtcaggacccagggcctggtggccaagcctcatcaaagctgttgtgatagcacatgcgggtggcattcttgagctgggaagtggtgtcccagtctgcttaagtagatgcagacatgactcatttggaaggatacagccaaggggaaaatcaaaatttgctttgtatgtcacttgtttggaatcttaagtccacttaaaaaaaaaaaatgccctgcaactgtgaggaagagcagagttagtcctttatgtcacttacttggaactctcgactcccggctcgccctcctccaccctggtccaggtggccatgccctctctgctggatctcaagggcctccttacaggtcccctgcttctaatcatacttcctgtcatccacgttctaccagcagccaaatgaatcttttgacaatttgtatcaaatcatattgccagactgagaataaaaactaaactcctcactgagttaagggcctgtgggctcaggatgaccactctgatctcaatcttggcatgcctcttgcaacatttcctagcatcagtaatcttctgtctgtctaatacatgcctactgtaggccttctgcaactttctcttcttcctggcatgctttcccatgtaatgttcacaattgctggccctttattaattgagatcccctatgaaccaccttcccagccccatcctcagtctctcatattaccaggtttattctcctgtacagttctatccctgccagtagaatatgtgctctgtggaaacacaggccgtgccagtcatcccttccctatgtcaggcacacgtaggagcgctcagcaatacatgtggatgaatgaaccttcacaccatagagcaaagacatttgtttccctcttttttctgatctgatttttaataagtgacaaaaagagcacaggagtgcttgggaatctctgctaagacaggtaagagaaatttcaataaacagtttggaggggtggatttatttggggaaaaaaaaggaccttgctcacagtcctagggctgagaaagtgttggagctcagttcctgagctccataaatgagtctgcaccagtcctggaaggaaagataaacgtgctggactaatgtgctcaatggcatttgaactgaattgtaagtgactttggggtttatcagagcatcctaggttatttgagaatcactgaatctaggtcgggcatggtggctcacccctgtgatcccagcactttgggccgaggcgggccgatcacctgaggtcaggagttcaagaccagcctgaccaacatggtaaaaccccatttctactaaaaatacaaatattaaccaggggtcgcggcggacgcctctaatcccagctacttgggaggcagaggcaagagaatcacttgaacctgagaggcggaggttgcagtgagccgagatcgtgcctctgcactccagcctacaggacagagcaagactgcgtctcaaaaaaaaaaaaaaaaaaaatcattgaatctatcagatcatgggaaccgtatagacttggaatttttgaggattaaaaagagatattttaaattatttagtctggtactcttagaggaaactgacccctagaaaccttaaattgttaaatgttaggaatggaatccaggtccccttttcacagagcctggcctcttctcagtcattgtatttcagccattcacttcctccacttctacatagcagggaacggattcctggttgtgtttttgacaggagaaatgtaaccttaacacagccttgaggaaaacatgaaggtgatcatccatctgccaaaatttttaatgctatgttttgtttttctttcttttcctgggggaaggatttatgacttcatctttttttttttttttcccttcaaatctgagcctctttagaaatgatcctgcctcaaggctagggggaaaaaatcctattttaaaaaataaaatgtagatcttcttatggtctgctttccagacacaaaagagatctatgtcttttattattattatttttgagacagggtcttgctccgttgcccaggctgagtgcagtggcacaatcacggctcactgaggccttgacctcctgggctcaaaggatcctcccacctcagcctccccagtagctgggactacaggtgcatgccactatgcccagctaatttttaaaaacttctcgtagagacagagtctcactatgttgcccaggctggtctcaaactgctggatgtaagcagtgttcctgtcttagcctcccaaagtgctgggattacaggcatggtaagccacccaccgtgtgtgatgtggccaggatctaattttgattgttgattaagagtactttttaagtaattttcaactgttttgtgatatatgaaaaagaagactaattaataatgagatatcaaataatgtttcttaaattgaggtagcttggctggccgtggtggctcatgcctgtaattccagctctttgggaggtcgaggtgggaagatcacctgaggttgggagttcgagaccagcctgaccaacatggagaaaccccgtctctactaaaaatacaaaattagccatgcatggtggcgcatgcctgtagtcccagctacttgggaggctgagggaggagaatcgcttgaacccaggaggcagaggttgcagtgagccaagatcgtgccattgtactccagcctggccaacaagagcaaaacttcgtctcaaacaaacaaacaaaaattgaggtagcatcttgtaaatagaatcctagaaaaggttttcaacttcccatgccttttatagtcatttttgaatgttggtctagagatctgcttgggatgagtaagatttttttgtacatctgagataaatttaggttgttagtgacatgctgttcttttgtatttgataataagcctgatctgtttctcttgctttctttaaatgggtcagttctggcttccagctcatccatgttttacaaagaacagttgttccactttttcttctctcatgaccaaacactttgggagcatgtcaacatcatggtcttgtttttattatgattaatatcaatttttcacccatcgtttgtgtttaatatttgggatgagaaacggacaaacaaatgagcagattctgacttggtatttctcctgcatgccatttgtgatttataatttatacatggaaggatttactgacctacctgatagtccctcccaacaaagataaacacacttacacgtcatcagggtaagtaagatgcacttgaaagggacaaataattcacctgcaagcacttttggcttcatgccttttcccatgaatttgaactgttgacagagaatgctcaggctgccaaaacacttcccacagaacctcccaaaatccccgaggttgggaccagctccacttgccatgctgtgagaaggactaaacactaaccttttgtgccctacaagagtgcatcacacgaaagcaagaaaatggtccacttcctttgggattcaggtctggggatgtgctgctctcctctgttcccttttgtggatgtggtcctatgaaaggctcacctgtaaggctggacaaactgccaagtcgtccttgtcaaactgggtgcagaggaccttccactgtcacactgtgtatttcggctgccgattcaaaccgatttcttgggacaatgacccatcaagctgaagagttcaaaatgcattaagtagattttcaaaccccctccccccggcttacaggagtataactgagtccgtgggaaagggtgggttgttgccagcacccttttgtacttttaagaggaagatcatcgtctgttatcccaagcttttggggctctcatctttgctaccatccctgggacttctctgtactgtaccaaaaacagacagtgcaaattctccataaatttcacttagtctagactaggtctcttcagggagctccttgagaatttttattttgtgctcctcagacataagcaatgttgaaagagtcaaacacatatgatattaaatgctggcagaaagttgtgtaaaatcattagtccactacatgcaataccaaaaatagatgtttaacctgatcgtatctgttaaatataaaacactttttaaaaatcttgtgtgctcaaaaactttcagaaaatttttaatatatacactcattttttttaaaggtgacccatcagaggagccaggattaaaaacctcagcagagaatcgtaatacgttgctaataactgtagcattggggaattcagtcttttaaaggttctgcttcttgtgtgtgtgattctcaggccccatcaacataacaaaaaagaagaggtgcactgagcacttattactgcagtcatttcagctgcataaatcatgattcctgacaactcaggctgtaaagtcgtttggatgacaatgactagcaatgctgctgccggagttaatcaaataattatttaacatgtgtttctcttggtctggccctggcttcagaacatatttcattcgttcccaggcctctgtagtgcctttacttttaaataaatggaggagctgagcaagtgtaagatatgcataaagttaatgacagaatcacttatgtctcctattggactgtgctctccctcaaaagaggattcttgtctaaattagtttgggtgatacccacagtacccacctcagtgttttgttccaggctagcagtcactattattttagcttcttctgggtgaagccagcttcctggttaaactctttttctccaggtgatactcagggggcaccttttctttcgggtggtttttctattccattacctctgcaagcagacagcctgggttaggtgcatgggtgaggtccccaggaaagtctcaaagcacctctgccagagatcactccttaaaatgtgagaggaagcagtggtctgcttccttcctgaagggaacagcctcatattcccagccttttagctcttagtatgtgctcaataaatagttgctctcattattgccattactgttattatgtaaaggcttaataaatgtttgctaaaacataaatggcccaatgaatgaataaatgcacatacctaataagggatgaaatttctacataatgacgctaatctgcatagacccgtgtattaaattcagacgggctagtgtgaggagaggaagaagaaaagaacagctgcttcctttattcagtgccctgacctgttatctgtaatcaggggatgtataatgagccactcatctttatgtaccccaaatatcaaagggtgaagaaaacaatagcaactcatcaaaaagcttgatcctctgtgaaatgtcctgggcaatcaagttaggtgttagtgtctcctgatttgcatttcatggctgcgatgtgctagcggtggtgaggattgatagtttatatggcagcacttatttaaatctttcaaaagtattttcagatattttcagtaattttaattcaaattaatggcaggggttttcttacaaaatatgattacttactttctacatttagttcatctaaaatatacgcttttcttgattttttcttacatggtggtcattttaatttttagcatccatttgtttctattcctaatataaacttcagcatattaggcaaacaagtttacttggcttttgtgacttaaaaatattattatagagtcattcaattaagttctgcttaatctacttgaatttatatctccaatagaattaatttattgaaaatcaaattaatatttctttaatctcaaaatttactaaagtcataatcatttttatttcaggcatgaggggaaaaaaaggaaaataccctaaaaatttgtagagccctaggtattagtttgtttccttcagctgttttataaggcaatattgaaaaccatattttgtttttcagatagcaaattttcagtgctctaatggaagaattagaacaaaggttagaataagaataagggatctttaaggaaataacatgttttttaaaaaaggaattattgtgattataggttgctgtactgccttctatttttaaattgtcatctcttatcaaattgaaataacatatttgtttgtttctaacaatgctctattgtgattaatcaaaaattcctattagcaacttcagccaaattaaatttaaaggagcttaattgagcaatgaatgatatgtgaattggcagcccccagaatcacagcagattcagacagactcccgcagacatgtggtggaagaagatttatagacaaaaaagggaagtgacatacagaaatcggaagtgaggtacagaaatcggaagtgaggtacagaaatcggaagtgaggtacagaaacagctggattggttacaggttggtgtttgccttatttgaacacagtttgaacagttagcagtgtatgagaggttgaagcatggctgccgggattggccaagactcagccattgttataggtgcatactcctaaattagattgtcaattttgtctacctactaagttaggttacagttctcccacaaggactcaaatatagaagtacagagtcgttctgaggccgtttttagttcactttaacagggaaaactgcaatgatcaaactaagtaaaagtttctaagagtatttttatcaaacctggcagcaacatctacactttaaaacagaatgcattatgtttttttccaaaaatacagaagcctatcacttgtcttaccagttacttccatggaaatttggtggcctcattgcttttgtatggagccctgatgagagagaaccccaggattatcaactagagattggagctagcaatctttattcccattccctttatacatatatgaagcagagctgtttttaagtagagtttatgacagtggaagttactcttcagagaagtaaattagagagtttagttgaatgtgtttagtttacttactttggaacttttactgtttaagcttactccttccaaactcaccaaagagaaatagctcctcaaataatcagatgatctgttctaaaggcaagaagggaaaataataagtcatctcccccactgcattctttttgtttgtgtttaatattttttatagagttaatttagatttagcaggctttatgtaaagtttcttctggaagatttagtgaatcttttgtgaaaaccatcttcatctgacattttagaattactcacctatttatgggattatactgcattctgttcttgaaagagcaaatccattttcagcatagtttttttctgtcactttttttcgttgtctgtttttctgaaaactacctccaaggtaagaggggaaaaatgggaggagatggaacgtagaaaataggatagaactgtgtcttgccagaggagatgatctgaattagaaactattggttgaaggaagaaacctccaaagccaatacaataatttatttaactttaggaatggtgtttaaattgtctaaataaaaataaatttttacatacttccaatcttgtctatagttactaaactgcagatgctatgagttagacttcaatcttgggttttctaccccatgttaataacagaagaaataaaaacaataatgaagaagttatcccatagtgttttagaaattatatccaatcttattttaaaacaaaacaaaaaacttgaagttttatgaaaatccattggtcatttccatcttcccctcttgcagccatgcactgtgctataggaataatgagttactcttagtgagtagcttatacacagaacacactgtcttttatcctcctgtgtattatctcatttcatcatcatttcagccctacagatgaaaaaattgaagttcagagtagttacatagtttgttcaagttcacacatctaataaggggcagagctaaaaaccaagttcaggcctttcccgttatgtctcccactgcccttgctatcaattattctgcagggcaaaaagagaccaccagacagtgaatatgaatgtcagacagaaaatcacctttgatttgtttgtagtttattttttgcttttgtcattctttacttacattcttgctgttgttgtctgtgaaacatctctgtcctaaatattttaacctttctaaatggatgtctggtatattcctttatacacttgattaaggtaaccaaaattaaatatttcaattttatttcaacatttacatatctactatctcccctacagccattttaaaataatattctaaagcaaccaaagaccaggattaggtcagagccaagcaactcagtacatcttttctgaattctcagaggtttactagagaaagtagaactttgtatgaatgaaataaacttgaatttctggtgatgcaatcatgttttggagtttagtctcctcagagtgcacaaaaaaatctcgaaataactaagtttaagtttttagtaattgttgttgttgtggttttttgaggcagagttttgctcttgttgcccaggctggagtgcaatggcacgatctcggctcactgcaacctccgcctcccgggttcaagtgattctcctacctcagcctcctgaatagctgggattacaggcaggggccaccacgcctggctaattttgtatttttagtaaagacaggttttctccatgttggtcaggctggtctcaaactcctgacctaaggtaatcagtccacctaggcctcccaaagtggtgggattacaggtgtgagccactgggcccagccttaattctttagtaatttttaacaacaatcaggttgtactattctgattttactatccagaaaacagaagagtatcaaataaacaaatacttgaaataaaataagtaagaattaactgtgttatttaatacttgtgaaacagtatcaaaaaacaacaatgatcagttcacaatattgatgtgagaggataactacttacttgagacagtattagtttggtaagtttcctttgaatttcatggtgtaatttttagcataacagagttctgtgtgagagcttcatctcttttcctttctctttggcagctacccatttctataaggatatttcactccaggctctgtcccataatttggggggcaatacagggcacattcatactggtttgagaaataatttaaattttatatttcaaacatgtcagatttcttttctttcttactctttttttttttttttcctgttttgagacagagtctcactctgttgcccaggctggagtgcagtggcatgatcttggctccctgcaacctcagtctcccgggttcaagtgattctcctgcctcagcctccagaatagctggaactacaggcatgcacaatgcctcctggctaatttttgtatttttcagcagagacagggttcaccatgttggagaggctggtctcaagcttctgacctcaggtgatcagtctgccttgacctcccaaagtgctgggattacaggcgtgagccaccacgcccggcctcaaacatgtcagatttctggcatgccctctccccactccaaaatgaattccaaaaccaattattcttctcctgataatgatttgtccctttagcatccgggtattagagaaaggatgaggtggtttgaacctatttaagatgaactgcattgttaagagtttacttagacacgggtctatttacagttaagcagtggttctcaaaacatgtccctggaccagcaatgttgtcatcgggtccagggacacattttgcctgggagtatataagaaatgcaaattctcaggactcaccagaccatcataaactaggagtgaggaccagcaattggtcttttaacaagtcctttgttaaggtcattctgatacatgctagactctgagaagaaagattagaaactactgatcttccaagattagaagcttctgagatgagaagtttggtattcttgctgaatttggattcaggtaatctccagtttaaaaacttttttttagttagctaatgtccagactagagcttaggccgcacctgagagacctgttacatctttcaaagctcttgaacactttctgttgtctctgtctttatctcagtcttgggattgagagtaaacccttttcacaggcaaaagattaaggcattatttctctacatcagtcatcaacacaaagcatttcaattgctattgtagttgtttcatgaacttagtggctcagaaattaaaaaaaaaaatcagtatcattctttcatttcatagacaaaaacagtttaagcccaggatcctcagggaagaaaaaccctaaaacaatgtaaatgtaaaattaatcataatatataattgcagaaatttgaactgattcaaagaaattgtccccacaatggtataggaatagcttccaaatcaggccataccatttaatcaaaaaaagaaaatcaattgaaaagtggttttacttataatgatactgagtaaaatcagcttttccagtaagacagttgatgaaaagtttactcatttgcagcgatgacaagaacatgcactttattatgctttgtcattcaaaacttggggaggcactgcagagtaacagacgaaccatggagtagaggctcaatcctagtatgctccagaaaggacccgtggacaagttattcatctcaaaaatgaacatgtcctacaagatcactggttggcaaagtatgacccatgggcaaaatctggcctgccaccagtttttatatgatctgacagctaagaatgttttttaatagatgacatttggaattgaattggtaataatgaacattttccttgaaaccaaattaagtgaaatgttctctctccaacaaagaattccattcccctcactaataactctatattgcaaaaaagtacttaatgatttactattatattttgaattctatcactaaaaaaataattgtaaaaatttgttttctatcttattacataaataccttcatcatatccttggtcttcctcttggcctctggctctttacagaaatgtttgcccattcctggatgagatgattttgaaggtcccttcaacaatctaatttttaactatgctcaacagatagcagtcaaaccacttgtagaatgcaggtgatttggacaatatggatttgccagcgtttggctgttcatgaatggaagagagtcagatgggtccaataacagttccaattgtccatcttcaccctgcatgtttgaaaagagaaagcagagatctatagcgtattagtttaagccatattgtctgtgttagaaaatccaccctgccttgggcaaacccttaacctttgtgccttaatattccatctgtactgtggggaattaattggttaatgttcacaccttccccaaagatggctggggcttgcacatattcacaaaaacttcaaaagctgtaatgctttttgacagatattttttctttcccatcattttttcttatattattaacataagaaatagtttaacaaatgaaaaatttattgaagaactaatttaataatggccattaagagactttgatatttctaacatagatgcctaagcatactggatatattatgtatccagtgcacaaaaggcagagttcccatggaaactttttggtcatgtgtgcctagtatcatgcccacaagatagggttggagagacctataagcctctctttgccaaatattgtatggagaccagcgtgcataaagggttcagattctccttagaatcagtgttggaatttctagaccctcaagcgactctatattaaggtgcaaatttgttacctgggaaggtaatttttaaccccccattaatgtccatttgttagtactttagcccaaattaggtttttaaaattacctagctggttgagagcagttcttcaggaagtgtatcagattcttctaagtaggttcagggtaagttttgaaaacaggtccttgggggattgtgatacatcctccttcactttcagcaccctgcgtttgcaagagtagcatgtgtgtgcacacggcagcacacacgcaatacttaatactctagcttctagagcagcattgtctgatagagatataatgcaagccacatagataattttaagtgtttcagtagccacattgaaaaataaattttagcccaggtgtgatggctcattcctgtaatcctggcactttgggaggccgaggcgggcggatcacgaggtcaggagttcaaaaccagcctgactaacatggtgaaactccatctctactaaaaatataaaaattagccgggcgtagtggcaggcgcctgtaatcccagctactcaggaggttgaggcaggggaatcgcttgaacccagaaggcggaggttgcagtgagctgaggccacaccattgcactccaacctgagcaacaagagcaaaactcttgtctcaaaaaaataaataaataaataaattttaaaggtgaaattaaatttaataatttaagtatacattcaaaacattattgctttcaacatgtaatccatatacaaattattagtgatgttttacttttgggatactaagtgtttggtatctggtgtatattttatactcacagccagtattcattgaccggccatatctcaagtgctcagtaaccacatggggtgagcagttattttaatggacagtgtagctctgagggaccttgaactggaaagtgggtcacagagagcaaagtgtggctgcctttgtggctgataaaggcagcaagaggatgggctgggggaacaaatagaagttgggaccagcccagatccttacccctccattatacccaagtcatatttttgctgaaggtcagacctaactctaggtaacttaacctttttcactaaaaacttttagaaaaacataagcactggagttaaatgcttggccttaccacttaactgtatgaccctggacaagttactgaaaaccctgtttcttcatctgcaaagtgggaacagtgataatgcctcaagctcacagaattattgtgacaattaaatgatcaatgagcatataaacaatgaatactcaatgaatacttgatatttattttcacaattgctattattagctactcttaggcactaatttagttttaaaatgaactataaagacaatcagatactatcaattattctacatttcttaaaaagcagaaaaatgacatagccatatatatatatatatatatatataaaattttcaaatagtaggtgtaatcagctcattaaattgggcattatactgtcacgtacacacatcaatgcatcaaaaatccagaagatactacgttaccaagactatcttaaaattcgactttgttatggtagtgggtgagccaatgaaagaagagttggttcttctttttcctcctcctccttctcctcctccatctttttttattcaaagccagcagaaagagataattaaagcaaagctaaaggaattgaatgcaaagtttgcatcatacgtgtgaactaatcttttctccatggcatatctagaagatcaagtaagacacccattcagatggttcattaactagtgaaacttcggtggaaatagggcaggaggaagtagtttcttgctcacaaagtcattagtattcaaaaatacagcatagcagttctcacctaaaatagaaggataaaaaatactaacagtcaatgcttgttatgccaagtacatctttcacaggggttttgtttagaataaaagagatagtgaaagttttcagatgctagtaagtagtgaataaatgcagaatgtacttacacatttatgtaccaaatgctggaaggctgtgcaccacatagagcaaagaaatgtactaaaccatcaatttactaggtcattttaaatgtaggcagcaaaatggctatgtgcgtgaaaagccactactatattttgagagagcctttctaagaatcctgaaatattaataacatggtcttaatgtagttggagacaaaagaaggtgttaagggtagcaaggctgccgagaatagcacaatgacaattttgtattttctgcctgtgttttataaaagcaaaaggaaaagagtgtctgtttaaagaacagcagccttcaattttccaaactggtataaaattggtatttcccaaatgaattcacatatatttattcctggtgacatattaataccagcttcgaggaaaaataggaaaaaatgtaaacttgcaaatgcacttttttcttaaattcacataatatataaaacaggtttttgcactgtaagaaatttaatgaaattgaaggcaacattttccattttgatttttgcaaaagatgagtttaattttttagctggaagtagtcttatcagaatagcttttcaaatatgccatttggactttgtgatgatcagtcactggacagtttcttgtccttgtcgatcttccactcccactgtgagtttttcgtttttgatgcttgttgaaattgaggggtgcatgagaatcagtcagtaatatgcagttttctgcaaacattcagatgtgaaaaaaatgaaagcattttgtgccttctttgcagtcctgagttgccacaagttgcttttgtcgactgcgactgactgagtgacaggcgggacccagtgggtttgtgttcctgttcagaggctcattgtgtttgatgtgagaaagctgggcttgacccccagtccttcttcctgctaaagtcagggtttctgattttaatcaaaaccctagggccatcttaagcatgaccaaaaaagcaccttgcaagttgaaccttatctaattatgcaatgtgtataaacttgagacacataaatctcagtcattggagcaacttgtttttctaagatgctccggtccagtgaaagacgaaagcaaataagggagagattgatctcccagcacttttattgtcagtgctccacacgtcataaagttttggcttgttaaaggaaattccataaacaacttcagttagtaagagtgaagtaactgtgtgccttcctgagcccctgctaaattccctttccgcttgccattacaagagtatgattaagaaaatgccaacaggatatgcgagtgggtggaacagacttcagctggaagccatacagatgcttgatggatgagtagtgacagtgagatgatggccctatctccagagagaatcaagcagtttcatggatctctttctagtactcatttcagtaagatctgctgcgttgctgcatggttgttccgttttggctgccaggctgatggaaaatggctgataggtccttctccccactgctgtttctgatagtatagacaagtcctaaggacatgatgaatgaaaagaaacgagagtgaatcatgctggaaagattgtgggttactggcacattttctttgaacctctggtgttatgaaataactttactcttaatggccttgtctctgtgggtttaatgctgatggtgttggtcaatttttatctggggttgagacagatttgagaggcgatcatgaaaggccatgggggaaggaaaaagagtggggagcaagtagtcattattttttattatgagttttcccagaattagtgagtttttccacactactaaaagtggtccttagtgtcagtatgatgacagtgtcagtgtgatgtttatgaagatgaagtcatggaaaggatgtcaggtgtataaaaaactatatggcccgtgttctctacaccaggctctcgggaggtgtgtgcattgcaggggaagggtgctggaaaaatggaaagagggaaaaacaggagggttttatgaacttgaaaatagacacaaaatattcgctgatcaaaaaacaaatcttagcatactatattccaaaatctccagttgatagtttttgttatttcaccctgaaactgtgacccgtgccttacaagctcgtcttttttacttgcttgcctttgttgatctttcgatttggttctttctgtagttgtaattgggaaataatcaccacccggtttttttgtcagcacttggatacacttcccactggttggctaaaggctacactctgaaattccatagcatgtgactaagcatacaggctttgagggcagaacacttggggtcaaagctgggtgctgacacttagcagatgtatggtcttgtgccctcaattaactgctcaaagctgaaattcctcacttctaaggtagagataatgcctgtcgaaaaggggtgctgtaagaattaagcagcataatgtgtataaagggtatctggcacatagaaaggcgttcggtaaactttgctgtgcttttccttgattctgccaggtttaagaaaatttcttcctttggacttcttgacacctgaccaggaatgttaatggcccttaaagagcgactatactcaatgaatgcttttggttgcatgacctgcatttcaagccacatgatcgctaatgattagcaagaacgtctcccttcttctgaaacaaggaggtggctttgcatttttgctttggtctatttgcagtggtttctatttgtttgtttttttcttcttccctgcagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtaagttgtatgcttgtctctcattcctgtgatgccaacagctttcattaccacctagcaaggcactgccaggtcttctcctgggataatcattcagggggcacttgagatcaaacattcatcctttctcaatcatagcaggggaaatgcttgtaaaaagaaagggtctttcccactgcttctggttgccttcagtgtgcacagctgcctacagactacttggtggagaagagattgagtgttcagaggttgtctgacagtgtaattagagctgagattggaatttattagtggctttgccattgcactgaggactcagggaagcttgacaactggcaggagaaacaggtagacggcagggtttgggaatgtggtttcagtctgtaaaggacagctcagtgtgcactgagatcattgcttaggttgtcattacacctcttccttctctactcatagttttgtgttcataagacttaggccccaatcctaataaatgcttgtttaatgattgcatttaataaatgctgggttaatgaatggatgaggctgggaagcttggtatgaagagcaggagtgaagaaatattttctcacactttatatggacagtgttcctaggtgttaccattcctttcatgtacacttgggccttcacagaccctacaatggctgtgaccttgatcggaatggggagcactgggcccatgaatttccattaggtgaatctgtgcttggagggctagcctcatggctcaggtcagacaccttccacagattttgagtttgtttcccagcctgttgtgtagctgggtggctgttgagtctcttcagtctgtttcctcacctggagaatggagttaataacagtgcctcctaatggttgttggtattaaacagcctcatgttgtttatgtgctatgtacatcgcataggatgatgccatttcatatattttagctttggccgggagcggtggctcacgcctgtaatcccagcactttgggaggctgaggtggacggatcacctgaggtcaggagttcgagactagcctggtcaacatggtgaaaccccgtctctactaaaaatacaaaaattagctggcatggtgggtggtgcctataatcccagctgcttgggaggctgaggctggagaatcacttgaacccaggaggcagaggttgcagagaggcgagatcgcaccattacattccagcctgggtgacaatagcaaaactctgtctcaaaaaaaaaaaaaaaaaatatatatatatatatatatatatatatatatatatatatattagttttagttatcattatgactattattattttgtttcctaactactataaatggtattttggccaatctggagctaacaaccctgcaaataaaaggtttttgggtatttgagcactttgggccactgggcaatcaagtcctgtctttaaaatgagtggagtgagtctccaggtctctctgactttatattcaaattgctgtaacctccagagtttctttcataatgagagataataatgatgatgatgacaattttataattatgcccaggtaatgtattaggtacttgaaaaaaatcttaatacgtggtttataagaaatctgttaggtaggtataatctttattttatagaaaaggtaactgcaagctcagagatgttaaggaacatgctcaagatcacaccctaccttggacagagttgtacaacctgaagactcacctagtttctattttatattattattatatttatattattatatttatattttatattatttctattttatattattctattatagagaatctgggagattctcttgctggctctcccaagtcaagcataaacattcagagttagggagaatcctagggtcagtctcagatgtaactgttaaaaaggttagatgcagtagctcaggcctataatcccagcactttgggaggccgaggcaggcggattattgaggtcaggagttcaagaccagcctgggcaacatagcaaaactccgtctccactaaaaatacaaaaattagacaggcgtggtggtgtgagcctgtaatcccagctgctcaggaggctgaagcaagagaattgcttgaaccggaaggcagaggttgcagtgagccgagattgcaccactggactccaccctagatgacagaggaaactctgtcgtctcaaaaaaaaaaaaaaaaagaaaaaaaaaatagccaggactggtgcctttcacctgtggtcccagctacttgggaggctgaggcaggaggatcacttgagcctgggaggtcaaggctgcagtgagctgcattcacatcactgcactccagcctgggtgacaaaaaaagaccctgtcttagaaaaaaaaaaacgaaaacagaaaaactgtaaataggcaaggattgtttttgctttctttctttcctgttcctccatagactaagaactttctctgcgtggccacttttgtttgaactcttcagtcccaacctttttcttttccaatgtaaatattttcatgctatgttccatttgtgtgattagtttaataataaactccccatctttatccacacctgctaccaacaattttcttgtaggaatctggggcacaatagtaaactcaaggggaagtgtttgaggctgacattttgaggatggccctcaatttgcatcatgtactcccccacttactttccatgcagataaagccttctctaggttgagatttgattgtattatgagtgtcatgaaatgtatctctgatggcaggaggtcctggctctttctcccaggtatttttcagtctcatgatgctgacctgtttagcatttaaggggaccatgtgcccatcactttattaccaagtcttgctacttgggagtttaggaaacctccaaagatggccatatgtctgtgttgctggaacatttgatgtatgtgtaataaggctgtggtagttgagcccttggaattgtatttttaactgttagctttatcttaaggatgcaaaggggaagaagagaaaatttgattttagcatatggatggaccaaaaagtctaaaaattaaagtaacatttgcatgtttcagaagtcattttccacaaggtgaagggaaggaaggctggtggctttttgtgtcattgttaaaaggtccatgaaaatacctgctcttggaactccttctcctacactttactacttcaaggtcttgtgcattactttacttacttattttttcattttttttttgagatggagtctcactctgtcacccaggctggagtgcagtggtgtgatctcggctcactgcaacctccacctcccgggtttgtgattctcctgcctcagcctcccgagtagctgggactacaggcgcccaccaccacacctgtttttgtttttgtttttagtagagacagagtttcaccctatcggccagactggtcttgaactcgtcacctcatgtgatccatggacctcagcttctcaaagtgctgggattacaggcgtgagccattgcactcagccttgtgcattactttaatggttatcacatcccacttactttatatgcagcacttcagttaagaggaaacaaagtgctgatggcgacgccatcaacttgctgatcggatcgccttggctgtaaccactgaccaacactgtgatattcagagagagtttaccctcaccaggccccaatttcctcatctgtaagttggaattctcaccatctacctctggggctgttttaagaatgaaataaaaaaaatttgcaaagttctggcacctggtagggatctaatcaatgtttgttctcttcctcttttatttccagctggtcacttccttccccaaactgcctccacagcaggttgacagctatctcactgcctctctatcagtgattttttacccttgcgtgcataattaaattacttgatggctgccctgtaccccaggatttctggtgggggggtaggactcaggcatcagtattttcaaaaatcagtctgttaatttattgtacagttaaggttcagacccctccaatggaactaaattttttttttttgagaccgagttttgctcttgtcaccctggccggagtgcaatgacacaatcttggctcactgcaacctctgcctcctgggttcaagtgattctcctgcctcagcctcccaagtagctgggattacaggcacacgccaccacatctagctaattttttgtatttttagtagagatagggtttcaccatgttggccaggctggtcttgaattccggacctcaggtgatccacccacctcggcctcccaaagtgctgggattacaggcatgagccaccacacccggccaacagaactaaacttgtaagtatttttttaaacttaaacattaactgcataagcctctgaagacttcctctgagatagggataatcagggaagtgactatactttgctgataatagatatagtcgtaagtcaggcagcagaactggattctaattcttagcctatggctcttcctttcgacatctcccttcctagtgaatataatggacctgtattgtctagtactgtagacacttgacacgtggctatttaaccttaaagtcattaaattgaaatttaggttcttatttaaacttggcacattttgagtgctcaatagccatatatggctagtggagactataccggacggcagacccagagaacgtttctatcaccacagaaagttctattggacaatactgtagtagacgttccaacagagaagacagtaggagtttctcaaagaacctcttgttcagatgatccacagagtaactctccccactcgcacgctgcccccagctttatcggattctcttgacaagatgtggggatgggaagcagcataaacatcaggggtcctttcaaactgattccagcctctaatcagttcttcccagttggttaagccaggtgacaaacccaattcccttgtgctgacagccatgataatcaggcaccttctttgttcattatgctgtctttaaccccagcattcttatgcagcctcgcatttagtgatcgctcactgtgacggcacactaatgaagaaataaaacacactatctgagcctcattcttctagccaaagagagactgtgctccactggcttgtaaaatcaggtttttgttcacttggagaacaattagaccaggtgaataaaagtagcattggctaatttagaaggaaactgcctaggaagtttgcaccattgacgctgctggagagcttaagagaatttaatcgtaaacaaactttacctttgggaatacttttgctggagcctctggttaggttaacataaatggctgcctgtgagatgtgctgagatgtttctatggaagcaccatcggaacattttctggaaaatagcccataactatttagaacagggagtttagaacagagctttttaaacatccacatgcacaaaaatcacatggaaatcacctgcggattaggaggagcgaggttaggcctgagagtctgtttctgacaagttcccaggtgaggctgaagctactgatctgtaaaaccgtctttaggcagcaaggatttagattcccagccccacggctgtcaggagacaggagattctgttttgatgcctgtaactttcagacctgttcttcagctcagtggtgactctagaaaggtatttcatggattctgatcattctcccttcatggaaatggaatacttcatctgtctcctgtatgaagaaaatccagcctgggtagaatcatacaaccaaatgcactcactgtggaattatttttctttttaattttgctgttgtttgtttgtttcttccagaatcctcaccaagttattgccagagagtagaaatgtaaatgttcaccttagacacctgtatcagtcaagagaggcaagaagtttttttttttttttttttttttggcaacattgccaggacaagcaccattatttctgcacattcagggctgccattaaagctgatgtcaggattttgattttatgaatcttttcttaacagggattttgatgtgatttttattaatgaaattaaagtcctttaactctacgaatgactagctctttcccttctccagatctgtttctccttgtttccctgccccttctggaatgcagtctggttatcagcaggactgggcgtggtcaacctcacacccctgcaggaagacttctgatggtcttagtcatgtacttgcttgttcaatgattgtagtgagcaagatcttcttttcccccactgggaagctaaatcaatgttatatttaaagtaactttctttttttgttttcccttttttgagatagagtctcactgtgttgcccaggctggagtacagtggcgctatctcagctcactgtaactgccacctcccgagttaaaacaattctcctgcctcagcctcccaagtagctgggatttacagacatgcaccaccatgcccagctaatatttttgtatttttagtagagcctgggtttcgctatgttgaccaggctggtctcgaactcctgacctcaagcgatccgcccgcctaggcctcccagagtgctgggattacaggcgtgagtcactgcacccggcattaaggtaactttcttttccaaccccttattgtatttcaaaatgtgctagaaaagtaccttgtaaaggtagtaaattggctttgcatatctagaaaaatgtagctcatctgtcattttgccaccttgacttctgagcactgttaccagagtagtttttcgtatttttcaattggaaatctgtccctgtgcttttgggtgctctttatttaacttgtttgatgaaacttcttagagcctggtgattgggaacactctgtaaatgagagattattattttagattgccaacttgaagggcctttacgaatctgtctccaagtaaacagcctcgaatgtgccaaacaaacaaagagtgattgattgatacttagacgtggccgaaaatattccaaaattgcagctttcaagacattttatactaggagagctcagagctaatgagggcagatttcctaagatctatgaccagaggtcctgatttgaaaaaactttctccaggtttacgttatcaagaaattgaaacagccaagttccaaacaacaaacatcacttactttgtctctacatttgccttttctaattgaatttagtgcgctgctgtatttcctcccagaaagtgtattgttttaaaattaccatttcagttctattactcaaagccctcgctgctaatgctttctgacagttatcaacataatgagccataatgaaatgatgagcaatcttcggtggaaacccaatgtcgattcgaccggtgctgtgtgactgtgttgtgaaaatttgaatgcaaattaaaataacatcgtccttacttgtttccaaggtcaggagaagggagggactcttttccttttttatttttttattttttatttttttaagggctttaattttgggaatctcacatccattttcaaacaagctcttgaaggtgcccctgttattctgttcaattctctaccccaaagatttacatgcttagcagtctggctaagggatttggggagggatgtctagagcgaggctttgatgtataaaccataggataaaatgcagccttcagtttcaagtaaactatatatttttttatctacccgaaagcatatttctttttgctttagagctgcaagtaactaatcatataatgatgggggaggcatacattctgtgaaataggtcagtgagggtgcagttagctctagtgaaagactagttagaaaagtgagaacaaaggccaaagattcccaaagtgtcgtaaatgaaagtgtttcagaagattcattggttgatctctagccattttatcattcatgcaatcaatcattttcgtgaacatatttttatgaaaaatctcaaatccaagttttccaggggaatttctcattccatgtcatttatcaaatttgcaatgtaatagtatagtttcatactgcattccatttgtcataggacaaaaactcagattgagacaccaactcctccactgccagattacatagttggtttttagttcagaacatatggtcctgctgcctgttagttggtaagccagctaatgtgtctgtcccatggactgtacaaactgatcaaagcaaccaaagacatttggacgattcagatgcagccgtcaacgtatgctgctgcttcagttagagcttagtagttcaacatctgatgttagctagtgagtataccacatttttgtttcttcctttcggattgcctttcagcattttagctactaaaaggaaaaagtacctctagacaaccaagtggatggtttttgtttgaagaaaattaaagataaagggagaaagatcaccaggtgagcttcaacgaaggcactagatagaccccagactgatcatttgccatttggttgtttgcaaaattttaagagcctcatgatatttcataaagatcaggtatcatctcactgaattctttttaaaaaaatgctgttttagcttcctcttttttttccccacatactccccattttatagtcataaacagcccattatggattccactggaaaatgcaaagattcgagggacactaatatatgcccaagtggaaggcttgaataatctgccaatgccatttagccaggttattacaatttttctaccaccctgaataattaagagtggcttgtcattgaccgagtcctgtcatttctggatgccatttttgacactatgcatggaagtcatacagtggttattcacagcatgcttctatgaaacaaggttaattacacatttttctgagatcccctggggtgagaacggggtatcttctttttttctttttttaagacagagtctcactctgtctcccagtggtgcaatctcagctcactgcaacttccacctcccagctcaagcagttctcccacctcagcctcccagggtgctaggattacagaaacgagccaccacactcagcccagggtatcttctttgctatcaacatttagatttatgagagattctgctatagagatataattgcccctcgccctattcctatgatcttccacctagaaaaagaacctttaatagaaactcctagccactctcttgcacagaaggtaggaacaaggcagaaaagataatccccatgaaaatgataaaagaggatcatctgggaagtagtactagctagccatcatcatcatgaagggcagggaagtgaggtgaaattgaactctggggtgaactgagaaagttggaaactttctatccaattctcaaaaagaatttgtaattatgggttattattttctttatattatttgtatctctatgaaagggaagcagggttgtttagccttggagtcagggtttctgatcacagctttgcgcatgttggctgtcttaattttggcaatttgcttaacttatcttagtttttggcgatcagattgttgtgaacaataaatacttttctgtcagatttgattgcagctgttaaataagatacaaaaaagtgctttgcaaggaaagtaaattaatgcacaggctagataattttaaaaatgaaatactcaattctacttttcttggtctttggcgtggtagctttcttgtgtataactgagaatttataaggcacttcagccataaacaagtcatcctaataaaaagaaaccaaacccctaattaacccagtaaaaaaaagacaaagatcactggagaggagaatgggaaaggagatagaaccagaaaaataggttatgggaaagtctcacaacaagaaatgaacctctataggaagccaagaatttttcatgacagcagcaagtgattgatgcatccaaaaggttctggtttaatcatggacagccctgcttggctgtctttgttgtaaaaacacataaaccaccatgataagaggttatgcactgttcatatatgtcaggagggatgtctttaaaacagccatctttatgtaaactaacccacagcagataggactgggagaaagcaattagtggtggcaacatatacaaatgtcaggggaagcatgggctttatttcagagtcaaaacgtaatgcatcccaactgttgactcttccttataacctgtctttcagctggagagagattaacaacaaaggcttatctgaagggttgaagggttttacagctaagacgctgaagtgctattgacagtccaaaagttgtacatgattaatgaagccttaggaaatggaactacagacccaaggtgctgcttcctccaagatatgtgttggactggttgccttagcattttagtgaggtgacagcagtgcttaaatacatcgatcatgggagagttacctttctgcccatgctcttgggggatgctccatttcccatccagaatgaatttcatagcccaggcattgaattttaaaatggcgattaaaaatcagttaagtattagatgtctgtgatagctctggaaactactctatcacatgagaccagagactttggtttttctatcaactgtcttcttgccttggttgcagacttgattttctttctttcttttctttttttttttttacattttagcatgtgattgccattttttctctctttattattattattattattttgcttagcttttgtgacatacaaaagtgctatggcagtgggtttttttttttttttttgagacagggtctcaattcatcactcaggctagagtacagtggcatgatcccagcttattgcaacctccacctgccaggttcaagcaatcctcccacctcagcttcccaagtagctgggactacaggaacatgccactacacctggctaatttttataatttttgcagggacagggtttcaccatgtttcccaggctgatcttgaactcttaggcttgtcaagccttccacctaccatggcctcccaaagttctgggattacagtcatgagccactgtgctcagccatagtgctatggtagtgatgcttctgattagtgagctggactgggctaaagcatcatcattcattcatttgttcatttagcagatatttattgagtttctaccagatgtcaggcattactctgaaggctgtagatattctcataaacctgaaaaagagaagattccttttctcctggagcttatgttctaatgggaatataaacaaacaaatgaataagataattgaaggttctcctaagaaggaaatttttaaaaatgtgatgcaattgggtgcattgggacagggaaagggaggatttcagtttgtatggagtagtcaggaatgagaactattccagggataagaagtcagtcagtcaaagggccgggagtgagaattccaagcagaactaccagctccaaggtattttgagttgcatgtgcaaaattttgctaacaatgtgagttttaaagttgacttacttttttccacagttttgcattctgttggcactttaattccagtcgttacgagaaatagaacttttaggtttatatggcacgttacaccgtatatccacatatatttaagccctttggcagaacccatttctgccaaacccatttcaaaacgcaattatcatagcaggttttcatcttttactgaagtttcagttgcttcctgtaagaataaagaaatgcattttctctgactttgggtgtgaggtagagtacatagggtacctggactttccatggaatggtttataccaaacttatagacacactggagacatttctgactttaggtttagtgttggctgacggcttttaaatgacattattaaggctcacacagatttcatgtggatatgtaaatactggcttgtcctaaaggggctactttaaatcttgacataagccagcaactgtgttctctaaactactcaagaattaaattttagtctaatccatgggaggaaagaattaagatatgtggaattactggaattttcttttatgcttggaatattgccgttcttaaatgtcacattgacagtatgtggttcatttccagaagcttgtttttttccccagagaagagcacatggttggtaaaggaagatcaagattccttttataatacaacatgatatgatgtgatattttataatatgatatgatagccctttgtatctactatcatgtggctatagtttctttggggcttaatgctgtcaaactcctgtcaactgaatgtgaggtgacatcccactagaaaataataattacccattgtagcacctttctctggtacttgctgtgtgatgcagaaagtatttcacaccagtgaagtgaatggatgttcattaaatgtatctataatggcaagaaattcagtgcccgtttctttcagagcaatgagaaactcaagaaataagccatatgtctcattttattccctccttagtcaataaaggtaggtctaacttggactttagcagccagagttgtcacctgggctatatacataggttaatcaggggttcctggactgagctttttagataggctttttagttcctggaattacatgcagaattctgagggtgccagagagcatcttcctaaaaagaagatgccttgctttcatcatattttcaatagcacgaaatggtctgaaggtcaattttaacggccacctatttttgcaaataagttttcttggagcacagccatgatcatttgttaaggtattgtctatggcttctttggagatagaattacagagttgagtagttgctgcagggagcagatggcccataaagcctaaaatatttattttctggccagatcataaaatttctttacagagaaattatgccggcccctgtgcaaaagatttataaactaaagattattgcatttgacttctatttctgggattaccattaatatctgggccactaagttatattacaaatgtaaagggcatactaaatatgaaaactttaaaatagttgaacatgctattttcatttttgggtgcaggcacagagagaatcctgggcttatatgtgaatttcatgggaaatttacaaatacaaccaaaaacgtgaaggaagggtgtttatgttcccttaaatacacctcagcatttgattaatttatatgaggttggtacaaaagtagttgccattaaaagtaatgacaaaaaccaccattacttttgtaccaatctaatattttagaatgtcttgatttgggtgaaaaaattaaaattaaaggcaaaagctgttgttccataaagactaatatggaaaatacctgtctacctttagaaatgttaaaattaagcttcttcagagataaagttttccccagagataaagctttcatgtctgagtaaatcacctcctgaaatcaaggtggaggaagaaaagtgtaataaccaatcccaatttgataaaaccttatttgatagaacccacatttcaaattcccagccgtcgctggttacacagctgtaaaaacaggacaaggcaggtgcttgctctgacatccactgcacatataatccctatttagtttccttgagtctctgcctttttccctaggttccctatccattcctgcaactatctaggcaactatcaggaagttatcaaaatgaataagaatatttttcctctctcctctaaagcaggtgataaacactagatacaccataaatgttttttgaataaatgaatgattcacaatctctcccagcagaagtaaccactaatattttatatatagccctttctactttttccaaagtaattctaaaccatgaaaaaaagaggcaattgaaacaaactagttacactgagttactacttcacaggtataaagctaatgaatctgtatgtgaaaagttgactagtacagctttggctcggagaaggctgcatagttcacacacttcataacactgggtataagatgcattaaaggacttcattagtttttaattcattcattcattgacttatcaaacattttttgaaatttctgaacgaggaaccatggtagaaaacaggaagtgataaagacatcaattattattattattattattattattattattattattattttgagacagagtctcactctgttacccaggctggagtgcaatggcgcgatctcagctcactgcaacctccgcctcccaggttcaagagattctcctgcctcagcctcccaagtagctgggactacagacgtgtgccagcacacctggctaatttttttttatgtatttttagtagagacgggggtttcaccatattggccaggctggtcttaaactcctgacctcaggtgatccactttggcctcccaaagtgctgggattataggcgtgagccactgtgcccggccaagacatcaattcttgaggagcacatatactggtgatagaaacagacatggaatggtgtctaagtagcaagacaccattatatgttacaaacaaagcaggaaaggaaataaggaactgaaatgtcaaacaatgacataagcataaggactggtgttatgccagtcctgtattgaggctagtagtgggtagttttgaaaacaaaatcttgccattcacaatgaccctcaagctacccgatgggtgtatgtactcagtaggtcgattcagatgtggagactagaaaattagaacaagtacaacagttagcccttttttgttataaacctcatatttgtaattggagacttactcgcaggtggacatatttctgatgacaaaggcaatcactctgtcagaaatttaattgcttctaaatagccagacacaatacttacataaatgaaagagaaaataatcggagttaggttttttacttctggatgccttgtatttattaaaagagagctcagattactcagaataccagttttctcttctttttagccatctctgtaggtaattgtttaccaagatgctgcagttcggtattaactacaggcccagattggcttttggctatattcaagcccatatttgtttctcaatgtcttgagaatagaatacttttattctcctcctcctaaagaggagatgggccctccctttaaatgagaaacacacttatatatttgtaatcttttaattggcagggaaacaaaaaaaaagaaaccacaatcccacaagcacagcataccacattatgattttaatttgtaaagcgtgtgtcctctcccaggtttttttccagaccaacatcatagtcatattggatggattttctatactttgttttcccctctatcatatgacttcgttatactccaatttcgaggcagcgacagtgtccccacaaagctgtcactctctatgatagcaaagcataaaacatacgcagtacgatttaccagcactgaacttgaatttgcctaattctcagtcttgagcatccaacccagagccttccttcagaatcgctgcccacaggaagaaggctgccctagcttagcacgtgttttcgtgccagccctccattttgaaatcctgcagcatctttgtcatttttttttccacgtggaagtgctatatctctgagtcctgaaaccatttagttttctgctccatttcttctctgtttagacactgccgtgccccgtcctacatactaattactgactttttgcttctgtggtgcttgattcattgtgtcacattttcccatgtgaaagtggaccaggaaccttggcaaggaggttaatggatttcagagtcactcttatttaaccctggaagtcacagcaaaagaagaaccaatgactgacccatttgataaaccaagccctggtcagcttcagctgcagactagtaatggatttcactatggtggcaagcattacagaattaaaacagggctgaagatagctcactgccacctccatgtttgccttctcaaactggctgaaatttttccttttgttatcattatacctttagtgaggaacacatggtggaataaaaataactccaaatggcagatagtacttttggatttcagtcaaattctgtcactaattagattgcatgaactttcagtattattagatttactttccagatctcagcttcctcgtctttaaaataagggtatttgtccaaatgattttaacatcctatgtagctcttagagtcggtgattttatgtacttcatttattcaaaaagcattcatttgtcattatattccagttaccatgctaaaaactgtaaatgcagttttgaaatctaaacaagaaagaaatttgtattttctctctgaggacttatgtgaagtaatcttccctttaatacaaattttacaatacttttgtgaaatgttttaaaggtttgcatttttctaagtttcacaggatggggagctgatcttaatgcttaaagaggttgttggtaattagtcctgaggggagtttgggaagtcctgcttaccttgttaaaataaagtcttcaataagtgggataaagagaaaaggagagtgaattacccttattaaatgttaccactaaaaaataattggccattaatcactgcaagctatgtaataaatattgaatatgatttcttatttataggttacctcttccaattctatctcgacagccattttgaacagtatgtttcattgtggtagactaggtaaagctcatccaagttcatgcaagcctcctgttaactttcttttcctgagaaacttgtactaatttcctgcaaagtagccatctcaattacattagaagtagtatagataacagtgatctagaaacctcaaatttttcttaaaactcattttgctcatctcttggaagactgaaatgggaaagaaatagctttccaactgtcaaactgagtagctatgtctcgtttgagtgtggcagctaccttttaagcctttggaactggttcagaccaagaaaattccctctcccttctcccagcctgattcttccacttgaaagcagtttgtgtcacaatttttttgccctattaagaccaatcatggccgggcatggtggctcacacctgtaatcccagcactttgggaggccaaggtaggccgatcacttgaaatcaggagttcaagactggcctggccaacatggccaaactccgccaaagatagcaggtgtggtggcacacacctgtattttcagctacttgggaggctgaggcatgataatcgcttgaacctgggaggtgaaagttgcagtgagctgagatcacaccactgcactccagcctgggtgacagagcgagactccatcacacacacacacacacacacacacacacacacacaaatctacatcaagaaacaagagtttcatcatgatctatagtcttattttttattattaatattattttttaaccaaccagtatgttgtcggtaatcagttgttctgtttcataacaaccactgccatcacccatatttcagaaactctttgatgttgctgggaatgcacgagttaaagggcaggaggaggggtctgggagccttgaacaaaacccctgccatctcgccacagctgtatcttcaacatctctgcaaccgcgttaaaccagttcgtactaattacccataaacagcttaaccctccgctgccatgttgaactgcagaggcacatttctacagttctgttaattttatttgctattgatgacatgctgtacttaggaattataatttaccttcagaagtggtatataactattaatttatcagagtctcacaacggccctgggaactagaatcactttcatttttttagatgataagatggaacagataaattatgatatttttctgccacttcatagggaaagcctgggcttggagcccatttgctggagagttgcttcacatctcaaagtgacaaccgatgccttgtttgtttgcgtgggaaagagaatgacactcacgtaacagccttctattatattgttcttttaaaagatcttttatgctggcttgatttgctttttgctttctttgccaagtgggtttgccttgctttggagagctgcagaaaataatacaaactctgagagattccaaaagggtatttcggttcttggtgtgatgatgtggttttctttctccaggtccaccatctgctcccctgaacttgatttcaaatgtcaacgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccacagcagaatggcttgaagaccaccaaagtctccatcactgacctcctagctcataccaattacacctttgaaatctgggctgtgaatggagtgtccaaatataaccctaacccagaccaatcagtttctgtcactgtgaccaccaaccaagcaggtaggaattgaatctactttattgtatgatctgaatgtatacagagaaaaggcttaaaataatgaattataataaattgctataattgaaatagaatcaatcaagcctgggagctgcgttataatgtaaaagatacttaggggctgggcacggtggcttacacgtgtaatcccagcactttgggaggccagggcaggtggatcacttgagcctgagagtttgatcaagaccagactgggcaacacgatgacaccccatctctacaaaaaaaatacaaaaattagctaggcatggtggtacaaacctgtagtcccagctactcaggaggctcaggtgggaggattgcttgagcccagcagtcagaggttgcagtgagctgagtcactccatgctggatgggattcatctcagtcatttgaattatgatgtccatggctggacatcagagcacttatagattatgtacaattataaaattgatttttaccaatgcagagtgctcttttggtatttgttatattttctaacaaaagcattagcagcaatagttttgatcttatgctttaatgtaaaatattataaatgatctaggtggacctatactagaacctccatgtacatctttgtgtctatagttaacgaagtttactttaagacacttaatagttttgcagctacttttttctttttttctttttgagacagagtttcactctgtcgcccaagctggaatgcagtggcgtgatctcggctcactgcaacctccatctctggagttcaaccaattcttctgcctcagcctcccgagtagctgggactacaggcgggtgccaccatacctggctaatttttatttgtatttttagtagaaatggggtttcaccatattgaccaggctggtctcgaactcctgacctcgtgatccgcccaccttggcctcccaaagggctgggattacaggcgtgattgcagctacttttatagttgatttcttgattgacgtgggggctgggagggtggggcggagggtggggcggccagtctcctccaattcctacatcactttctgctaatacagatgactagaaaacatttcctgttcatgaagtgtttctactgagttaatcgcagaactgtcatgaaatcttgaatatcaaatattttgaaaatctaggtttctaggctttcgcttctgacttactcatctgtactccttccctgaaaaagttaccacccctccaggagttttacattgccggcttttttatttctggagagttagagaggagaagggaaacagagttagagtggcttattctttgtgaggctcttgggatagaaaacatagccagaaaaggattataaattgccaacaatcctatcgcctctaactgcacttttcttttaaatgaatgtttcagtaagtgcactcaatagtttagtaaaatatctgtactaattgatcctataagtgaaaactattccagtgtcccaatccaaagccattatttttccattttgccctgaactctttggaataaataaaaagttaagacttggggaaggttttgagcaggggctagaatggcaagtcttaccggaatgtatcttcagctctgcaaatgtgaacagtcttttaaaatatctaatgtgaacgggtcatccagctaggcctttgtcttttaattctgaatttttaggttgtgaacactgttcgcagtcattagttttatttttctacaaagactagtatgatttaggagtttttgatagaaacatgagtactctgtgattgccaacagtttattagttctcttttggaagaatgcaatggaaatattacatacagatcctgggaacacgcatcggtgctgctggtctctctgaattaggagctgatgcaatgcagaacgatttctgcaccatctggagaatctggttgatgatccaatcagtattcttacatgcagcccccttctacctttttggctattcattcgcaagcactacatcattttcttaaccgaattataagtagggatggacttttggagcctcatctgtaaaaggtgaagtcattctccttggcagagaaaagcctgtgggagatgcgctgaggacaggcttggctcccacagattttgggggagacttctatgaccccctgtacacgtagggatttgagccaagaagttatgtcaacacctactggggcaaaaggtccagagagcacaaagaagacacactaaaatcctccaaaagaagaaaatgcaaaaacatttccgggggtggggtggggtggggtgggatgaagttttattttaaatgtaggtataattcttctagatttaggagaaaagcagacagagaattactctgacacaataaggttttctttgccatggcatgtagtcctgccaaggaggtttgctgaacaggacaaaattccagctccttattttaattttcatgaagggtaatgctgggaagctgttcaaaattaaaaataaatctttcaataaggagacctcctatgtggccagccagaaagctttcacttagtagagaattgtatatgtgcagagcactgcttcattatcctatcataatttgaagttctctaattcaagtcatcaggatagtttatctttgattaacaaaccctttcttcatagtagtgcaaattaataatgtaggccaaaattcgggtgaatgtagcaaccgtaaactctatcgaagctcccctaagcatatttacatacacacaattatgttctaattgcaattgctcctatcatttcattaaattaaattccttgaggaccactataggcaatggtgtctcactctataaggaatacatagaattaatgaacgttagcatttagcacctggaggctacaaaagttagtggttctccatctttgctctgttttcacagggttctttctctcatcagtaatatgttagaaatgataaatcaaatcaatcacgcaaaacctgctagaattcttgggtcctatgttcaccacctttgagactttaagagttgaggagcagctccatgaaggtgaggtgactcacccatgctaatgtcagagccagtactaaaaagcagggagaatcctactcctgaaagtagaaagttgctttcctttaaaattaggagataatgaatggcattcatgtattcagcttggcattctccccatttatgagaccagattatgtgagtatctgggcatggacatggagattgaactgggctttgatcatttaattgtagaatgtggtgtgaatgggcctgtgttctcacaaggttatttaaacaatcctaacccaaatcttactcctggggtcttagggggttaataaacacccttttgctccccttctgggttgaaaaccagttgacacagaagacaaaggaaatctgaatgtctgtcagctttttgctgataagctgatggaaggatgtgagctttatatctgtggccaaaagggcttgcttcagtgacacttgcagcccagctggctacctgcagcctctccgcctgccctgctaaggttgttggaaggacactctgtgcaggcagacaggtaggcagataggcagataggcagatagacaggtctgagagtgggtggagctgaggacagagtacttttcccaaattctctaatgagatgagtcactcccagcctcacccccatgccagaaacaatgaagggaagaggtgggaaaagagtaagggtgggggtgttacttttccagctgaagtcgtacccagtaaaattggagaagaggaagctcttggagctcccccaatagttacttttctacattacaggccaaaaggaggaaaatgagattccagtttccttcatctttcatcctgtagcgactgttttgtcttttgtttagaagcaggtagtcctgatgtttatgaaaaatggataagcaaactgctgggtgatttgttttctggatggctttcctttggtttactttcacttaagtggaccatctcaggcaaatgaatacaggatgtgtcactaggagggagaaatactgtataaatgaaacaaggttttctggccaagcaacagacctgtgaatattttttttttgttaaaaaggctgtgatggcagccagcagtagcttaatatctctgaacggttttttgccgttcatctcccatcgcctttgcttggttttctagctgtgaggctggaccatattctggcgttttaaatcattatggtcccaacccccatgaatggtgttccctcctcaccccaaattgcacccagggccggtgttgtccattttttatttttactttgcatgtgatgctattctagatacttcataatggaaagatctggtcatctctctctagcacagctatggtgtcctagtgacaaacaaacatctgtagcatgcttagtttggaggagttaaaatatttgatgcattacgtaattatttaaaccagctaatctctaagatcttttccgtttcaaaattctatgattctaagtatgtaaccctgagctgtgggctatgaacctgaagaagtaaggcttattcttctaacatgtttagaaatggtctctcaatgcaattctaagagtgggaaaacattctccaaatgcttcagcagaattatcacctgaattctgcctgccctccttctctctaattccttgccttgccaagggatttacgttgcggggggaaaacagtaagatagtgaacagttgttctaaattgggggtgatttctgctcctacccctaatgggcaatgtttagaggcaatttttggtgcagttgcatctagtgggtagaagccaggcaggctgataaacatcttataattcacaacacagcatccccaatcctccgcaatgaagaattttctggtccaaaatgtccatagggctaaggctgaaaaactctgttctagcaatagtttttaagaacagacttcatagcagtgcccaccatttcagggttccatagccatgtggcctttgcttgagctggcctgtggctgaacacatagggaagattccacatttctctggctccattgccccatgctgaaagcatgatgctcccgttactgttctcagagaacaggcagttgtaaagggcctttcaaggcccctcatgaatcctgttgtagctgttttgccatcagatgaacgggcgctgcttgttaggctgaccttgttctctagggttggacaattaagcattaactgcaaaataataataataataataataataataaaataaagtggcattacacctcattataatgccactgtgccacatgtagtcattgtacagttccatctgtttgttgattaacatttatttacagtaaaatcaaatcagttaactctctttgtcaagtaatgataaatttaataaaaccaaaataatgaataaagaaaagaaataactaagtgtaagaggcacactgtcttttattattcaactggtaagttcccattctttctctctctgccatcttttaattagacatattatgttatttgagtgggataatggagaacagtgggaattctcatccccactgggtataattgctacctgtcttctagatagtaagaggaaagcttcaagaaaatggtgggagaaaggggaaaatcttacagcaatcaatttaggtaatatgctgtaggcatggcagagccagactttgtggagtttaaagcttaaacaactattgtgtgattaagggtgaaaacataaaaccctacaaaattacaaatgtcagactagtaacagagcttcagaaagggtccatacaaacttctttagcttcggtaaataaaaatctgcctctgactatgttgagataaatgcaattgtcagacaacaagactattgcataatcatccctaaaaacagaaaggacaagggagaaagatgagatgttgggaagtccagtttggcctgaaatgaaggtgttgaaagacaggttgtgacagtgagtggttctggcccacagttaggtatgaggggcacctctggagtggacctgagttgtggtctgagatcaaagggacaagcagaaagcacattcctgctgattctgagaattgttttggaatactaaacctaaatgagatgatgtgatctcggttcatgcaaccactgcctcccaggttccagcgattctcatgcctcagcttcctgagtagctgggattacaggcgggcgccaccacatccagctaagttttctattttttagtagagatggggttttccatgttgcccaggctggtctcaaatacctggcctcaagtgcatccatctgcttcagcctcccaaagttctgggattacaggtgtgagccacctcacctggccaaatgatgatatttttaagacacaaatgtttgcttcctttagtgccctaaagcaggggtcagcaagctatggcccaagggccaaatcgaatcctccagattgggacaacccacgaatattggcttttatatttctaatgggttcaacataataaaaaacagaataatattttgtgacatttggaaattatataaaattcaagtattggcattcataaataaagttttactggaacaaattcccactcatgtgtttatatattgtgtaagagtgttttcacgtgacaatggcatagttgagtagctgcaacagagggcaaatgtccggcaaagcgaacatgggcactatctcactgctgacacaaaatgtttgctgatctgctctggagtactaaatcaagaaaggagaccagtaagaacaaggttgagaagctattgaaatactggtatcatttgtggaatattgttttggcaaaggatgtgatgggtaacatttaggtaaatctcacatttgaaacaatcttcaagacaccttattttgtaaaggttttgactcagaaaaaaaattaactaaaataattaggatttcagtcataactttgctttcttgaaccacaaattttttcccattggcactcagatttaaatggattatgtgagacatgcttcactgatattctggttctctttaaagtatgcattcttcacactattgcctaggtcctatagttgctgacagcaattttctttttaaataattctatgttagcctggtgcagcggctcacgcctgtaatcccagtactttgggaggctagggcgagtggatcacttgagcccaagagttcaagaccagcctacccaacatggcaaaaacccatctctactaaaaataccaaaattagacgggtgttgtggtgcacgcctgtaatcccagctactcaggagactgaggcacacgagaattgcttgaacccaggaggtggaggctgcagtgagccaagatcttgccactgcattctagcctggatgacagagtgagactcgatctcaaaataataataattctatgctctgctcctgtgccttatcttctctccgagatgatgtcatgcttgcctttgatctccagtaaatcgtgttatttttccttacccctaagaaatttaaaggaaaaacaaatgatggtactagtgaaatcgagaaaatgaagaactccttctagagattcattttaaaatccttcaaacagacaacaaagcaattccactgagagattttgctgaaacgttgtttgcgcatcctcagttgttagtagggaatcggtagctggttggagagtcctttctgtgcctggtaattataggcccaagcaagcacacaatgagcttcagaggagccaggctgtggttttctcattaatagctctggtctagccatgggatcctggtttacttcataaggcctatgaaatgcacatttaaaaacaacatgcggtacttttttttttttttttaagaaacagtctcttgattctaaccttatactgagaagaatttcatttccagaatactgttgctaccactataattaataagcatactcactaattatgatcgtaattaaaaataaaataaaccagcagatatacaatggcgcagcctcttgtgtgtggcaccagtgtctgtgaatttgtattcggggtgggtgccacaagtcctggtgaggagaaaaaaaaataaaagcctgccaaaagagcctactaaattatccaacttttcaaggttgactgaatagcacagacaaatagtatgtctatagaacgtagtggtaattattgcatataagcaaaagttagattgcatttttttaaaaaagatgtgaatattccactctaagaaaatgaagtctttatttatacacccaggactgagaacactatttttcctgagtcctttccttttgctcctacagaaagatatatgcatgttcatttgtaagaagagaaattcattcaccagtaatcacttgacagcctaattctggtttgtttctcatctctcagtgttgtgcttgttccatcgaacactaaccaccaacttttacaccctctggagaagccatcaagagatttaaaaaataagtgcctggctgagatgagaaatgggcagggcagggctagcaagggtttccaatgggcttctaaattatctagttgtcactccaactggctcaattaattactgtctccccagaggagccagatgggtctccagaaaccagtctgcaattgaacatcaatgaaaagatccagagaaactttatcaaagcttccattaaccccctgctgatgtctttaaatagttttttttttttttttttttttcctttaaacaccttgaaaacccaaaagccatgcacaggacttatcttgcattaagagatcttaaatctacagggactaattgaaatgcctgtccatgtcactcaaatacatagagaattcttctgagtctcaacatccctgtggcatttttgtgatgtgggtatacaataagagggtatcctgtatattttcttcaggtaaagactggtgaggatgttttttagggtttacatgttaatctgtcaagataagcaaacctttggtctatctgtcagtattaaaaatatctctcttatttaatgaaccttcttctggtgtccacctttccacccgccacccccacaacctgtactcatgctttctcattctttgcttctgccaaaattagaaatgaaagaggttccccaggctcccctgaaacggcaatgataaaaacgagagatggtgccagtcagtgtggtcgcttgcctagtgaaccccttggcttcctcattgggaaatgtcactaatgattggttccataggtgagggctggcacccagagcactgtgggaatctggctgaatggtcatcaaaatgtccgcctatatagacacagagttgaagaaatcactcttagattccatttcttctttctctattctgacaaattggtaggcctgatctaaacgaactgtactgtggttctcctctgaccatcttttgggttttgttttgttatgaaaaagtacagggaccactccctgaaatctatctaaaatactttatgtgtaaaattatagagacacgaaatattttttctattactattctattcttgctgttactcttgggaggggcaaggggagaaaagataaagaactatggtccatccctttttgattcatatcttccagtacacaattttttcaggcagtttgtttatcactttcaaaaaaatccttttaataaaggctgtgggacagataagttttttaaaaattcttgtctaggaaccttttgtctgtgacatgtgcatacaaacaagacttaaatatgtagcttcaacttctcagtgggtgctaaatagtgacctgccaccaatagactcacagtgtgttccaagcttgggtaagatccatccattagcacaaacactgaaaagggggtagcttacaacggctccctggagaatttgtgtttttctagataacatactgcaagctggaaatctgcctcttgaatcaaccctaatttttttttttttttttttgtaaaataagtgcgtattttgagcataaacctgaagttaaataggagcacagtttcgttcatgtttctttttcaaagctaggaccacacatataaacaagccagggatttttaatatgtaaccagcagaaagcttgatcaagtgttctctatactctcaagtgtaattaaagacttctttttatctaaagataaagaaataagataaccaaagacttttattttatctgaaaattattgatgaggctcatgttgaaacccaatgaatctaatcccaatcctatagggttcccaggagggtgtggttttaggaaacttcttaggagacttggaaatccttggagctaacatcatctcatttctctccatttacagtaggagtagggttattattaaggtttgtgataaaggttcttattgttttgttttatattagaagcaaggagaacaactagcagagccttaccccctctgaaagtatccttttgtagccatgaacagtggacagaaaatttaagaagcatacactgtgtttacagccttcattgtacactccaatacagaacagtcaactaattcaggtgcggctccaaggggctggtaatatatttaagaaacccttatattatgtaaagatgtattgtttggggagaaatatcaatgagagccctttctatctcactgtaaactcttcaaggattcaccttaactgtacgtgtttgttggagggtagcattttctctttccctccacttctttttcctctacctatttcagaaaacacaaaaataatttccattaacttccaataacttcctccatagtgtgcaggagctttcctccagtgtctttcttagatatcatgctgtggaactatttctaggtaagatgcaattctaataaactcctccagtatttaggaatggactaaatactgacttctttgggtggagccagttatgctgaatttcacacttcagcaaattgagttcatgagagaggcccctgtgacatgctgtgaaccccctggttttctttctttcttcctttttttaaaaaaataaaaacaaaaacaaaaaacaagtcctaaaacagtaatagctttcgtaatacattctttattatttcttatgactacaaaagtcatctcaattctcaattctcaaacacagatccagttgaagatatctactgaccttaataacattttaaaatttaatagctcagttgtttctgccccattcttataatgcctatagaaatttaaactatctagcacatagaacttagtttctagctgatactctaaaaataaaaaataaaataaaaatacaattctagggttacagatttccaagcttaaaacctcttctcctaaatgattatcctgttcctaacctgtaccatagcttttgagaaaattgtcaaaaagacagattttcaaatatgaggtctgcaagaacataattgcatggccacattttcagagagcgtagcatgtggtgaccatttgtgtaagatgcattctcaaaatgttctgactgtaatttaacccaaaggtctctatcccacttctttccactcaccaggtgcttccttacacttgtctacatagcaagcaagaaacagggcaggaaagatttcttctttataaaaaaggttccctaaagtgatactttagggaaaagcaggttccctaaagtgatactttagggaaaagcagaggttccctaaagtgatactttagggaaaagcagaggttccctaaagtgatactaaaacccaccttctcagcattctatgggtcatgaatattgtcctcagaatattttgatcccctgtgtttggaacttccctagacttccatccagtagaaccaaactggcaataagaaacatgaggagtctcagaacttcaccccaatggccttcttcctgtttctctctctctctctctctctcccccccgccctttctctctctgtctctctcccctatttgtaacattctagtttatactgtccgtgatcatcacttctcagtccttagacattgtgctttaagccaagcaacacttggacttggaaaaattccaaatagcacagaacacattgatttacaactgaatttttaccaccatgtttcctctgactctctggccttgtcaggaatcattggtagcctatgatttcatgctataatttatactttgtcaatatgtgtcattttttcctctgttctgcctgtgtgttttaagtgcaacaagagaaagaaatagaagttgctaaaaaataatttcatagatctaaaggacagtggctggtaacaatgctaaagagcatctatcttcaatttatggtcaccatgacatgttttggagcagctcacgtgatctttttaaatgacgattaaaaaactaggtatcccattccaacagtatatctgatggagaattggatggcttggaagatgactaatgggattctggacctttctgtctttaggtcacctccttgaatggggactatatcataagtggtccaaggcccggccatttggcagccgtagaatgactatgttaatggaattggtctcagtccaggtcttagtcgacaggtgctcatatcataagtgacgtttattgactcccaactctttcaacttggaagacagtggaccatcactgagatagtgatgaagacggagtaatttataatatattcaggctccattgaaagccaaggaattcagccccttgagctggcaccttgcaaatattgtacttgtctcatgggttctgttagtttgagaaataaaaaatagaaatctaatttaaaaggatttctaataactcagaatagctaatgttggtttcctctgaggtcatatgagcctctcgtgttggtgcttttctcttcattgtgtattatagtgattagatattggctatgaaaattattacttttcatttgtttgtgtgtttggaggttgattacctagtcacttgtttataacaaaagctgtaaatgatactctttgacagagttaaataaggctatcttcatgcccttgtgaaatggaaattgatgaaaatgtaacactgagtaccttttatcaacataaatttcaaaacatggaattcagaaggattcatccaacacatactcttttctattatctggattaatatacctcacttcattcattcactctaatcaggttcatgacctgaagatgatttggcccctgttggaagagatcgttagtattactagtatattaatgttttgcccattgatgttttctgggttcatccactgactttttctttaacttcacagatgatttggatttccctatagcaagtggcaaagccacaacacttctgaattagttatcacacttaaaaagtcaagatgacaacaaccatagtggatctatttattgaagcagacaggctcttttagcggaatgatcaatgtcttacctctttctgaaaggcttttcagaggtaggaaatcatcaagcatctgatataaagtaatgaacaaggcttttgattggtcaagtttctggagcaggcttttaagtatttctgcctgtaaatgtagaaatctgagtgtgaaaagtaaaggcaacagcaaagatttactgggtgcatctatcaccctggcttttagagtctttgtgattaatacctgtttaattggggactgatctagatgctttggacgtcagaaagctaaatgttacagcattgtctcatgggttcctaacacagcaggacgattagcagctgtctgagtaacaaagagaacctgaagcctacaagcttagctttttattttccagatttggaatgcttgaagctccctggtggagttaacagcaaaaggaatagaagccttgatgcatagcagctaatcctttcctttctcttttctgtattctgctcagtaaaaatgaaccttttccttacattgttctccatattccaaattaattttggagagcattttttttgttggttatttgtttaaaaaataattttggggggccttttttttttcctctgatcttccctaggaagtgattggagggcattgtaggtcatggagacccccatttggtgaaggttcaccatcctgtctaaccaagttacacataaaataatttcaactaagagtggaaacactagataactgtcaacactacttttaggcccagtgagaagattcatctcactagaagcattcagagaaaaaaatgtatatttattttttgttgttgttgctagtttcaccccattttcttaccttaaaacaatcatcttgctcaggcaaattcttctaaactgccttccagtggaaagacttgttttcctgtttgcctcaaactggcattcttacttataacaggaaacacacacattgaatcctgccatgtttctgttggcaagtgttgagctatccttgtcagaacctgccaacaaatttcttagtaagcaagtagaaagtaaaacaagcagctcccagacgaaacacaggacacacttgaactgcagcaaagacacttgggtgcccctgaggttagttccctgctaattctggtggacatgggccttggtttccagttgagctgttacccacttataattttataaccgatcctatgactgtacctgtaataatgctaattcaagatactagctaacttgtaaaacagacattaaagtaatgcattttatttactacaaagagtaaggattgctgtatgtttcagtataatgattaaaaagttgcaaaagctctaatttgcaaaaccttacatctttcatgacatctttagggcttaacccaggaggtatactaaatattgtgtttggatctttctagtaataagtatgatacttcctttttaatactcctaacatttgtgtttgttttataacctttttattgtgaaatatacacgtatggaaaagtgggcaagattcgaatgtatagtcattgaattatagcaaagtaaacacctatgtgaccgtcacccaggccaaggaacagaacaatagaacattgccagtcttccagaggcttgtcttgtatccttaccccttctctaattccaaagactaattattttatttggtaattgaatttgttttgttttattcttgtcttagctctttagattagttcaaatgtgagttcattctgcaccaaaagttttaaggtttgtctgtgagcagggatcatatcgaacttacccctgggtttctgacagccgacaatgtacacagatacccctgtacctaacagagcagactttagaaagatttacgttgttgctgctgccgctactgctgtgggaaaacagtcacttaaaccttcaagtctcctatttcttaccatggaaaggaggggcagagatcagccgctttctgtagatcagtggttgagaatgagggctctaggaccagatttttgaattatgaccacatataagctataacttggagcaagttattcaaactctctgtaccttatcttcttgatctataaaaatgaggataataatagtacctgtctcatagagtttttgtgaggtttacatgaattaagtcctgcaagagatttagaacaatgctcagcacatcataattactcaataaatgctagtttcgtgtgtatgttgttacagacatgtggcatagagggaggatcacatacttttgagccaggtggacttgagttttaaatctcattttatggctttggtcaaattatttaatttctttgtacctgagtttccaagtctgaaatgtaagggtgatcattataactacttcagagagttatagggatgaaatgatgtcaggtgtgcgtgtatgtgcaagtgccttgcccaggagtttactggcatctgatttgctcctttccccattctttgttttgtggcaattcacagggcctcagttttcatctgcttaagcagttaataattcagtgaaaactaaattaactcttttctacaaagaaaactcaaccaaaccattttgagaaccccaatgtgttttcccatttagcattagcataagatcagctgaatcttttggctcagtgttttgcgattctgccgatttcattcactgttagaagactagtggccgtgattgtggccgtgattttgtccgtgggaagccacgcggcctctgtcactggctttgctgacctcagggcagcgcattccagtttctcacaaatgggtggatatctgctcatcgtgcatgaccagctggagtttccgggagggaacccaaaggcctttcaggaagctgcaaaaccacagaccaatcttctgtgggccacagtacttctacagtttatctgagttagttgtgatatgcaaatacctcttttttgccagaaggctccacttcacttgaatgagtacctgttttaaccccaaatgccagttcaatgggttattgcaatagaaatttattttcttgctgaaatcgcatccagttggtggtgatgggggttgttgggtgtggggcttccaagatgggcctgggtcattaacctccctctggcttgtgggttcaagaaaatggagagtcacagggagctatttatgggccagatctagaagaggggaaatcacttcaacccacattccattacccaaaactcagtcacatgaactaccgtagatacaaaggaatctaggaaggtagtctttggctgggcagctctatctagaagggaagggatctcacagttttggatgccttagccaaagaggccaacccaacaccttcaacttccctatgcaaacaattaacgtgaaggctaagaatagcatcacattctatcatttaaaatttaaccaatagctctctgtaaaggatttgttgaaaataatccgttgcccatctctctggcataaagaaaatgacgtgccctcccatctatctgggaaataaaaaaggcttataaaattttcgtcttctattaaaccaaaagtaaaaaccaaatcacagactttgcaaagtcttactctggaatcatttagttcaagtatttatagtgttccaaaatcagactcttaaaatcattggcagcatgagtcaattgtatccttcagtaaatattgctgaaggataatgtggctgtgcactgctttattttatagtatgtgtttaaaatagactctggtctgaccttggaaatcactttatggaaaaaaaaaatgcatctctcatacattctaaatttaagcttaataaatatgaatacttacatatctaaatataaatgaacttcatttaattcacagtcttctgaagattttggctgagaatttggttctatgtttttgtgtcaaataaggagaaaaatcaatgtcaatttcagaataatcaagttgtttttctgtaccttttgccggtttgttttaaaaagtttcactttttgactatgagaaactgtgcttgtgtggatgcatgatgtagcaactaaaagctgttgggggtggagctgactttttactttgatgatgagtccagcgagggtggttggggattttaatgattttacctaaaagatggcagaggagttgacctggctggtcgaatgtaccgcaaacaaaatcatgtgtatgtgaaagcactttataaactcttgtactataaaatactgtaatgatgatagtaagaaaaaggacgtataaatattgctaagtgatgtttgatgccataggtattgcctagcttgagaggaggaatccttctctccatctggaatgtagaagaaaacaattaatattagcaccagagctcttagcatctcagagacgcgaaacccttaatcacaaggatatcattagtgctctgaagcatttaattctgatgcttgacagcattttaaaatgcacaaacctttgataagaagcaaatcagagctggggtattgaattgagaaagaaatgggaacaaaaaccaccttaagctccaagtaattaaatttaaatatgctatttgcattaagcagagatatgtataaatggtgggtttatatttttctatcaatgaaagaccccttgagtaaatatcatctgtttaaatccagatcctggggaggggaaaggtaaccctgctgtggttaagaagccatctctcctgcaaacactggccattgtgtaccactgacatccatggcttcaggtgtcttgactttcataaagggctgttttcactcctccttgcccacaggctggagacctttcattgcatctgtttatttcctagctcacctcctccaccctctaatttgaaccagtaatgaaatgcagtcagcctacttcagctgttttctttttcctccaaagttccccccaaactgtttttaattcactgcttgtgatactggactcaagaaaacaattttctagctcaggaaccatgtgaagctttcctctctttcttttctccgtatctcctcttctcttctccatcccatttgggtgtcacaaggaccaaactgctgcagtaaaatgacttgtaggtgtttaatggcaagtcattgaggaagtgaataaaagaaaattgcagcattcacgtcagtggggagcaaggagaactgctgagctttgaaccaaagaaagttaaatttaccattttcttaaagggagccacctctgtttgacatcaaagcatctcctgtaatttctccttgtgaaatgcaccactgttagagagtcatgatagagccccctaatctgtgctgtttctgtttatcaaaaacacacacagagagaaaacccacatgtaccttctcagtgcattgtggtctgctctcaaaccaaatgtaaccacaggtacatagcaaatggggattctatttcgaaagcattctcagtttctcagggatttgtagaactgggaatacaacattctttgggagtgaaatttatcttggacctctattggaaagctcagatcattcaactggaaagctttggtgaattttttcctttcctcctcttttggtttttgcttcatcgttttttaaaaatggtattttgctacaatttcacttgtgtccatttggtatgtggaaaaacagagtctgttcctaataatgctgctcgcccacactatgactgcaaagggctctccaccctattacccccatgtttcaagtttatgtccattggtggctgttgcatatgtagtaactaatggcttctgctggcagtgactggctttgccctagtccatctttggaggcttaggatcctttctggatttatcattatgacttgggagtctcaccatcactccaccttggcagttaagaagtcaggagaactatttgcatatgccctacagatacagaggagaaatgcagagcaaattgtcaacaccttcatcagcctaaagagcagaagctcaaaatgctgtctgtaacaggtgcagtgatgcctagttttaatgttaacttacatttgaatgacattttacagcctgtgtttgaaaaatgttcagaagcatcacacagaccttagaaacagagactccatttataattagagttgtcatttgcttcaccccaattgtcaatatctcagttaacctaaatagtaaaaccaaccccacaaaaggtcctttgaaacaggtgcagatggaaagttgttttaaggatggcttacttctggtactttatgtttagaaaatgtttgatatctacagtaaagattttttagataaattttaatatgtaaaaacttttattcatttgacataattattgagcaccactgaatgcatgtgtcaccatgatttgtaggttaaaaagaagaagaaatgagagacaagttttgggttaaaaactgctgaaatctccttaggggtaataaaaaatgatggtctcggggataggcaccttagaccaggaaaattgacatctatgagtcattggagattttgctgtaaaggtttgaaaattaaggactccattgaattaaatcacacatcttttttaaagagctaccctttaggagtgcttgccttatgatttttacatagtcatctttctttaaccatgctactgtcaactagcatgaccagctctcattgctatgtgtcatgtctgaattctagccattaaagaatgcctgcatttgtctggaggcacaaaactgtccttaaaacaagtatctcctctatgaaagaagtccgtgggtagataggaatgcttttcaatctatgatgcatctctttcttgtagtaagaatgtaaaaaaaaaaaaaaaagaatgtgttcatcagccccccagcttcttcctggctttgcttctgacactcagcaggtgtattgagtgtctacagatagaatgtgtgagaaagtgccctctacttactcctccccatcacccatgagagaacttgaattagaagaggggcagtaggaatcgtctcctcttaaattctagaaaaatgggccctctgacttgacattagaaagtgttttttctttaagactactataaaaatttcccaatagttcttttagttaagaagaggctaaagtatttggtggtacttagtctgataccaacaattattttctatctggccatgcttacccattccccctctcggccttgttccataggtgctcattaagtatgtgtctagtggccgagttgatgttgaggaagaaccttgtctctatgagatttcagaatgtaaatcaaagaactgagcagccactgagaatctttttttccacttggtctttttatgctgaccaaattttctactatgattagaaactctcttttgaacttaggcattgattggtcagagctcttattgaaccatatatttaagggtgggatgtacaatctttttaaaaaaattctattatctcctcttctaattctgtaagcaaaaggcagagccctggaatattgcaaatcaggattcaagacatttgggttaggcattgtttaccaaagtgtggaaacataccaatggtggcatcagagatgattttagggaacacaccgatgagatattatgtaatattgaattgccctgtgtacagtatagttcattttcaattctttctcagtaattctgagtactccaaggtcagaatctcaagcgggtgcccatatatcctttgtttctctagcactggctaatctccatttttaacaatccttggagaagtaagagtgtccagcaaacattgataacattgttttatttacatgcaatgttcatttaatttcaagtaattatagggtttcattgataccagtaaatgggaaatttctttcaaatacaactgttgaagttaaagatactgcatttattaaagaaaatattacttaaatcatcttacaagctgcagagggatgtggcagcaaatgtgtggcatggaagtctgatgcttgggaaacactgcggtagggggaaaattgcaaaatgtcattggcaaatgcctcatctagggaaatgacccataggcaggcacacacagtagggtgatgccttctagatgtaaagttgaaggctgttttggaaatggggtagaaagggtgagggaaaagcccatatgtggcttatgatgtggagaacatccaggttgcctcctttccaaagtggcagtatggcaaagcccagattttctcaaactccttcttactagagaaggtaagctctccacatacaatgcagttgtatgttttaggtacatttcccaacctcacttggtcatggattgcttgtgtcattgtgccctgataacatgctcttctgaagaacatctgatcaataaagaatttagactttgcagccatacaacacaatactttttgtgaattagatctatgtattctacttttccttggttgaattgatctctccagtaggtatgaaagacaaatgtcaactcagcagttttctgactgtcctcagcctagcattctattttcatttaatccttcgttcttgcttgcatttctctttcagtctctccttattctccatttttatgacagctgtgtcaaggtacactctgttggtttattttcacatttatgcatatcagcttcccaagtagggctgcattagaaatactctatgagttaacgtgattatattgctaactccctgcttgagattttttgagcaccttagttgagttcatattccctttaaatggtcacaggaacacagctactcaaacttctaaaatagaaatcaagctcatttcccatatgcagcagtttaatgataacccaaccagagagaagctgtcttagttcatcagtgcactccaagggcaggcaggcaattctttctcaaggaatctgtcgattatcaggatctgaccaagaccatttccgagagaaagttcattttataattttatgatttttctccctcctgctttctttctaatgacctcacttttctgtttcatttctcaatcctgaacatcagaatttaaagagctcctttttatggagtgtatgctaagtggtctgttaggcaatatatttattacctggagtgaaatgactttccacagccaggcagttttcttagcctccttgctacctctatattttacaaagtcactttttgcattttgttggacaatggctttgtgtcaaccaggaaagaaagagtaaatgtgagtgtgtgtgtatgtgtgtgtgtgcctgtgtgtgtgttgggagaagggggccttaatgaatgtaatgagcacatttccgtttttcattttcctcagatgttcagtggcttccatatgtctgccgcatgcagctttgttcactggggttggtattactaaccttgggattgcctttgatggaggacatgtgtatctactgtatctttcccttgtgtttttgcctgagatccaatctggaatagctttgggactgagagagaggaaaaaaaaatagaggggtgtgtgtgtgtgtgtgtgtgcgcctgttaccatccctaacagagatgctgggctgtcaaataaccccctccaggagacagtctctaccgtactggatttagctggaagactcccttgtgtgactatggtgtgtctgcttggcttccctgccatcagtatactcgtcagacatggtcaagcaggtttgaagcttttcccataccattttcagtgacaatgtatttcactttttatctttgttccttggagttaggggttggcattcatacgcatgtattgcaaaagggcaggaggatgacccagcactaatttatccttcctcagtggccagtttttgacatttgtttccccagtttgggaataaaagaatatatacattggagttaggaagctccctaatctctggttctccagggcagctttgttagataagattaaggatttcatgaatgctttctcttctccctggagattgtgcatgggtaccagccattgtcagtgtcagcagagcctgataacagctggctggagatgcgaccactgcagcggagaagtgagcatcgggcagcctgggtgtataaatctaaagtgtgccctccttccacccccataacacacccactagagggctgcctttgtgtccttcgcagtggaaagagcaggcaaaggcaacatgtcagctcttgtaaaatagctgcaaaatgccacgcatgttcagagagaccagcactgcttgatttgtattcactatttacatggttgtgttcagactgaactcttactgtgattaagcagtacttttatttatattggaaagtatgtaaattgtttcccttttggcattccctacagtacttattgaagacttgtacattctcttgcttgcatgaaattaaagtccagtaagatggcactcataatactgggaggtaggattagatgtagctttactgagcttaaaatgaggtcttccaaaggctgttatggcttacaaaaggttaaaaaccagacagccttctctgtacctacagccttttatgagaaatgtctctacgtgctgtggaaatggtactacaggcctgtgagcccactaggcttttacttcagagattctctttttaagacaaacacatgcaaaaatatactggagagaaggatgaaaatgatatgcttctatactgaagagtaaaatggtcaagggggagacaagacaatctttcacacttttcttaaataagatgaaattatttctggctaccaccaaaaccatttattttcctaaagaaaatatcttttgtcttttgtttttttctaacagcaccatcatccattgctttggtccaggctaaagaagtcacaagatacagtgtggcactggcttggctggaaccagatcggcccaatggggtaatcctggaatatgaagtcaagtattatgagaaggtattacttgagtgaacaacactcctttcctttcttccttccttccttccttctttgttttcttctttcctttctccttccctccctccctccctctcttcttttcttccttctttcctcgactccttcccatcctcctttgctccctcccttctgtttaagggttagccagttgtaagtcatggaataccagtgaatcctcaaatcaaatgcattttgcttcccaattaagtatgattatgaaatttatcatttacttagttatcctgaaaagtagaaaataacaataatgataatacattgtattgtaatataactatatctttactttctagtaatggaaatcaagatagctaagaagttctaatctatgaaccttctatcagggagagtgactcataacagttgaaataatgatctgtttaagtagatcactgctattcagaataaagatgtgggttttgatgacttttaatagaaagtcagggaaggaaaatcacattcttcagcctcttaaagttatagaaaggcattatttttacaaataacttgtctctcttacaggacagaattttgaagagagctatttgcattcaaggttgtctagaaaatgaacagttgtcttctttttctttttaaagataatcacttattggcttccttattaaaagtagaaaagggacaggattttcccattgaaaccatgttacaacacattttacattttctagacagaaaatagaaaaagataagggaccttctcacagttatttcttttaaattgctgggtgtggaactagaaaagccaccaaccatcatttaatgttcctttcaaaaaaaaagagtaggaggaaagatctggatatggtcagcgtcaataacaatcatacctgaatttgcatttctttcaacaagtaagaagtaacaatagtacttataacatccaagagaatacaggctccagagagtttattcatctccatttactttcagtttctgagttgactggcttgactcctttaatattgcacctagtaagtaagcaggagatttattttgccaccttccccaattttatcttgccatgatgtaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggttacaaccaacacaggtaacaaggaccacccagactcagtcacttctgaggctatttttataatacagctgaatcccattacagtgaaatctaaggagttgtctgtaatttttggttcagcagacattttgctgcaatgaatatgtcttgaaataagttagccaatgtctgtaacttagaaaacttcatgtgatttagagaaaagcattttcgaaatactgatttgtcttttcctatgaatgaaaaatgttgcctatttttctcttgttttgagccttctagaaagcatgaaaaatgggattactaaactgacaaattgagggttacatagctaccctacattaatatagggaattttctccctgagaagattaaagaaggcgccaaaaatattttttacctacttatttttaagaatcatttaaatcaagttacataagcttttttttttttttaaagaccctttggacaaacatatcaaatctttaagcattgcgagttggattgactggttgactaaatttaaagtgcttaagaggggtctacccatgaacaagcattagtgtcagatacctccatcccggtaatcaatgaacccaaattgggcatgtttgataaaaagatgatagatttttgacttcaagaaagaaattttgttcacaaattattaaataagaataaaaggaaaagcagaagagaaagtagagttgaatctgaaggggattgacatcctttgaaattatccagcaagggtacaaggaggaagtggcttttgaactaggcaaaaataggcaggtttttgatagctctcggggaaggaggtacattcaaaactgctgccctttctgaaatgttcaagtgtctttctctctccaagtggcttcagaacactgaaaactgtgacccattcagaagttctacctcctaagactttcccaaaggtgacccttatgcaattgtcattcccagtgccttcccggatcattggagatggggctaactccacagtccttctggtctctgtctcgggcagtgtggtgctggtggtaattctcattgcagcttttgtcatcagccggaggtaagcactgaagccactcactgtgcagcccccgaccttcccagtgtttatgatggtttttttctcttccacacaaagctaaggcttttgattgcgtcataaacttggcatctgcatcccaagtttcctccttgttgctttgatcttcccacacccctaccaaagctgctagctgtaccctggtggcaggctgagaggtccggaaggacccagctaattgtaggaaacaaagctgaagagcaagccagtgggagatttctagatgctttaagctgccaggtgttacgtttatccctctcttaagcctggactcactgccaaaggcaagaaaaagccctataaaacttgggccccaattttgagctctgccatttgccagctactactacataaacctttttgagtctttatttctattctgtaaaatagagataattattatctgcctcaaagggttattgacaggagaattttgatacacaaaatagataatacagcacacaggaggtgcttcagcatgattttggttaacagtaatggtcactaaagcaaagaaatgggtacttcacactcagtcttcccccaggaaaagccatcagcatttccagacaatcaagggatttctagagattatcccttgagcaaatctcgggcatggcattgtcttggaaatgaacctgaaacatctgagcccttatcctctaagtacttacaatctgacttgatacttaaaaaataacctaaaaaggagagagaaataacaacagattggcagcatcttcttttgaaccagtttttcttactgtttttgtctccatttactcactcccatcgtctgcccagaggctccagaggagtagtcattgatatgtgccccacatctgggccttctttgtctttgatgtgtaagaatctgcctcttccctgatcggcatccccatataccatcaactgtttcacaagatggggctgttggtgaaaaaaagggctaagcctggggatgtcaaaaggatcctcttaaatgtaaagcttttcattctctagaagagggaagtagtcctaggaaagaagtaattcttgcccaagtttgtcgcattgccatagtggtaggctgagctgcttctggccccaccagtagctgtgcttggccctcaggccagtgtctgttgcattgtccctctctgcctactgatgatctcaccaatgtcatagcaatgcctttggctatttccactggcctgggcaagccactatgcttttactttcctctgatatacattataattagagtggtgaccatataatctagtttgcctggatggtcccagttggtacatgtatttatttaatttattaatttttttctgagacggagtcttgctctgtcgcccaggctggaagtacagtggcatgatctcgggtcactacaacgtctgcctcctgggttcaagcaattctcctgtctcaccctcctgagtagctgggattacaggcacacgccaccacacctggcagctaatttttgtatttttagtagagacacggtttcaccatgttggccaggctggtctcaaactcctgacctcaagtgatccgcctgcctcggcctcccaaagtgctgggattacaggcatgagccaccatgtccggccatgtatttcttaatatcatgctcccatcctcactctctaaagtgtcctggtatacagggaccaattatgttcactctaacataacacagtatagaaaaacacgttctgtacaggcatctgttttacaccgtgttcattgcttttcatgcacaatctatgaataggtatgtttgattagagtgatgagtcaaatcttgagatgttaaatccacaataaattctcatttctgtttctttaatacacacacatacaaaaacatatagacattggcatgccctctatattctaaacagcagaatatctcaacctttggaaacttaaggttgacctgcatagattttgaattcccactgttctttccttccctggtatttgattttgaaagccaatcaagatggccctctttcttgtacattgccatttagttttgtatatgtacgcatgctgtgcatataaccaccgggaactgtaatatccatctgatggtgggaagcaaggagcatgtgggggagtgtataggaattatatgtgcttttttgattttataattacatatttctatgtctgaaatgttcacagtatacagaaataatcttggttgttagaaaataaagatgtttaaaggtttaaaaacagatacaattcatgaaatacctccacctctaaaaatatttgataaaaattcagcaccctaggatgctcagagcacttctctgcagaaagtaggccttgccttgtgtcttgaccatctctttgacttgactggaaacattctctagttgtagtccagctttgctttagatttactttgcttttttgttttttggtataagtggccctaaatacagcagtcaaactggagtaatgagaaataagttacctcattgtaagtttcctttggatgttctgcttaaaacattggctttgatgaaaagaaaggaaaaacacatgaaaatgtaatgcggggagacaagtttattaaaagccgtgactacggaaaatagcatccttaagcttgatgacttaatttcctctctgcttttattgatcactttattatataaggcaggattgatagcaggatgcatcggatttccaattatgagtccccaccttagagaattgagcctgtcgagttacctagcgatgattcctgtcccttctcccccattaaaaaaaaaatgtcacttcccaaggctgataaacagtgcttggtgattggtcctcaatggatcactttttagaaaatgaaatgtcaaccccttgccctcatattgattcttctttagtgtcggccgtaaagctgtcatgggaaaggccgcccggagccaggtagctgacaggcttgcagcggctcatgcacactcagccaattcttctcctcacgcaggttgtctgctctgttatcttggactataaatgtttaaatgggacaagaacaggtgaacagagaggagacaggtagtggggatgaaagcctggctggcccaggcttttcgtgagaggacaaatgaaaggtggtacatggtactggcgaaataatcttgccagacttcagccagtagtatgagaaagcaacagattaaacaccctagcctatgaaatctgagtcatgtcctttgacgatggggctgctttgtgcttcttagaatcactaaatgtttatgctggaatggatgctacagatagatcccttatgggggtccccttgaactgactcccactctgctgatggcatgcaagattcctaaggaagtcaatggacagaaactcacgtagtgagaaagtttcagtccttctgatgacctcagagagaaaattgtcttggtgctaatttgtcatttaagaaagaggaagcagcctcaggctcacagttggtatcttgctagattttttttatagcaattgtttcatttatttcattgtacacatgcagcttatagggagaagcctgagcctaaggcaagccagaataatctacacttttttcagcgagatctacttttttcttttggccaaatggaacatgtaagcatttagggatcgcggtgaaagaatcaaactactaaatttataaaatacctaaaatgagatgttatactaggcacattgatttagctatattgtatatttttaccacccacatttatgttaagcaacttaattttatattttctgtaggcatctttgatctgtgtctttctcatcactcaagatataatttcagaattctttcagctttccagagcacataattgtacttgttatctaggttagtttaaggcagaacacttcttgtacctatatgatgctgtccctataaattttatttcaaaccacaaacaaatctctatttgtacattctctccagcaaatcaacatttccacatgtatatatttatatatttgtgatctccacaacataaccacttttctatattgtttttttaaaatgatctttaaaaggactgttcacagtgacatcctaaaatacaattataaggtcataacctccaagactaatgactgaatctatgctaattttctctgacaccctcttcccttttatagtaatgatttcatcaggttatctccaaaagcatcacaaactagtattaattcagattattttagggcagtgttttttccaaaacagtattaccgtattgattgattgattgagacagagtctcactctgttgcccaggctggcatgcaataactcagtctcagctcactgagacctccgcctcatgggttcaagtgattctcatgcctcagcctcacaagtagctgggattacaggcatgtactaccacacccagctaatttttgtatgtgtagtagagacagggtttcaccatgttggccaggctggtctcaaacccctgacctcaagtgaactgcccacctcggcctcccagagtgctgggattacaggcgtgagctaccacacccggccccaaaacagtattttattattcaaatgtgaaaaacaattttaagaaaagtctagaatacaagaatagcccctatttcttaaaggataacttggtagtgagggaaagtattactgataaccaggcacatgctgtttttatacgaaccttctaatgattgctagtgacagtgggtttccatttatgttagggttataaagtaccccttttacctggataaggaaaaagaagtgaattgattttaagaaaaaaatgaagtggttatggcaaaatttatatatatatattaggtactggaggcctaaagagattaaacaaataaacgaaggtcacatggtgagttagttgctgatcaggacaggaattcagctctcctgacttccaatactgggatagatatattattttaatatcttcttaactgacaaagttgacctacataaaaaagctgacattggcagttctatggaaccaaagcttcaagactctgctagtgatgttggtaagatttgtaatctgtgaattaatatgcaaatctgttgcacaatataaagtcagagtttgcaagttaattttctcctcctattgaaggttaagatattccactttggagctaagagttcacacaatgctgaaacagttatggttcagcctgtgctaccacacctggttaatttttgtatttttaatagagatggggtttcaccatgttggccaggctggtcgcgaacccctgacctcaggtggtccgcctgggccctaatttccttccctggaatattacaatcatgtgaaaatgaaaacacttaaatgttagcctaattcagctctgatgaagtcatgtaaattcacacaagtgggggcagatgatacctcgggaacatttctaaacaacttgcgtgcaaccatttcaacatgctactcatgaacaccatttagacatcattcggtgcaagaataatgacagcttaaagaaggagaaaaagaatggctgctgtgaatcttcatgggtgatgccgttcagtgctggaaagggacctcctggagccatgctagttacgttgctttatttttaatatgcactttagctgaataaattacttaccttttactaattagttttggaacagtgaaccacatcaatcaaatctgtccacttgaccagaaaagttagtaatttagtaaaagcatggtttatgctgggcccctgccttgctccccgtctctattttgtttgttatattgaatagtcaaggtgccaggaacagcacgttggttgagagggctcacgctgttctgcaacaatgtctgctaatacccttattaccatgtcccttggactgcaggagggcttagttcacactctttcaaagtttcacctgcaatgtgggctcttttctccaactcctgcggctgaaagggtccatgtttccttctggagcattcactaacaaaacactccactccttcccagttttaatcagcttgtccacatctctgtaattagaaaaccttcaacaaagttttccttctgtcattcaagtgatcagcctgagatgtcagttttgagttaggacttcttcaggcagtgtggcttcctgcaggctggctgccccagtggtgaacttcaatgggctttctttcctgggatgataatgggccacactgtcctacactgagccaaggcaaaagggccatcaggtgttaaaggtagaacaggacacaggcatttttgttttccaggtatttctaaaaagcaaacagactactattagcctttcaacagtaatccttgtggttttttttcagccatttcctgcagtcttaagggtcctctcctccaaataacactccacgtaaaaaaatctcatttaaaaacacaccttcaccactaatttaattcctccttctatgtttagaagtctgaggaagggatgggcgtgtcaaccttataattaatgacccctgtcattttgtatttcctctggctttgcacatatttaatgaatgtgcttgatgtaaaacagataaacgctttcccgggcagcttcaggccatgggtttctatggtatattccaggtttttgtttcattgacaattttaagttggtaccaaagctttctcactctatgcatttgtttttccttcttcaaaggaaagaaattcaaatcagtgttcgagatcttaagtggtttaaaagagatacttgtaattttagataatgcttttaggagctctgataagacacaatgtttcaggctggcaggaccctatcactcccttgggaccaatcgatggcattttcctgacataaaatgttattttagtagtccctgacctaacactcttatattcctttaaaagaagggaaaggacgggggtggagggagaggaagaagattggaggagacttcatcttttatagaaagttgtttggcttcagggtatttaaacctgtttagttacttcaatgaagcaatggattttaagagcaattgaattcactttaagtgaatgtactgatataaaacgtaatactacttataattaactctcaccaggtatccttatgtaactaatctccagtaagagaggctctatgaagtcgtgggctggatcagggctttcacaaagtcctgtacttgctaggagagcacgtggtgatcctcttgctccccaccccccaccccaccccagctccatgtcctcatctacagggaatctgagcatgtgtgtctgcctggttgctttcaaagggttgtcatgaagatgcaattaaataatagattctggctgggtgcggtggttcatgcctataatcccagcactttgggaggcctatgtgggcggattacttgaggtcaagagtttgagaccagcttggccaacatggtgaaaccctggctctactaaaaatacaaaattagccgagcatgggtggcgggtgcctataatcccagctactcaggaggctgaggcaggaggatcgcttgagccctagaggtggaggttgcagtgagctgagatcatagcactgcactccggcctgagcaacagagtgacactctgtctcaaaaaataataaattaaataaataaataaataaataaaaatagaccctttgaaaagttaaatgcaaaggaaaatgcaagcttatgatttgggactgaaatactgtacttcacagttagctgtagtcattggggtctctgttttgctaagttggttcctgctttgcaaacagttagggaaggagataatatatgagatgagagcactttgaaaagttaaatgcagtgtaaaagtgcaaggttttattatttgccagggaattatccccacggagaaacatctgtaggctctgagggtctgattgctgagctggttcttgcgctgctgacaattaggagaggaatgtgggagggaaggttggagcatgtgaccgggatccgctgcctctctggttgcactgcctggctcctttaggttctctgttattctctctttttcgtaatcatctgcctttctacctgttcaaagtttaagagttcagggtataggattttgacaggaccacactgccaagacacctggctttgcgggaatttttacttatctcagaccgtgtttctttttctgtaagagtcttgccttaccttgtctttgaagctctaagaaaacatagaatgtaaattccagtgtaaattgtacctttctgacagaaacataaatgtatacattttatttactaatttggtctcaacttcccaagctttagacagctgtgatatcaacggagttgactttctgattcctttaagtgatatatattctcctgactcactatgtatatatattcaagatttttgatttgcaaggcttgagttgattttccagtttgtataagagagatatatacatttctgattgaatatttatgtgtactgaagatttctaatccacaaagctttataacaaagccaaatttaggctattaaaagttgtaggagcagaatgccaggtttaagacaatgcaccattttactgaaagtgaattaggcaaagcaaaacaaagctcatttttacccttgctcatttttttacaaattagggaacataattcagtacaaagcaaatacttacttttaaacattttgttaataagttgggaatttgtatgcagcaactgaaaccagtgaccgcaaaagtattgtttcaagagtatcatgtaatatgataatgaagttttgtggtagtagttatctggttatagcaataatatttactattacctatcacatactgaacattactgccatttgatttacacagaattactcatggaaatttaatttagaatgtatatatacatatacacacatgtacatatatatacacatgtatatttatataaatggaaaaatagccaataaacttatcttcaataagataaattttctctgagagattttaaattataattatattataaaatatttgctttaacctattgtaagacacctcagtttaaaattgtggttcagaggtgtctgtgactgcttgagcttaaaaccatgactcactacccaggtgacaagtatttcatctcttgtaagtctcagttttctcatctctgaaatgtacatagcatacctgcctgacttacagtagcaaagaatttgtcttatggcatgtgttaaagcttaggtgtttgaggaaaataattctcttttttaaaaaaattttaatagacggagtaaatacagtaaagccaaacaagaagcggatgaagagaaacatttgaatcaaggtacaaaaaattggattaaaaaattctatttttagagcatgtcacacgttttctagtttaaacatgttcaaataatatttacgtggctattaatgttatataatataatatatttattccttatcccaataatgtacttcctaggtatcaaactgaaatgggtgatttggatggtgagattaaagatgtgggatgaggtagagaagtttctttagatttttactttttcttattttatcctctaccctaagaaagttatcagtctagctggctcattgttgtagctgggtggcaaaattaaatgggtattttttttaatctaagctggaaatttgaggaggaggaaaagaataagaaatgtaacagtaattgctacttcccagggaatggctatatgtgatatagaattagtgactgtcaataaatttttagtggattctaattttgatgttccaaagaggtcaaagaagacattaaaagtggctctagagtgacttaagcaaggtagaagacttttttttttttttttttttctgacggagtcttgctctgtcggccaggctggagtgcactggcatgatcttggctcactgcaagctccgcctccctggttcacaccattctcccacctcagcctcctgagtagctgggattacaggcacccgccacgacccccggctaatttttttgtacttttagtagagatgggatttcaccgtgttagccaggatggtctccatctcctgacctcgtgatccgcccgcctcggcctcccaaagcgctgggattacaggtgtgagccaccgcacccagccagtagaagacttttaaatggacagtggttggtgactatccaggagagctgtccactagaactttctgagataacattgttctatatctgcactgtccaaaatgtaagccaatagccacacaagctattgaatacttgaaatgtagctaatatgactgagaaagtgatttttaaatttaacttatttatatttagatagcctcatgtaacaagtcactcacatattagtgcagaaagatagaagaaagattggccgggcacagtggcttatgcctgtaatcctagcactttgggaggccaaggagggcagatcacttgagatctggagttcgagaccagcctagccaacatggcaaaactccgtctctacaaaaaataactaaattagccaggcatgataatgcacgcctgtaatcccagatactcaggaggctgaggcacgagaattgcttgaacccaggaggcggaggttgcagtgaaccaagatcctaccactgtactccagcctgagcgacacagccagactctgtctccagaaaaaaaaaaaaaaaaaaaaaaaaaaaagatagaaaaaaagagagggactgggaataacaagactcatcttgaagattttcttggctatagcatataaagtgatgagggatatgaagtgtctaacaactttccatttattcacctcgtttcctcctaaaatcatgttttttaaatttttacatggaatatatgtttttttaaaaagctgatctattaaaaagaagtagcaagaaattgccaatttaaggagcttattcctaaccaatggtgctgggatgaggacaagacctacaggcttggaaagtcgaagggactgggccaactggtgtccttcataccctctgtgccccagtgccccaacagctccaggagggagaggtgcaagtgccaggacaaagctttttacaatgacttctgcctcttggcccagatatctgtcactgggctgccggcaaacacatctaaatttagtttatgggtagtatgagatatggctgaatcatacttcctgatgtctaggctacaatgcttatctccagctgaaactttctggcaaacttgaatatcttagcttatgacaccttctttccaaaccagaaaagaagtgaggtccactacagagtctgtattctcaaatcaactagctgatattaaccttattgtctactttaacttaggtttaatctaattttgttaattgttggtcacatatttaattcatccagatattgggcaaaatgtgacaccatgtggaaagagctgtttgaaattaaaatgcttctatttccttccctaagggaggataactgaaagtagtgggtaggacttcatgcaaaggcaagggagctatgagcaactgcttgggacaatagtatttagctaacacaattcaaatttcctccatgggatgggttgttttaaaaatcttgtccttgaagtgtgaagacattccaggaagtcagtaaagctgcagcctcttaagtagctaacaatattttgtttacccactaatgaaaaccagagcaagaatttaaccattttcatatgtcaagaccgtacagctaacttgacttttcctatgtttggtaattttagacccagactatttatgtttattagtggttccttagaagtattcagccaacttatcatgtttatcactcaggtgtaagaacatatgtggacccctttacgtacgaagatcccaaccaagcagtgcgagagtttgccaaagaaattgacgcatcctgcattaagattgaaaaagttataggagttggtaagtgtctgagtgtccgtctgctaatgagtctgttttcttggtggatgttaaatatgtgtgtggattacataaatgcttttgtgagtatattatatgtgtgtatatacatgaaatttccttttttgagtataaaatatcatgtgttataaagaactctagtacaaattttgattttattcttagagagaaacttaatgcaatctgaaatcagattgattgcattcaaaagatttactctgtttcttactaactaagattttgtgtaggttttttgcattaagccttagttttctctaataaaatggggctaatagtagcatctacttcagggttgcatggaggattttgtgaaataatctatgcaaagcactagcaaacagcctggcgtgtaacaagcactcaaggaatgttagctgttattctttcatcttgaatgtgtttctggtccatcgtagattctttttctctctcaaaggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtacgtgggtcaccccctttacaaagccaagctagaagttactgggaaattaaacacacattttctttccagggaaatgacagatggcgcagacccactgattgctaataggaggaaatcagtgcaggacaagtcattaatcttgtagtcagctctaaatgggtctttggttttggctggataccctatctccaaggcagcttgtgtgagattttagagaaattaatattgcagatttgtggtatgccatgccatccttcagatatttgctaggccaaactgattgtcatagggtgggctcaagcagatggtaagcaaaataaaatttaagtacttttcctataaagcacaacaaaacctggccacaccttgtgctggaatctttggttccagatgcagagagtgaagcttgggaatcttgaatatattgcgggatttgcttgtctgctctgcctgatttatggctgttgcagttcagcacctatttacagtaacacctggttgaactttccttttttagtccattagcattcgctgagcctatgaaccacgcttcagttaaaatgcgacacagctcaacagatgcattttgtgaagcaaatcctgagtaaatctgtaaggctggctaagaccaacttataaagtgccacatagacagcacagctgaggcagtccctgtttaaggtggctgtgttccaagagccctcatacacactacagttactacaagtcaaggatctcataagcctggggctgtgtcccctggaaagccaaggcttttcttctttgattcaaggtgtctgtggaaagcatcttcagtcagcgtgtgcagagtaatggcaatatagccaccccagtgtgggggagcagtcggaggagggtaggttaaagagaaaaactgatgctgggtgtaatcactcatacctgtagtcttagctacttaggaggctgaggcaggaggatcacttgagcccaggagtttgaggctgcagttgagatgggtaagtttcctggacccctcgtgggacttgtaatggggtgtgacttgttttgcttggccaccgagctcaaacttcttgtaggagggggagcacacagtttagcacctgcaggagcctgggcgagtggttgccagtgacctctggagccccaggtgtatgttacaaataatgctcttttagcagttgtcatccacggatggctaagtgttaaccagctcagtggagagtcggggtgacagcctttttcaccctcccgtcttggtacctgggttcctgtctggtgtccaggaagaatcaggtcacatggacttgaaggatggtgaatgtgtaggttttattgggtgatggaggtggctctcagcgggatggggagctggaaaggggaaggaataggaagataatcttcccctggagtttgactattcctaaggtaatgcccacggtttccagtgttgaaggtggggcctttgcagggaaccaccctcttctacccagtatttccctgccgcctgtccatatcattcctagtgagctacgatagtaccactgcaccccagtccaggtgacagaggcacctggactctatttttttaatagaaacctgtctctacttaaaaaaaaaaaaaaaaagaaaagaaaagaaaaaatgagacattaggcctggggcaggtggctagtaggacacaaagtacaaaatctttaggaagaagaaatgaggtggttactaaaatgggagagaaagtacacactatacagttcaggggtcctcaaacataagaatcttctggaaagcttgttaggacagtttcttgggcctcctgctcagaggtttgattcagcaggtggtgtgcggcccgtaagtttggagtgcaagagagctcaccacaggtgaagccaatgctgctggtatgggaatcacgctttgagaaccattggcctggggacaaacgaccgcataccacctctgctgcttctaaagcttgtgaccttggactacttgttcaatctttctctttcagttttctcatctgtaaaatggaggtaaaaagagcatttgccttataaggttattttggggatgaaatagaatacttagagtggttaccacaatagcaaattttttcagaaaaaacctcgtacgtgttcagtggtgctattatgtcttaagaagtaggtacatctttccccatcttcagaatctttcaaaaaaaaaaaaaaaggaaccttggtgagaaggatatataattttccgcataaggtgaaggctataattagcatagaatagctctatttgctttttgagattagttttacagacaggatatttttctgttgcctgtggccttcagggccgcccagagcccttcactactttaattaaaagataacattccctttaaatacttttgcaggtccgttttctaaaaaggaggctctgttcagcttagggtgtttttcctgtcgcagacagtgattttcctagcacctctgcagaagagagaagaaacaggggatctttgtattaaagtcccaccgcgcctctaaaacacgtagctattacagctgtaactgttataaacgactggatgcatttgcataatgcagttgtcactgaattaaaatgatttaaaatttctattggagaagctattcccttcccccacccctttcctccccactgcatccctgcctactgcagggaaggagactcctctatccaagagcccagcccaggcctattttataagcccctttgcttatggagacattcatctttgtttcccttgtagagctcataaaggatctgacaaatggatacttttaataaacagaaaatggaatgcagaaaatttgtgaagatggtgccaagagtccgactagggaggtgtgagggtgaaagggtagagtggaagcgtgtgaattcattaccagcagttacttgagtaactttttaaattggcaggaggaccataaattctccgcatgaccctcacttttggatcctctcctgtcgtctccacagctccagagggatctggtgaaatgcaaggaggtgttaatgcacagccatgagaggctgccctttctcgttagttgacaaagtatcttttgattgaggcaggttgattaaaactcatttaggcacatttgttctgtcagaagactatggtcacaagctgggctcggtggctagtgcctggaatcccagctactcaagaggctgaggcaggaggatcccttgagcccaggagttcaaggctgcagtgagttatgatcatgtcactgtactctagcttgggccacagagccagaccctgtctcttaaaaaaaaaaaagaaaagaaaagaaattcacccaggcttgagtgcagtggcacgatcttggctcactgtaacctccgcctcctgggctcaagtgattctcctgtctcagcctcccgagtagctgggactacaggtgtgcaccactgcatccggcaatttttttttttttttttgagtagaaaaccctggtcacatatgtagagggtaaatgaatctgagaactaagcatttcctatttgtattgatagagaatgtgcagacacacccctgccagcgtagagaaaagacttaaaagtggttttatgcacctttggtctgcaccaagattcccactttttctaccagccttctttcctcacttgaaaataaaatgtccatggtaccattttctaatgcaaaagtgtttgcctctgagtaatttcttagacacaacaccaaaaactcaagcaatcaagaaatatcacaaattgatatattggacttcatggaattaaaaacccactcttcaacacttttgcccctaaggtgaaaaatttccccatgccctatatgccagaaattataagctgatggaatcactgggtggaaaatgtatttctttagaataattatgggtgcttttcagcggtgaaatagttcagcccatttttctagactgaagtctaaataatcagccaatgcagcaataaaaagtgtgattttttttatttttatttttttagaatgactctcactctgtcacccaggcttcagtgcagtggcatgatctcggctcactgcaacctctgcctcctgggctcaagtgattctcttgtctcagcctcccgagaagctgggactgcaagtgcgtactgcacccggcaaatttttgtatttttagtagacacgaggtttcaccatgttggctaggctggtctcaaaccccttgcctcaagtgacccacctgcctcggcctcccaaagtgctggaattgcaggtgtgagccaccgtgccctgccagtgtgaatatttttggtatatcaaactgacattttattttcttccaaaggaatattttagggacctgttttatcctgctcttagaaaaaacaaaacaaagcaaaaaaaaacacctcatgattcccaccctccacttgccaacaataaataccctttagaaagaaggaatttcagaccttgagcctattgcctgtgatcaagaaggtaaagaatggttcttatgtcctaaagtcctcagaaagcggacttttgtgaaaatcttatttacacctcattctgctcagagcttaaaatcatttttatttctttgcagaaaaaaaaaataggtagggggaatgggggaaataaggatgttctagtattgaatttaaattcctgtctcagatgaaataattttctgaacctttcctgtgactgttctggggtttttgtttgtttgttttttgaggtaggcagtttaaggaatcagaccaaagcaagtttattcatagctagggaaagtgaagagaaagacagaggccctgagctgagcaagacagtggagagaagtcgcatgcttgtttttttgtttgttttttgagacggagtctctgtatcgtcgccccccaggctggagtgtaatgacgcaatctcggctcactacaaccttggcctcccgagttcaagcaattctcctgcctcagcctcctgagtagctgggattacaggcgcctgccaccatgcttggcaaattttttttttttttttgtatttttagtagaaacggggtttcaccatgttggccaggcttgtctcgaactcctgacctgaggcaatccgactgtcttggcctcccaaagtgctgagattacaggcatgagccaccgaacccgcctgcgtgcttggttttaaggcttgtctgggtaaggaaggattcaacatagctactgctccctgaaacatggatttctctaaataaagaagtttattgcctattgacctccttagcttcttacaagtggctcttctgaggacaaaataaattaattatcctaaagattatttctgcattgaaacaggcctccccatttatcattttccccttttgcttgagagagcaattatccattcatatgctccctggataccagaggccactttagttaaagaccttgtcaacaagccacccaaaggtttaactatccagatggaatttaaacctactcgtccttttaatatttcattcctagctccccacagctgaggcataagcttggcttgttttaattaaattagatcacacaagacaggtatcttggcagtaaaattgtgcgcagcccatttttatctcattaagtgcagcgctcatcaaaggtttgtgtttttctttctgaaaactctaggtaaaccagtaatgatcataacagagtacatggagaatggctccttggatgcattcctcagggtatgtgactactttatattaaacccaagaatgttggtatttagaaaactcctaacagagtccttgtgtttgttgtgttcggtggtattcgtggatttcttttaatgggcaaagaaagaagaggagaaatggagaatgatgtgatttttaaggctattaaataatccatgttcaacgagggtagtttttgatttattcctgtaatgtggagctgttggagccgtagattcattacagttggataatttccatctatcacaggaagcaaacccagctcctagggtacagtctactagtgaattagcgactttggtcagaaaggcctggaaataatgttgagtttcattgcataccggatacagatacccaaaaagattcaagtaataaatgcttggtgagaattaacttggcctaatgctaatgagattgttcctcactccttttctatgcagaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccagggtaagaaagatcggtgacatctgggctttcactctggtgaaactgttcctctcttctcactttgagattgaagccctttgtaatttttttattttttaagttttctcatcccttgaagcctcctcatattcctgcatccatttttaaaccatgtttccaataaaagagggattttgaagctgactgtagatgtatgaccatattaacagccacaaactagaagcaaaatgaattatctttccctctatgtttttttttgggagggcagggggaagaaagtgctaatgaacaataagacggtgtcttaaataaaaatgagctgagaagcaagcattaaggatcagtttacacaacaaatgatcaattactgagaaaatcaggaggtagcttcacttatttatttttttgcacttgtatttgcctgcctgtcttcctgcctctttcttcctttttttttttttgttgttgttttaggttttgtatttgccttttttctattctttaaaaaaaatccttattctaaatgagacaaagcaatgtttctagttggttggctaccaaatctcagaatgtatatacaggatttataaaacatttataccatgcaaggttttccagtatctaatggccttcattttaccactggtagataagcggggattaggacacagtgaagagttttaagtacacagttaatggctgtgctatcttagctcgactatctgaatataaaatactaatggaataaacacagaatcataaaacagttattggccattaacactgacactgttaaaatcaacacgaagctgacagttaccagccattttccccttttaacactcttcattttgcatctgcaatcccaagcaatgggggttttttgttgttggttggttggctgagctttttttggaggggggcaggggggtatagtattctatttctttggctccagttttgattcttatgcttgtcctcttttgaattccaagtccattcgtttagaaaagaatagatctttgtgaatgttgaagatcttttattttttcccagtagttggagaaagaaaagttaaaggaggcttctagaatgatacatttacatagataaaaccttagccaaatatttaagcaggggggaatgcagtacaagtgtccttctgtgcgtaacaaggatgaatgcaatacactgggttttcagagtttactgcaatgtatcaaagcaatttccagtacaatttattgtcctgtttcgtagccctacctaagaaagcaaagaaaccttttaaatgatagccctggggatacctcaggggtctgaattagacttgaattaatttccccaggtggaaccctaggacattgaaaacctgactgaaaataccttatacctaagcataaacaaacaagacatttgaggcagaaaaaaaagtgtgttttgcaacttttcctgggtaatattcacttgctttaccattttacaagtcttttttttttaatttaataacaactaatatcctgcccttactccattaaagtcattaatagctctagtatctggtattatttggctttctctaaaggcctatttatcatatcatcccctagctattggacatatttctcatgctgtataaggggaggtagacttgtgtgatggatagaaatgttcatatttaaattccttcattcatgatttttgaagcagtgtaagcattgccttcctttgtgctcctgggtgagagaatccaacaaaaaatcaaacaaatgtcagctacatatcactgataccccgtagataacacgtattttgtaaaacctgagatttctttttttctagaatattgccttaagcagagctcagataataggtaggctttaaaaacataattagattacttagtcacttccctgtgagtaaagaaaacataagagaactgtgttaacctggaagacttgcgttaaaatgaacaagtgtcttattgttttgagagctatctcaagaatgctgttgtcctgcttggctagcaggaactacattcagaatctaaaatggcacatcagtgatgtacttaaggaataacttatggctcaaatgttcacagggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtaagtctctatgttctgaaatatattttttcacattgagattcaggaagttctgcattactgtatgatggagtgggcacggggtttgaaatgatacattaaactcaaatttcttaatacagatatatctagcaagctagttcaacattacaaccaatgactattgatttcaaggacaagaattaaatggcctacatggtacagtatgggagatagatacatacgcacatagattcatggataaaaaatatgggatagtatttttacttggtgaactttcaaaaccagagtaaaacaaaattaaactttgacttttaagaaaatgcaaagattatgaaaaaataaatttcacatatgataaaacggacatgaaaggcttattgaaagaaaactagtgaatattttaaagctggcatcgttgtaattagagctcaccccttgaggactctaaaataaagcttcactcaatgacccttggtaaattatgcacatccctttaaatgtaccatctggactacttcgtaagggagtatccacaatgactgcaatttcagaaaaggattcaataatgacactaataagattccagagtaatagaatttaattacaaacatctccagtgagaaagaaagaaaaaaaaataaaagaaagcattgatcaaggggtcttcctagaacacgttttagctaattctggaaaagtttacattagttctggtaagattgggaatcatattaaaattaaatggccacctatacttttcgaactttcctaattttttatgtatgtggtagtccattatcagagagtgtttacaaatgcaaggtattcagtttatcagttataattatattttggaaacttcttttcaaaaattctctctgtggtggaatgttacctatccatctgccttgtcttcctccaacaacaggcagttgcacagccttgacagttagagccacgtgcacttaagaaatgggatgcaggttgccttatcaattaaagaatgttcaatgcaggccgggccctgtggctcacgcctgtaatcccagcactttgggaggccgaggcgggtggatcacaaggtcaggagttcgagaccagcctgagcaacatggtgaaaccccgtctctactaaaaatacaaaaaattagccgggcatagtggtgggtgcctggaatcccagctactcaggaggctgaggcaggagaatcgctagaacctaagaggcagagattgcagtgagcagagatcacgccactgcactccagcctgggcgaaagagtaagactccgtctcaaaaaaaaaaaaaaaaaaaaaaaatacaaagatttgctgggcgtggtggtgtgcgcctgtagtcccagctactcgggacgctgaggtaggctaatcgcttgaacctgggaggcggaggttgcagtgagccaagatgacaccactgtaattcagcctgggccacagaatgagactctgtctcaaaaaaaaaaaaaaatgttcggtgcaatagagaaatgcactccatgtctggtggggcaaaaagaattctctatgctgaccaaccagattaaggggaatggtagtgttcacactgtattatctgtggattataacagaagattcatagcagatgggaagaaagcagctagcctaagtgatagtaattacaggttggaagaagactatggaggggaatagcatgtaatctattgtttatgtgattatgctgtgcagacagcttctagtagcttcttgtagccacatttggattcaggttagagactctcacagggacaaagacaaaaaacctaaatgagcaaatagtaaatgtagttactgtaattattcgatacttaagctttctttttcttccgttgaaatcatggccaaatgttcgtaagagcagagtatctaaagatgtcagtttttctaccctaaatatgttcagatctgtaattttggcagtttatatatatgtattttatatatatatacacacatatatataaaaaaacaatatatatatataaagaattctgttgttttgaactttcagttctctggctttatccacgaaaaggcatctgaagccatttcttgctcacaaataatattgatctattatttgtctctgtgttggattctatgtagaacaggaatcaataggaaatgtatctggggaattactttgatgcatagaattaatttggcatatggtaaatggagtgaaagtaactgttgaaaatatgtcaaacttagcaagttttttgtttagtttaatcctctgccccccaaaatatttagtagtaaactgagaaaatatgctttgctaacctatgagccatcttccaagctggcagtggatagggagcttatgaaagagcattaatcagtctgaggggttataacaatttatgttccgctggcatcagcccagtgttgctttcattctcctcaattcagtgcaaaatgttctcatcaagtctagagtcaacacgatgcacctgggaagataaaagaaacccaggtgatcaaactgacgtagtgtaattgctagaaacaaatagaataaggttcaataagacagcatagagaagtctgctttacaaagaaaagtaggtgatactgatacatgatattggcaaaatacataggagaaaaaggatcagagggcttaataaatcacaagatgatttgttaaactgaaacggtgctcttattaaaaagatcacagtcatactaatccatggaccctggacccaacagactcttttctttcgaaggccaatttctgagcagtcaatagacccaccacagggtgagtccagtgaagtcattgggatggctcaaccactgcttatttctctggcagctatcatgttgatagaaagaaaaataaatggagtgatttaaagcaaataaaacttttagactcccaaacaaataaaagcacctccagaatctcagaggatatccataaacaaaggtaatgagtagccaaaaaactgtgaagtagttctcctctataaatttggcatgtcctaccatattattttcttggaatttataccccaaagcagggggaggatgttagagaaaaggctataagaaaataatttaatgcctgtgaagacagattagaaaaattagaattagcaaagagactgttgaatgagttatttatgacttactaggcaaggagaccactctgggcactctggatggtcttggccaataagacaattatcatgtaccattataacttccttctttagatgtgcgagggtctcctttaaaatgtaaatgccccaaaagaaggaatttttttaattgttttttacttttttaaaaaaaatctacttactaacacctttaacagggtcgactgacagccaactgagaccaagaaagaaattcagagttggtgtctaggggtagagtaatccaaaagaaaaaatggctgggcgtctggacttggactctggtgttgacacactggctgtctatgtaagaggacagggccttaaaaggaggcaaagaaaattccattttggagacagctattaattgcttcccaagggaggtctttggcactaagtcagagtctcttttgcgaagagtgtttaggtgtgctaatagcagaatggagcggggcaggggactggaggcagggggcagggggcagggccacatgatctctgagggccgtcaccaaaactgacaccacattgtggatttgactgggctctagccacttgagaacattgatgcatcttccctttagagtacacctcagtgcaacagctggcttccctctcctgttgccagtgatactcaggtctagctttggctcatgtgaaggagttggagctgttcccaggctccagcttgctggcagcttcatgcacaagaaacatgccagtcggaagggtgaaccttgaacagcagcttgcctggcagcttaacataccatcctgttgtcttccataggtgattaaagccattgaggaaggctatcggttaccccctccaatggactgccccattgcgctccaccagctgatgctagactgctggcagaaggagaggagcgacaggcctaaatttgggcagattgtcaacatgttggacaaactcatccgcaaccccaacagcttgaagaggacagggacggagagctccaggtcagccatgcttacttaatagtgatgtatgaaagaacacattagaggaggcaggcaagtggtgactcacttaaattcctgccttttcatcagaggccacttcatggctctctgcaacctgggtggcttctttctcaattagtagagtatttcaggtagttctattcagcattttgaataactaatacctgtcaggcatcaaatagttataaggaaaaaactttaaaaaataataatagtaggaaagaaataactgaagtgcctattttaggatgccaggcctgaaatttaggaagaggggtgaaatgtacttttagaagacgttcagatcagtaggtgctatattttgaaatggggcaggaacactggaatagtaagaaataaagattagaaaacaggtctttaagcacggcaattttaagttgatttataaagtgttaattgtaagaaagagattcattaggtttcagttcttctggtttcccttttctgagtctttcagagtaggaggaaacagggccaagataggaaatgattgagttataaagcatgcagatgaatgtttgggaaggattttaaagaccaaaatgattggaccacctgaaagaggtagttattttcttggaatgagcaaaatgaagaagtatatcagtctgtagagaacataaagatactataagtcctacaagttcagtgagaactttctacatggagaatggactttactggtataagactcaggatacctacatatcagtagtctcatctgaaagggtgtggaccatctttatcagttaaattattttagaatacaggcataatagaccaggtgactcaggcctgcgagaggtgagacactcactcatctccaagtctgagcttctcacaggcttctgtttcatcatgatcctgtgttaaaaataggaggacattttctcccgtaatatttaagcccttccagtctttgcaggccctgtggtgttctcctctcatctttctcctgaaaacttggactaaagattctagaaaagaaggaaaacacattacatgaaaaaaaagagaactgtggaatagatagtagagataccctatattctccaccaggttttcaaatccctgtcattagccactacacaaaatgctcaatggtctatccagctcttttcaaataacactgaaaagggctgaattaacatttcacctctgccacttggtcactatgtgaactaaaaaaaattaaaagtctcctactattgtgaggctatttcttgttcttctgttctccaggagggtgaaatagatgactataaggcctcctttccagatctagctgacttctcttccaccttttagatcttcagcaccagagcccatgtattttgtctgagggtccattcaaggccagttttttggtgtttggtacttcttctgttagcataagtcattcaaccactactatcacatagcatctgctttgccccaaggtacagaacaagttgaggtattagatacactattatcagttctaaattctttttgctgatggtacttaaatagctttgaagcttattatggcttacctataatgagatgtagtataacatggtatgtgattcagcacaaaattaggctaacatcatggtgtgctaccaagagcacagaggcttccagaacaagcttaagaaccacccttaaagttaattgacatcgagtgaagatattttcattgtaaggtcattttgaccttgtcggtgctcagagcctacatcttcctcattaatgcttttggcttaaagtcagaagtaaatgcaaactattggcttttgtctaataacaaatattattgctatatatccacactcaattaaatgtccaaaattctatgtggtaacatttgttgttgactcaaaattgaaagaataattatatcttgattatttttgctgtaaacatttacagaattgtacttagaaaatcaaacttatattgaaataatggacacaaaagacaggttacaatggcaaggtattatttggacacaaaactgactgataaaacaaatctttgttaaaatatttatataaaaaagaaataatacaagtcaagtcaatttagataaaaatgaaaattttaaaaatcgaattggattaattctgctatgtagaaaagtaaagcattatatcgacttaattttgtttttacaaggaaagagttttttggttgaaaatttagtagtaatgatataattgtgatttaaatgtttgtacttaaacatagtatcacgttgaaaatcaggtcaaaatgttaagatcaaacacattctgtgagttttaggaaaaacagaagttcaaaaactatgacttaacaagtagcagtatttttctacaggttattataagtaaaggtagtataaaataaccccatgaaggcctgctctatggttattcagcaattgggtgatgaagataactaactataattctcttaatagtttttattagtaaatgattttttatatgtcaatatcattaggaaaggcagaattccagcctgtaattgcttgtgacagtgacctaatagaaaacacctggcctaagaaatgagtaaactaataaataagttaataagaagtgctttgaatttgttgaaatcattattcaggaaccccagcaagggaatacgagaagcacattccacaatccaaacagtgatcaaagtggccgttcttctgccagccttggcactcgtgctggtcaggcatggattgattaaagaggggattaactccctgctgtcccaagtttgtttgaatgccccaagcctgcctgtagactaggctggaagcatgctggacttgaattcttgctgttttctctgcttccatccagtctggcaggtggcaagctcgcagttttccttactcatccttcactagggtttccatagttgctgaacgaaagtctgtaatattcagtactggcagagactggactctttctgcaaagattgaacaggtttcggccatgagggctctcccagtcttcaccccaggctagggtgttaaaagacctgctatgagcatgaatgccctcagagggccacataaaacaagcgcaggaaatagaattaagaaaaaataggatgattgatacatgctttagcagctttgtgaagttaagagcaaaatattgcatagttacatttaacaacaattgttccatttaaaaccttcccttagcttttcagttctccttgcctatttgaggcaatcagatttctgagtcttcttgtctcactggtagctccgttctgcttatattttcttgttctctttctagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggagtaagtactcaacgatgtaacacgaaagggtaaatctagatttaatagtattttctttttttgctttgagctgcgtaatcatcctactcatttaaaaaaaatctggaatgcctctcattttgattgagtataattttacacagcctctataaagtatctacattcttgcattaaattgcttaatgaaacattttaatacacctgccttgttgtgctgtattaattgtggctgattcaaacgtgtgtctgcatgaagcccaagaaaagagattgtcagtccctgtgacttcttctgtcccttttttgtcgccctatgtacagggacctggcaagaattggtatcacagccatcacgcaccagaataagattttgagcagtgtccaggcaatgcgaacccaaatgcagcagatgcacggcagaatggttcccgtctgagccagtactgaataaactcaaaactcttgaaattagtttacctcatccatgcactttaattgaagaactgcactttttttacttcgtcttcgccctctgaaattaaagaaatgaaaaaaaaaaacaatatctgcagcgttgcttggtgcacagattgctgaaactgtggggcttacagaaatgactgccggtcatttgaatgagacctggaacaaatcgtttctcagaagtacttttctgttcatcaccagtctgtaaaatacatgtacctatagaaatagaacactgcctctgagttttgatgctgtatttgctgccagacactgagcttctgagacatccctgattctctctccatttggaattacaaccattgtattttgtttgtggcataaattacagtcatctgtctttcactggaatgaagaccatgcctaggaacattttttaaggactcagctgtggcttttagggcttggttcataccatgggggaaaaaaaagtcctaggagaaagcgacgtggctcattagtgttgcctcttcagtgctcaagccgcctggtggattcctatgacacagggggcctggaaagaaagggaaagtggatttaaaatatatatatacgtaacccaagccccataacccctaactggacaaatgaggtctgtttctttgggcctgaggctgtgccatataaagtcttattttgggactttacaaacttgtcctaactatcttgtggatagtgggctgtgacaatctggaatagagaacgttcacacttcgctcctttaaagaagcgaccccagatctgcaaggtaagtccaacaaccaagaatgattttttctccagtgaaaactccttttgtgctttaaacttgatctcattcgaaatactgaaaacagaaaaatactctctcatgtctctcaggttgtgttgatgtttttcaggatttcagtccttttttgacagcgaaagaggagaccaaacacagtgtggtttccctgctattcttccggggagaagtgacatatgacccagatgaggtcaggctctgagggatggtcctagatgctcactggctgttggctgtgtgctttccatcacgaagggctcctcctgtcctttggtgccattcattcatggtacacatatttattatcttctgggcaccaggcagcaagcacaggaggctttctctctaaccttgttaggtcatgggtcccgtcctttggagagtttacctcaatggagaagtactggcgagacttttccattagcctcattttctgtcctgctccaggaaactccatccccaaacagggccaaagaggattcaccaagatgccagtggtgagacttggaactcgcctcggctttctcatgatcagaaagttgaactactgaaaaatgcactgctcatccataaacctattagctttcaatgcttctatttttatataccagcattgagtttgttcattcctagaaacaaaggacataactttggactggacacattttaacttttcattctttttttttttttgagttatttcatttttatcacttttaaacaagagttgctgattttaacgacctttctttccccttggttgtatcctgaaagctatttcttatagagcaaggaatgttaaatttgatgctgtcaaatcatgacagtttagtgaaaaccttttttgcaacataagttgtaaaagcttttctgttcagaaggaatgtgaaatttgtttttaaaactactccaacaatttttgttttatcaccacttttgcagaagtctaggagttctggatattcacgttaaaagctgacaaatgtaggacttttttgtttcttttgcttgcttggtaaaaaaaaaaaattattattattattattattactatttgagacaaagtctcactctgttgcccaggctggagtgcagtggtgcaatcttggctcactgcaaccttggcctcctgggctcaagcaattctgcctcagcctcccaagtagctgggattacaggcacccaccacccaggcctggctaatttttgtatttttagtggagacggggtttcaccatgttgaccaggctggtctcgaactcttgatctcagacagtccacctgcctcagcctcccaaagtgttgggattacaggcgtcggtcactgcgcccaggtggcattgtattttaactaacaacagaatgttaccttgtgtacattgaataattaaaagttttttttttttttcttaaagtctacaacttaagacaaggtattttctaaacactgaacatattaaaagcagaccatttcaacagagaacatgtccattctgaaatagcctaacaacattatatactatgctggtgttgttttgttcctgctcagcaggtatttctgtaaatgaagtaatcagggaaggatcaaaggagaggtgaagtatgaaatcttattttattcaaaggtcaccgtctgaatcttcaaaatttcaacatatgcatatattagagtcaaggctgatgcaaaggccaaaaaaggactttccaagtgcctaaaataatatccagcaacagtaaaagtgttaactctctccactacctccatgaagttttagaagagaaatgtgagaacaataggaatgatgcattgtttcccagggcgcagagccagactctggcatccggacagctatggattctaaagccaactgaaatgttgacactgggaaattcactccacttttctttataactcagttcctccacctggaaattagagagataatgataccttaataataacacctttcctaatgcatggtgttgttgcaagtgtgtatgaaatattcttaagtaaaacacggtgagctccacagaagaaaggtacgcttcttcctccaacattgtccaagtattattcatctgtctttcacttgtaaccccaattgttttattacaacatgccagagtggggtgaaatgaagttcagtggtaggggggtcacacagtgaagcttcttcacttaaatggatttatgagagtttggaggtaaatacatatttatacaatggtggtagacctttcaagttatgctggcaggataaacatgcattatttagccttgacatttataaaattattgttttgtaatggggaagacagtgatacaaaagtaaaattctattgcaatgaaaagaactggatggtaaagacattttgatgtcatcacgactgactcaaaggaacaagcctttgtttatttagtcacaatgaattctccttaactcatgaccctacatagaccacatgctttgtctggtctctgtttaagaaatttcccatgataaaggagttgcctgaattcaatggtgaggagaaggcttatttcactcaactcgtatcctggcattaagtagatacaagtcttcacattcccttacatctcaattcaaatgtccaatcatttctgcatacacaccaagtccccaaattgcccacttaatattacaaatatatttatgtaatatctattgatatccagatgttaagtggagaaggaattggcagactgaaaggcaacacgtgtttatgagaccattctttctcctttaagaatttctagtagcaaaagaaaccattaccaaccttgtgtgtccgcaggacgtggaatacactctagcgttttaagatcatattcatgttctcctcatacttcacataaatacctgcccacctgatgaaatcccttcacattcaggtttcaaaaactacatttgatggatttgaccgatttccagagaggaaatagttagaaggtagatttgatgacttttctgtcatttttacgtaattgtcaacataacattcatgttcatgtcgacccagggaccacaggtgtgcacaaccatgcctggctaatttttttttttttttttaaagatggggtcttgctcttttgcccaggctggtctcaaactcttgggctcaagcagtcttccctccttgggctcccaaagtgctggaattacaggtatgagctacaagacctggccagaaaacgatttctctctctttaaatagactaaagtgttttctacaattttaaatatggtcgtttactacaaaaaattaaattttattctctacacgataaatgtacacatatgcaaaacagacaagtgatttgataaaataggcaaaataatctataaaagtgcattttggtcttaattactgccctttgcttgaggccaccagctgctaaacatggtcaccgtggtgggaggcatagtccaataagtaatctggatagttggttgttataaatgaaagaagggaacttacttcctttggtttgagttgattatgtgacaaatatatggacaatgaggagccatgaggagtccattgctgtgtgccagccttgttcgattccaggctgatgtctagaattccagcctgcggctgattagttcttgatatgtggaaggaggcttgaacctagaagacctctgtcgttcatagagcaagtatctccctgtgtcccatgttccctctctcctgcctgtttacatgtagagagtatggctctttcgccatgttagattagatacttctatttatcaggagttactctcttgttaagaaaaaccaccactttttttcacttcttagtttgcatttttcttttttttcttttcttttttttttgagacagagtctcgctctgtcacccaggctggagagcagtggcgctgtctcggctcactgcaagctccgcctcccaggttcacgccattctcctcctgcctcagcctcccgagtagccgggactacaggcgcccgccaccacgcctggctaattttttgtatttttagtagagacggggtttcaccacgttagccaggatggtctcaatctcctgacctcgtgatccgcccacctcggctcccaaaacgctgggattacaggcgtgagccaccgcgcccggcccttagtttgcatttttcaatcattattgttgactatgggtggattgtgaactgaaacaagtcaggattttcatttcatagacaggctgttcaacacggtggttaaagcataaatatcaattagaactttgtggggtctaatcccagccttgccactccagagggtatggcattgggcagggtacttagtctccttatgctcaatttcctcatccatataatggagataagaatagtacctatctcggagttgtaattaagctgttagtaaacaggttttttttgctcttataattgctatttttcagaaaaggaaagtataattcgtgatctcaccactgaactacttttactgaaggataccaacttctacgaacctatatattctttcttacaatagtggttgacagttggctcgcaatatgggtcgacgttttgtctaaagtcttgctcttttatctacagggagtagattctgctatcttggcctcacagcccttcctgttgattacaaagcccgtggaagaaaacagaacacaccctcctcagttccgtctaaatgtgtttcttctgcttcaattacaccagttctggggcaaagacactgatgaaacaacacccatacctgaaaagaataaatgtgtgactttcaaatcccctttcgcagtgaaagaaacagcaaacacttaagattcagcatctgttctccagttgcactgaggaatgcactgtctcgcagcaccagctctgcagagcccttgccccagactctttgcggttttatttatatgtatttccatatttcattcctgtgtgtcactgctgcattggtgtggcagcaagtgaccaaatgctacaggtcttactatggacaccaggtcaggtgcaaccacacaaaacaaagccagttccatgagctgcctatgatatgcattgcggaagtaacattttacccagggtgtgccattgcagtgatataaatatatttttttcttagactaaatatgagctgactatctcttttgatgtgtgtacataggtgtgagtgtgtctgtatgcgtgcctgtctgtgtgcgggtgtgtgtatgtgcgtagcctcatgcttaggactacccatgaatgttgtggaatgctacacctggagagttctggttttccaccagtttcaagatgaagaactacatgatacagtggacctggagaccatccccttggaaagacaacccagagatgttcagcatcctgtatctacacgcatcctgtatctacacgtgtattttgtagctgtcacactaaccttaataagaattctacagctttggacagaggcattttcaccttaatggtgaagtaatttaaaatataaatccattcaggtgacaacccatcatcaaaattacaaattttctgattgaactcatctgaatcatcagttccttgatggagagagagaaggagatggaatgtgtctggtaaccccaaatggagtacaagtagcctttgttttcctgcataaatggacttgttgaatgcgaacgaatatatgcaattcatatacttttggagatgaacgtagatatgtgtgtcagctttgagatggtgtgtcctggattaatactttgtctcccaatatcacagaaaaatacatgccagtgactcttgaggttaaggtagttgggatgaaatggcctcaggcaatttcacattccctaattacctggaaagttctacagtaattaatatgcagctaactcctgttgccctcacaagagcatcagccttctagaatcggagctccggagtgtgaagattcagtattgatatgatatgtataccaaactccagccaacttactgccatttttcataatctgagtggctgccttgcttatcctaagctgtggttgcagaaaccgtggccatttatataagctataacatcaaatcagggaaaaatgaggaaaaaaaatagattctgaaccatttattgttgaataagtagagaaaatcatcaataaatatttattacattctgacagggtgtgtggcattgtgttctatgccagagtgacaaagttgattcacccctttttggggaccttaatatattttttaagggatgtgcctatgcattgatgcctgaaaaatatgtataaagaaatgaggttgactcttctgagcagttcatcttttccagaggtaagggtaggaggccaacttcagggtctgggtctgagcccgtgggcaagccctggccgagtgagctccaatgctaactcatgtgccgatctctagagcagtgggaaactaccccgctgcaccaaatcaagtagcttcaccttgtgtatgcaggccccaagttattttttagcaatcttacgagtgaaatgttctggtgggttgaaaaacgttcttattttaaagaaaggttgtgctcgctacactgctggtgtgtgcattctgagacctcttgtattcaatctgtgaaggatatgtgtattaatccgtacacccgtatagcctcaatatttgtctgaagacacttaaattctgacccataaaggaaagttctagaagcaatattttcacttatttaacattctccaaacaacatcaagcattgatacacactgaagagtgcgtttattttttgtatcactctaagtatgttggaatatgcaaggactgtggttcaaattagaatgtataaggcatattataatttagttcatactgaataagaaattaacagaacattgttcggttcacacgttccaaactttgagtgatttctggagttagacatagattttctattttgttttaatttgtcaaggtatttttcttcccttcatgaactttaggtacacataacttatgtcatttatttatggtcttttatacctagtttgtaaaattgtaaaatagcaaactaaatgcaaagagtttgcatttgaaaataataaagtagttgccgtatacaaccctgcaa

SEQ ID NO: 8 - DNA, 204493 bp, Homo sapiens
cattctgctggctgcgcggtggcggcggctgtgtgtgcgccgcgccttgccgccccccctggccccccgagcccggggcgcgcgctcccgcccgggccgtccgggccccgcggcgccgcggcccgaggccccgggaagcgcagccatggctctgcggaggctgggggccgcgctgctgctgctgccgctgctcgccgccgtggaaggtgagcgagcgggcgggcgggcgggcgatgggggcggggagcggccgggcacgggcggccgccggcgcccacctccgctccgcggcccgcaaagtttgcccgggggccggcgccgggcgcaggtggccgcggggaggtgtgtccggccgcgccgggaggagcgggccccgcgggcgcccggggagcggcgggcgctgattgactgtgccaggaggaggcgaagggaccatcttgccgaggctttgtagccagcccggcgagcgccgcccagggctgggggctgcccacgcgcgctcgccgcccccggctcgggcagccgcctcgcgccggcctggtcttgctccgcacagggtggaggggcgcgggcccggccgtggcggggggcggggggggcgccggcgctcggtcggggctggaaagtttggcagggagcagagggagggaggcaccgcggccggccggggtgggggctcccggcccgcgcccccgagatggggcccggcgccccggagagcagggactggcagagtggaagggagcgcgccagcccccgcgtcggtgcctgcccatcgcccgcggcgtacaatggggtcccctccccgagaggactgcgcgggggatgggtctgtgggcatctctccgccgcgcaaggtctccgggcacccccgccggccaccgccccgcggccgcggcgctcagcgtggcggctggagccccgggaactctccagctgccgccggggccggaccagatgctcttgccatgtgttggccttggccagggtcgcgggccctctccccgtggcctcgtgtattggtaccactcgacccccaggggggcaagggtagttgctaggtctcccgagccagcttgctctggagggaaagttagtgcggtctgggtgtgtccaccaggaatggccgagcttgcagggcaagaagcgaacgtgaataatggttctcacgtgtactgcactttacagttttcaaaccactttacagtttatgaagtacttcgcactatacgcagctctctgtggtttacaacgtgctgcacagttgacaaggtactttaagctttacaaagtgctttcccgcccaccagcgtgttggatccctcaaaatacaccttccggggaagacaggtaggtatgattcctacttctcttgaacagatagggaaaccgaggttctgaaaagtccgatgtctcacccagggccgttgggtgacaaaaatagaacccaggtctgtggtctttctttgaaaccagcactcacttagctgggttttgttgcccctaaactgcgtgagcccttccagggttctgctcccttgggcttagggatgatgtctgtgtgcacctctcaggccactttagggttgtggggcgccccttcccttcttgcagcctaagaaaaaacgcatatcagaccagacgtgggggctgcggcctctgggaaaggcgtcgtgggggaccctgtgctacaacttcagtttctctttcggtaatgagcactttagtgaccgcagtcagggggtggggggtgtccctggatggcagccacagtttctggcactgaggcagctgtccttcggctcctgggggatttggcggctgactgcggtttcccggagtggggccactggggcacctagggtgccacgggccctgggtgtggagggcagccctggggcctggctgctggcgggagctctgtggaatatggctgaggtaccacttattaactctggctttggggaaatgactcatgcgttggcccgctatacattgggatgtttacagtattatggggagcttggcataaatattgctatttaggttgcagtcagcggtgctggaggggaagaaaattggcccctctctcgttggaagaggcctgggtgtgtttttaattactctggggtagatggaagggccacatctgtccagccatcgccctggcagaggctggttggaatctggtgggctgtggccagcctggaccctggccctggacacagggctggtgggcgctgacgtcacaggagggtatggctacttggactgccacttgggggcagggtggggaagggaagccacagcagggtgggaggagggctgcagcaggcaccccaatgcttgcctcaggctcttgttccgtttgccccctggacactaggaagttagtccatcagtggttaataaggagctggccgaatggatggggagatggtgtgaggtggaggtcagagggcctgcttctcatttactatgggaccctgggccaggtcccttccctgtgggggcctcagtttctctgggtgtaaaatggcctggctaaatatcttgtagagtccatcgtctacgccctacttcccctctttgagcctcgttttcctcccccgtctagtgagagtgatgacagcgcctgtcctgcctgtctcctggggtgtttgtgaggatcagaccagatgatgggtgggagaagtcccccttcaaagccagggatggacggtgctgcctgtgcacatttggggggcggtgctgcctgtgcacatttgggagacaccagggtcctcctgagggtgacacagtctgtggagacaggactgggccgtggagcagtaggagggtggcccctctggctcccagaacccagagccacatggctaccacttccttcccttcctccttccttgtctcctcagcccgtaaagggctgtcctgccggttaagtccccaggaaatccccagctccagccttcggaatgggggagaggagagtgtgtgtgtatacggggggtttctaggttaggacggtaagcttagcatctcccccaaactgtgagaccgccccccgaccaagtgaaagaaagcatggagcatgtgaagtggcggcgagcaggatggaagagcactggggaaacgtccaacaggacaggaggccggtggcagaccctgtccatccctggccgatggaatccaaaggtcaaggtctcaagaaaacagcctccttacatctgctcctttgctctccaaatatcgatagagtttcctctctggctgacagggtgctggactccggggcaggcaaggagacgggacaagctgacagggaaaagagtgggcgagacagagcatgatacggggtccaacgtacttcccagaggaggctgtgaaccccccggggcggcaggtgcacttgaggacagaacagggttatttcatcttttatgctgttatgcattgcctcattttctcaccacccattttccctgctatgaaactttcttagccacctgtcatgctaacgaactgtgttctcaagagttaaagaggttgactttagaacttataggatgtggagaattttacctaaaaaaggaaatagcatgtctatatgtccatagaaagacatggaggcaggatgatcaggtgcttactttgatgtgtctgaggagggtgggtgttgagggcagcagtgggggttgagactgagaatgggagtggggtggtcaggtcctgaagggctagaatggaaggctggggagtttggatcaaatgctgagggcagcagggagcccttgaaggttcttgagctatcaagggacctggccagattcatgcttggaaagatcactgacttgcaatgtgtggtgacgttcagatgagccagatctggtcctggacagtcacagtaaagccagcttgtcggttcccggctagactgtgagctccctgaagacagagacccatctggctcatctttgtgtccacagttctggtctgaagagctctgttcaaattccacctccccagaggccttccctgattctctcttctaaaacagacccagttctgcttctttccatcccacctgctttgttgtgcttcatgaaacccatcgccacctgaagaagcatcaaagacttgtttggcatctgccttgcccactagactgtaaactccaggacttcatctgccatgtttgctgtgacatctccagtgcctagaactgtgcccagccatgcgggtgctcagtaacggaatgacattgtcagctgaggaacatggaatgaattgaatgttgagtgaatgaacagatgaatatatgatactgtgttatgtgataagtattgggagaatgatatggagatggagggaagtccatctggcagaggaaatcaaggaggtcttcctggagggagataccaaggggatggcttgagtagagatgcaagaaagtgctggggataacgaatagaccagttcagagggagcagagcattcagatgggccagcagccactgtgtgctaggtagacaagtccacttctgatggggggtgggggaagcctgcctccctccctcccccagctcaactctcccaccccaacctctaccctactgggcccacctctggggcattacctgtctaagacccagcgaccttccatgggattaatttggaattggttttccttttatgtctgtttcttttgcttctcatttttaaaggaggctgctttcatgtatttgtcttagccaggaaatcagggcttagatttaaaacctaaatgttgtagaatcagaaagccagttgacttattcactcattcatttctccatccatccatatatttttaaagagtcaccaggcacctagttcatgtcaggggctggttgggagaagggattctgcctgtggtggggaacggggccagctgacttcacaggcagtgtgtggtagagaaaatgcatagccttcaggcgcaaacagacgtgagttcaaatcccagctgtgtgctctggggcgaggagcgcagactccctgcacttcagtttccccctgggttcctgtgtcagacactcattaaatgctgtggacattaaatgctggtctcaacccctctaaggtccttccctcaatgatggcgacgtggccccctttttggcatttaatttgtccaggcaccagatcagccttcagtgtctcccctaacccaccccacaagctcccaacttcccccagactcgggatggtaaccccccaagtgtggacagactcagactccatccctgcctctttctccagagccccatcaggggaaaatactcagattcctagtccagagggactgtcatctggggtccctaagcctcctaagtcctggggatctttgttcaccctgaaattgtcatagaacattggatgggccccctccctcctgtgggattgtcctaggccctacttcctcaaggctcttcatcagcgccaaagtggggacaggttctttttttttttcgagatggagtctcactttgtcacccaggctggagcacagtggtgccatctcggttcactgtaacctccgcctcccgggttcaagccatcttcccacctcagcctccggagtagctgggactacaggcatgtgccactacacccggctaatttttttgcatttttagtggagacggggcgggggttcaccatgttgaccaggctggtctcgaactcctgacctcaagtgacccacccaccttgacctcccaaagtgctgggattacaggcctgagccactgtgccctgcctgggacagattctatgggccagtttgctgggcattcagcccgtggtagcctctggtcaactctgcctgcccagagctcacctgtgagtttagactggagactggacctctgcacatagaaaggcccctaacaggaaggggcagatggagcctgctggtgacaggatgcctgggctgggcaaggcaggggacccatgctcccactgagggtggcggagatgcagagcacggtgggcctcctgacgggaggatcttccacacctccgaccaaggacccgtctcctgacctggcacctgcatgcctgacttagctggagatctgggagatggggaacaaggttggggagtctgtatttttaacatactctccaggtctttccattaggcaggcaaatttgccccccagcggcctatgataaaacacaggactcctgggaaagaggaagagaaacctcagcaggaaactggaaaagactgaaatgaagtgaaatcaatcagagttagcgcccaccagccctggctgccgctggctcgtgcataaaaagagggttagctgggggaaggcagggaaggaaagaatgtttgcacagctcccaggggtggggcagcaggccaggcagttgttgattgtggcagcacctggaggctccctgattgggatcagctcaggccttctgataaggctgccttgaaagcattttagggccttttaaagcagctgccttccggagggtgcaggagggggacacctgtctccccagtacccccgtgtcatctgggggcttgcctaggacaccctcactaggtgagcttcctggagccatctgcccccctgctgcagcccctgtggggtgggagtgtcctcagaagaggggaccttgcctgctgtgtggccttgaccaagtgatccactctctgagcctcagcttcctcatctggaaactggagaataccgcgcatgtgtcagaggctcatggcgaggattcagtgagatgctgtgtaccatgactggcagaactgcctggcactcagctgtgtccattctttattagtttccgtaaccattaaatgtcagcagcaccctcgtgcccctggccagaatgacttgtccctttctctgaagtcctacagaggctttgcttagccctgatcactttctctcctgttctataaacagcagagcctgggggttacaggaaatgtgtgtggagtcagactgctccgtactgtgtgtcctctggcttgtgttttcacctctctgagccttggtttcctcatctttcaaatgggggtaatcattgttcctagctcttgagatggttgtgagcaatggatgtgttaatctgaggaagactaagctgagtgtgtgcctcaggtgtgctaagcttgcaataaatgtgaacggttgctatccttgctttctaccaatgggaagctcaattcacagtaggggaacagggggccagtgtaccaggtttttcatctccagctctcccccacccactgtgttctgagccttacagggcaagggtctgactggcttgccaagtagctgagaggcccctccagcctgcccactcagggtaccatccaggttttctcaaaggccccctccccactccaattcagcctccctaatctgggaaaggggtagactccttcatggctgtaccctccttctttgcccagtgcctgccaggcaccaccttccctgccatgatcatgggaatggctgtcaattctttttttttttttttttttttttgagacagagtattgctcttgttgcccaggctggactgcagtggtgcaatctcggctcactgcaacctctgcctcccgggttcaagagattttcctgcctcagcctccctgagtagctgggattacagatgcctgccaccatgcccggctaattttttgtatattttagtagagatggggtttcactatgttggtcaggctggtctcgaactctgacctcaggcgatccacctgcctcggcctcccaaagtgctgggattacaggtgtgagccaccgcgcccagcagctgtcaattcttgtgccagacattgtactaacagcattatgtgtgttgccttgtgcagttgccccaagagccccacaggtcgttgtattattgtgcccattttacagatgagaaaaccaaagctctgagaggagtgactggcccaaggacacctagggagtggtgaggcagcgattgaaacccaagtctggtgactccagagctcatgctcttctccacttctagaatgtgcctccctgctcagaggaaaggcttggctctgatgagggtctctaaggcagctgtccagcttccagctccatcaacatcctgagataatgcaatgggagggttctacaactcacaaacctgccataaaaatgcaatctctgtgataatggtcagaataatgttgttctaacttagacaaatcgggtgttaactcattatgttgtaaggggcgcctccacagagaatggagactacgaaacagtcacagggccatttgcagcttgtacttccaaatacaatagctcatcaggccttcacagccatcctgaaaggggcaggagccacggggcccactttagagatgaggaaactgaggtctgggagataatatgactcgcccaaagccagcagcgggaccaagcttgaagcccagggccaatcttaatagctcatctatccagttcaaattcttagccaacatttgaaaatcaagagattttacagaaaagtcctgtttctggcgtttctgaaaagtcagacaatctggtttcacagggcccacattcccacatggccacagttggctggagtgactgcctcttaagacagaatgtgtgagcaccaggggtacctctctactgacttgcaacatacatttgtcttggtgtgttgcaagtcggtggagacgtacccttggtgctcaacccctgtaagggcttgagtttgcctcctggatctgcccctgttaccctgtgtgacctggagtcaattgcatggcttcccgagcctcagctctctcttctataaaatgacaggggtgagactcagtgattttggaggcctcttccagctccaggattcagtgcccattgccagggttcaggggttcaggcaagggaagggagagctacaaaaagtacaggactccactcctgaaaagcatatcacttatctttagcaagccaccacaaaacctactggcttaaaacaataatgatttcttagttgtcctgattcagtggattggctgggctcagctgggtgcttattctgttccccgggttgtcagttgggatcactcaggaggctgcactcagctaggttgggctggaaattccatcgtggcttcacatacatctttgaggccctcatagagaaggctggaaggctggtccccctacgctcctcgctatctcccatcctttgctagtctagactgcgcctctatccatggcaattagctcccaagatggtgaaatggaaactgcaaggcttcttaagggctgggctctaatgtcacaaagtgtcacccctgcagccttctgtggtggtcaaagccagtcacaacaccagctcagattcatcccaggcttcctcatcaggttcaaggaaaaggaaaatatactgggcttgatttttttgttttatccttgaagagaagtcccatttcttgctcagctgttcagcatggaaaatttaatggtgggttatccagcgtcccactcaacatgtcctgacccactgaatcaggtgacactcagagttcagtgcccgcccctgcaccctgttgttgtccatgtttcttgggccaacctgtggtccaaacttgaatctagacgcccccttactgggaggagtggcttcgtgtttagtagggggaggaattgttggcagccatatttggagacagcctctcacaggtagtttatcgtccagtccagggatggcggtggggaggcaacaggaagccagaaatctcattcccccccccccccgccccagcacttacccccgaattgtcttcagtgttatctgcctcttctgagaaggcagggactttccacttcactatgtacagcacaaggcttggctcatgatagatattagatagatgtttgtgcaataaacgaacctaaaattcatgaaaaatggcagcctggagttgtagatattcaagacctagtatgaggtgtgaggccagagaaaggggccttgggctggtgggattgaactgaaaagatgggtccctggtgctcctgtggcctggggcaggtcacttcacccctctaggcctcattttccttatcagcgaactgggcatcataatttcaggcactacagaaggctgtgccgaggagtaactgtgttcttcattctactatgaaagaccgggtaagggggtgactggttgtcactcccaccttggccagaggtcatcgcaggagtggggaagcattagaggaaaagaaaaaattctaaaggcatgggccagttattgtcaaattaagtttggaccacaggctggccccagagcacatggaaatgtgtacaaacagtgaagtgagtgggtgggaccactgagctctgagcgttgcttccaaagacagttgagggggacctgggcaacacatagtcaaagttgacgcattaaaccattgagcaagaaattggccttctgtttgctggcagaccaggaaatctggcctaacgtaataccgggaataaatcacaagagtcttgatcagagactccagacttgtgagctggcctgcgttgtgaatgagtgaggtgacttgactgttggaagtataatagtgcccccagtaagagcgcatgtccagtctaaaaaaggcaggtgctacccactcctgaccatgttgtcacacaggaatctgtgtccggttttgccacatcttctgatttgcaaagttcttttttttcctctctcttttttcttagacagggtctcactctgtctcataggctggagtgcagtgacgcaatcgcagctcacttagccttgacctcctgggctcaagcaattctctcacctcagcctcccaagtagctggatccataggcacctgccaccgcatccagcattttttttttttttgtagagacagagtctttcaccatgttgcccaggctggtcttgaacttgtgaactcaagcagtcctccttcttcagcctcccaaagtgctgggattacagacataagccattgcgcccagcctgatttgcaaagttctgatgcttatgggaaaactggtttttgttttgttttgttttgagtctcgctctgttgcctaagctggagtgcggtgacactatcttggctcactgcaacctctgcctcccaggttcaagcaattcttgggcctcagcctcctgagtagctggaactacaatcatgtgccaccacgcctggctaatttttgtattttgagtaaagacaggcacctaccaccatgcccagcattttttttttctttttggtagagacggagtcttgccatgttggccaggctggtctcaaactcctggcctcaagtgatccacctgcctcagcttcccaaattgttgggattacagacgtgagccaccatgcctggtctgaaaactggtttttgaatgtttactcattttattctaaaatacagttctggccaaaccaaaccatgtttgctggctggatttggctcactggctggcagtttacaaccttaggtatttggggtaaagaaatagcaagggtattgttagcaccattgtacaaatggggaagttgaggttcaatgacttactcaaggttacatagctgttaggcactgggaggtgttaaaacatggctcctcaccttgaaatggggagtctctttccctgtaacttccctgcatgatccctgttttccacgctccagaacaatccaggaacgtaagagccatcttgcaggcatctgccatgtttgaaggcagaaagcatgtcttccctaggtttcttcttgagggaggtagagttggcagaatgaatgaaaagcagcgtggtcttagactagaaccatgctacgttggacctctggctctgacacttaacagtgttaccttggccctcttagctctttgagcctcagcttcttgaactatacaatgaggttagacaaggcgtcctggaagaggcgacttctaagatgattcttaaggaagagccaggtgaagaagcagcaaggcagccattccaggcaacaggaacagcatctgcaaagatccggataggaggcccgtgagtgtgtgatgtatttggggagctggaaggagtcctgtgtgactgagaatggggcatgccaagcactggggcggggtgcaagctgcctggccccagcagggagagagcgtggggtcaacattcccattatggcgacgacatatgtccacggcaccaacttgtcacttggcctgagtccatgggaagccggaaggacaaaaagcatctgaaacgtgtaagtggggagaaagcggcttagcgcacagtgggatgcgtcccgcctgaatggggcttctccgcctctcacggggaggcagagcctgggaacagcctcgtccagagcccgcagggcctttttggaacccacgaaaggccatggcccagggagtctgttcgagtcagggctctggccggtacatcctcttgcctgtctccgtcagcgtcagctgtcactccccacggcctcagatggcagctcccgcagctctcgggagaacagtggaaaagggctcctgagctgccaaggagcccctgacactgggtgcccctggctggcccggaagcacagccatgccagcaaagctcaggactccctctgaccagccccttctggagttgaaagggtgatgaggctgggccccttggcctgaggccaggagagggaggagatatcgggggaaagaccctgaactttgtagacttgcagaactgtgttcaaatcctagtctttccactcactggcggtgtcaggggcaaaccatttcaccctcttcagctttagcttctcatctgtaaagtgaggatactgtcacctaccccatggtgttgtttgaggaattaaaagagctaatgtatttttttaaagcagttgttttaccaagcctctctcatcctcagtatctcagccactcaaaggcaataataatagtagtaataataccagcagcaactagcatgtattaaggacttgctaaggagcaggcactgggcttaggtattattgttagctgaatcctacagatgaaaaaattaaggcttagagaaggcattcatgtacccatggccatttggccagtaatggtagagctaggatccaagcttaggcgtctggctccaagataaatggagaaagagctgatttcttttctttttcacatttcaaacatacagagaggttgaaagcagagtaaaacacctgtctagccttcacctagattcaacaatcatcaacatgtttaccacatttgctctcctgtgtgttctcactccctctgctcccctttcccccttgcatgtgtgtgtgtgtgtgcgtgtgtaatgtagagatatatattttttctgaaccatttgtacataatttgcatacatggacagagaactaacatttactgataattgactcgtgttgtctaaggccagctctctaacccctgttttagatcactttgcctggcacacagtaggacttgagtattggcagcgaccaggaagagtaactggtcttacccgcagcttaccaagtactccccctatattagctgcttctgtcctcacaatggcctggcatagagctcttggtgttttcttcattttcagaggagggaagaaagactcagaagttaaataactcgttgcaaaataagaagttgggatttatacctgggtttgcttggcagcaaagcctgtttcacaaaatcttagggcacccacttttctccccctcctgggtttaaccctattgtagccatcagagcacagcccagagcagcagatggcagcttcccacccagctgccgcaggacatggccctttctctctaggaatcaagggggaattatagagtccggtggacttggaaaaactggggactggcccagggatcacagctaaccaagtagttttgaggactcaaggctttgggctcctagaatccaccatactgtttcatgttgctcctccctctcctccttgcctgggtacccttttcaccatctctccctggtcagttcttgctacctgttaagatgaagcttgagcatctcttcctgtgtgaaacctgctctgatccctctcactggcccctcccccttctgctcttggtggcatctgtgtccttggtgtcaccttgcacgcagcccttttatattgcctaggttatgccataccatgtataggtttctcccccaccatactgggagattctcatccatgctggttgggtagtgtacagttagacggttggatgagcagctcagctgttggatgagtggatgagttattgatggttagatggataagtggctggatagataaaggataagtgcatggattggatggttgggtgaatgacgggcaggttgatggtgaggtagattgttgagtggttgatggttggctggctggctggatagatggagaggtagatagataggtaacaggttggtttcatgagtagagggacaatggcaggatgattgcctgttttggatagttggttggataaatcgatgaaatcaatggataaataaacaaacaccaaaaaccagagtgcatttctccccccgagactcccttttgtatctggactgtgacatttcctcattttccagtttctggccctggaaagagctagcaaacagcacactccccaggtttggagaaaccttctgagccattgactatggatttgccaaggtttttgcactggggagttctggagaagctggcccccaaagtgaatttctgtaaagtaaatcctattttcccattgacttggcccacacttttggagatatgttcctgctgtcaaaggctggtgacaggtgggggaagagctggaactcccctgggtgtcagctgccccgagcttctactcattccaccttgagagcagactgatgctggccaggagcacaggagcttagagccagggggagatgcaacagcaggggaagagatttggcatctggtcccagaagcctctgctgccagtgggatgctctgctgctaggcttctgggatagcacactccgtctcctccagactgatctgtttctgttcatctgtccgtacatccttccttctcacaatcccaccctccctccttcatccatccatctgtccatccattcagcaatcatttttgaaagactctaggatgctaggggacatagagggaaattaaagagaatcaatgttctgatggcaaagaattatatcccagtagaggtgataggcaaggcctccttcctcctttttctccttctcctactccattgctttttcctcttcatcctcctctacctcttctttcttttctgctctttcttcttcttttcttcttccctcatcaatatcatgatcatagcagcctccaccgttaagtccccactaagtgccaggcaccatcctaggtgagattctgacatactctaatttatctcaacaaccctgcataatagtttctttttctttttttttcttttttttttttatgagacggagtctcgttctgtcacccaggctggagtgcagtggcatgatcttggctcactgcaacctccacctcccaggttcaagcgattctcctgcctcagtctcctgagtagctgggatttcaggcgtgcaccaccacacccggctaattttttatatttttagtagagatggagtttcaccatgttggccaggctggtcttgaactcctgacttcaagtgatctgcccgcctcagcctcccaaagtgctgggattacaggtgtgagctaccatgcccagcccgtaatagttaataatgctcattttgcaggtaaaaaagcaggctctgagatgtttagtgatatacccaaggtcacactttttagtacatacttgtgtatgagatggaatgtgttgagtgcggaggggaaagtcctccagcctgtgccgtcaggatggcattatttagtaggtaggattttgatacatagtagatggaaagaagggcattcttagcagggggaacagcctaggcaaaggcctagaggctggaaaggggtaggtttgtatgagccatggtgaaccaaagtgtgagaaagaaatggcaggagaggtttgagtccgttaagagaagccttgagtgatgagctatggctgacattggaagcagtaggaagccactgaaagaaatcaaaaggagggaaaggttcaggaagatggccatgaagcctggcatgggaggaggatccagagcagggagaggcaagctggaggccaggaggggctatatgggcctagcctccattaagccagaccctgggtgtggctatttctgcccagccagctactccagcagttgggagaggccaggacatagcccacatccttggtggatgggccacaatggcagggacaagggcagagtgaacgagttagggcagagcagctgcctgcctgccttctcccctcactgaagccccacagctcccagggggctcctccgcatcctgtcccaccctgcccacttcactccttgagccagggaatggttgccagtaccttgctgggcctcagctcttccatcgagcctggacaacccaagcagcaccctgagaaccatcccagaatatgcagagtgtcagagctggacatatggggaagctgaggcccagaaggggacagctagttgcctgaggacacacagagatagtggcacggctggaacttggggctagatctatagcataaaactccttccaagggagataagttggtgtctcccttttctagctgtggaggcttgaacatattttcttttcttttcttttttcctctcctgtctttgcctatgttttcttttctttaaaaaaaaaaaacaaaaaaaaaaaaaacttttttttttaatggagatggggtctcctctgtattgcccaggctggtcttgaactcctgggctcaagcaatcctcctgccccagcctcccaaaatgctgggattacaggtgtgagccactgtacctggctgagactcagacatagtatttaacatctgcctctagccctcttgagagtaaggtggaataaaaataaatagcctttaaaaaatgtcttaaccactctgaacctcagtttacccggctgtaaaatggggataataataataaataaaacattatttagtcatcatttttcctatcacctccctgtaagaatgtaaacttcacaaaggcagggatttttttatctcttttgtttacaaatgctcagcatggcacctaggacttagcaggtgctcagtaaaaaattactgaatgaatgaatgaatgaataaggaatacatatgatttacgggttcctcacaatgtgcctggcactgcagaaaatgctttccatgcagaatcctgtttaatccttagaacaatcctgaggtgtggaattggtatgattatctccactttgcagaggaggaaactgagcctcagagagattacacatgacttactcgtggtcacacagttcctgggtgatggaactgggatagaagccctgctttgtggggccccacagcctgcagggctgcacagctgctgcagagccaggtgagtgcttctgggaactattgtggggcctggcatgaagtaggtgctggatagaccatgtctcttaccctaatccccccattccccttttctggacttcagttttcccacctggaaggttccagggctggcctctgaccttttcacggtcctcccacatggactgatcacactagggatgatcttcccatggccgacaactctaaggcccgttgtcctgcctgatcatgacccccaatcccgaagggaaaaggcctctggaggtgtctcaatgctcacttcccctctgggacctcagcacctctgtggtctcatcacttgcttccttaggggccctgaattggcctccttgcaaatccgcctgcatgacagctcccagtggcctgcgggaggagtgttttctcggctccctgacggcatctgtcccaaggtgcgaggttccagctgcacgcggcgggccaggctgccgttctgtctggagcgctgcgtggagaaacaaacacagctgtgtttattccagaaattacacatcctgataatctgctcactcggggtaatgcctcccagttaggatcacagggggagctacaccaaggttcctgaacttctgggcaggttgtaattctctgtgacatctgtgctgttgggcagaccttgggcagcaagtagacctcagccagtgggcacccagcagctttggaatgccccattccgaggggtgtggacattctcacctgggcatgagatgctggaaggagatgaccttttgtcttgaaatctccaaattaggatttcaagcctgacaccctggcccatagccacactgggagacagaaacacacagacctatattaggagaacatgacccagaattggatcatgaatcaagtcatgttgttgctccagagcatttccacaactccctgttgcttttgggtcactcttccttggcccataggccctgtgcggcctgcttcctgcctactctgcctaatttccatcacccacctcagtctaggggttctagccactctggcctttcagttccttgcaattcctagactcttcccaccacagggcctttgcactgcttggtccctttagctggaatgctgttcccttatccttggataactctcacccatcctccatgttttcaaggaagtgttcccagagcatagctccatgggccaatcttttgctgcatttgtcaacatcataattttaaaataattaatgtgtttctttgaacatctctacctctcctaccagaccgtcaactttacaagggcagggaccatgatccaattgcttcatcacttagattccctgggcctagcatagcgcccagcccctagtaagtgctcaactgatatatattgattggaagaatgaatgaatgaatgcacggctctcagatgactgaaaggaggatatgcttctgtttgttcttttgggtgacagttggcagagtgctgtgacatccatcatctccctttaattgaacggagtgggattgaagtctgcaggggcttggcacagggccaggccccagggtgggggtgtgggatccgaggtgaattaggcatcatgggcctggccttggggagctcacacactggctgtgcacagccccctgggaggaaggtcccactggtattgttctcctggatggacagatgaggcttctaatactcagagccaggggcggaggcgggggtggcttgatgaggccacacagctagtcagtgggacagacgtgcactcagatccaacggatatcaagccaggtggcccttcccccacttcttgtgggcacttgggtgggaggtgtcagggatccctggcctttgggggtcttgacatcccaagctcttaccagccatgtggctgtggacaagttgcagggggcagcatggattgtcctgccctatggaggttttattctaatggacaggactgatgccagatatctagtgagtagcttaagtagggatggtgctaagaagaaaactgctgcagagatgggagggccagcgagaggagggatcaggaaggcctttctgaggaggtgacgtttgagcagaggccagaaggaagcaagagagggggttcagggatatctgggggagggtgtttcaggcagtgaggagagctgggcaaaggccctgtgacaggggtgtgcaaggcagccagcgtggctggagcgggagggccaggggagaatgggagcaggtgacacagagggaccagccatggcaggactttggcttctacctggagtgagatgggagcggtgcagggctttgaggaggtggcaggatctaacctgggttcagaaagcaccactctgtcttaagaggccagagagtgagggacagagcaggggacaggaagaaccatcacagagtccaggcacgagacggtggtggctggaccaagcgggcagtggtggggagttgtcagtaagtggccctggttttgctccccaggctgcctcacatagtttgggggatccagagggggcggagagaaaatggaccttaaatgtcttctccctctggcctgcccccactcaccccaggaggctctgttggcatttttggcatggaaacatatgtctctttctttctaatgtaaattgataatgtattgacaatgcgatctcctggcagccaggttggtgactctagcatgtgctagatcattctggcggggggaatggagggcagagggacagagaagagcctggcccgggcccaaatccacccccatcaggacttgctgagcgactgtgcacaaggccccttccctcttttgagctgggggctgcactgggggattagcggaccaccgaggggctctgcagtcacaccagttgggttcatgtcctggcaccagctcttactaggtgtgactgtggacaagttgcttcacttcttggaacctcagtttccttatctgtcaaatggagagggtaatagtccttaccttagtaggtggctgagacatagtaagttctcaacaaataaccatcatcggctaggcgcggtggctcatgcctgtaatcccagcactttgggaggccgaggcaggcagatcacgaggtcaggagttcaagaccagcctggccaacagcctgtcaaaccccatctctactaaaattatacaaattagccaggcgtggtggcgcgcatctgtaatcccagctactctggaggctgaggcaggagaatcgcttgaacccgggaagtggaggttgcagtgagccaagatcacgccactgcaccccagcctgggcaacagagcaagattccatctcaaacaaaacaaaacaacaacaacaaaatcatcactgtgtagaagccagggcacagaagccagggccggaatgcttttgtgcggcctgtgccccagtcttcatcccacccaagaggaatttgcctggtctttggaaggatctcttgggtctcaggacttgcagaacttcagcagcagctgccctggaaggcagccccctctagcggaggagattcagctctgggccatacagaccatttacaggctgtgtgacctcagcttgggagcacaaccttcctgagctccagaggtgatgagctccccttatctgtgcagtgggaattagagggcctgcctcccagagtgaggatgacataagaacccacttggaaagggcttagagggtggggctctatgaattctggctcccttctgcccagatgtgtgggccaactggctcccaggagtgggagccaagagctgcgggggcctgggaaaggtgagggggccagagaaggtgggggtggaaacctggaggcagaggcagcagggtttggggaagcgcgtggggggccggagggcggctctaactcttctctctaatttttgagaaaatctttaccccatcttcatataattaagagtatttttaaaatgccttgttgaaataaaaatagtccatttccatatgacctcatttcattccacaccctcagtgcgcgtgtgcacacagatatacacacgcacacgaatgtctagatttttaaagctgccttttgtgcctctgctgaaggggttcttatttttgcctagcaggtaaatatttagggactgccccccggccccgctttattttctgatttgcaattggaggccctctaaggtccattaacagcagctgacactgtgcggctctgcagcttacaaggcgcgctcacattgatatctccattgctcctcctgcgttcctgggcgggggtgtcaccatgacccatcacttagagataggaccatctttttaccagcagcatctagtccagacctggcacatcacacacaaaaaatcagctagtgtctgttgaatacagatgaagaatgagacgcataacacagatgaagaaattgaggctcaaagagatgaaaggatttgcccaagtggattttttcctgagttttaatccaggactgtccagactctctgtatgttccccctcctaggctgcctttctttctttctttctttctttttttttggagtttcgctcttgtcgcccagactggaatgcaatggcgtagtcttggctcactgcaacctctgcctccccagttcaagcgattctcctgcctcagcctcctgagtagctgggattacaggtgcctgccaccacgcctggctgatttttgtatttttagtagagacggggtttcaccgtgttggccaggctggtctcaaacttctgacctcaggtgatttgcccacctcagccttccaaagtgctgggattgcaggcgtgaaccactgtggctggcccaggctgcctttctaaccagcctctttattttcagatggggaaaccaagacccaaagaggataaggacctgtgcaaagtcacacagtgatgagtgatgatatgaatgatgaaaatattagcgttatacaattttaacattcatgttaacagtcattttaaaggattgattttacggagtagttttgcacggtggaaatcagcatataccatggccttattatgtgccatgttgccatgctgaatccaccactgtgaggcaggattattattatttttgttttagaggaaaactgaatctctgagaggttcagtaaattgcccaaggccacatagccagtaaggggcggaaatgggatttgaacccgcgattctctaagtccaaagcccatgctcatgacacgctactacatcaggctggtatgatttggtggggacagagctagaagttgaacccgggactggattcttggcctggtatgatttggtggggacagagctagaagttgaacccgggactggattcttgacctggtatgatttggtggggacggagctagaagttgaacctgggactggattcttggcctggtgtgatttggtggggacagagctagaagttgaacctgggactggattcttggcctcctgatccccaaaaacaaaaccccagcccagaggccgcaggagtggccctgtcaggagcttctcagtcaaggacagagctctgccctgggcctcccacccagggccagcctgggcttgggcagggggctcatgtctctatcaggcctcactgtgagggggctttggagcagctgcctctgtggcccagcctgcatgcaggcagctggtcctggctgcctctttagcaggagcaggataaatcttaccccccggcacagcccatgcacagcccagtgtggttcacagcatcctttcccctccacagtctcacctgagcttcacaacatccttgtgagacagttagggtagggctccccagtcttcatgcagagaaaccaaagcccagagatatatacactcaataaagtaccaccagaatgtcaatattctttttttttttttttttgagactgagtttcgctctattgcccaagctgaagtgcagtggcgcaatctctgctcactgcaacctctgcctcctgggttcaagcgattcttgtgcctcagcctcccgaatagctgggattacaggtgtgcaccactgcgcccgactaatttttgtatttttagtagagatggggtttcaccatgttggccaggctggtctctaactcctgacctcaggcatctgcctgcctcagcctcccaaagcactgggatttacaggcatgagctaccactcccggcctgaatgtcagtattattttgctgtggttcttaatttctttggggtcctgaagatccttgagaagctgccacaggctatgaactgccccctcctagaaagttggagacacacagatacttttatgaaaaaattcaggggacttacagattacaagcctctgttgtgttgctccatggtactgatgataatgaatacaactttgttttattgagcctctgctttgtgctgggcagggtgtttgatggtttacatacattatctcagaacacccctgcagggtaggagactgaggctcaagggagggtgacactgactaaggctgcacagcagggctatgaacctgctctaccgactcctgtggcctgtggggcatggtgtgggagcatcttcctgaggctgctgttaagaacaaggacctttgctgggtacggtggctcactcctataatcccagcacactttgggagggtgaggcaggagggtgaggcaggaggattgcttgaggccaggagttcgagaccagcttgggcaacacagtgtgaccccatctctactaaatttttttttaattagtcaggcatggtggcatgtgcctatagtcccagctacttgggaggctgaggtgggaggatcgcttgagcccaggaggtcaaggctgtagtgagtcatggtcatgccactgcactgcagcctaaacaacagagtgagacccggtatcaaaaaaaaaaaaagaagaagaagaagaagcagaagtagaaccagggcctctaaggaagtttacagtccatactttctgcctttggaaaagactgctggcttaccccaggcctgagagcaggaacagctactgaggacagggtttctagcaacctctgaactcccagcagggagcctccttctcccacttcccaggggtctgatttgagggccctgggtagagcctgtctcagctctacatgatgggaaagtctgcaattcaagcttgactcatttggcttaactcatgggaatttgccttccttgaaatcctcttcccaccctgggacagcctaatgattcctatagggcacttgggacgcccttggcagtgagtcggcccagagagcaggactgagggagagggctgggaggtcagtagggtcactagacttagggcagagcccctgcctgtgcacccctcaggaccggagcagcctaaggtatcttgtacagtggataagagtgtgggctctgagggacctgggttcaaatcctggcttacacctacacgctctgtgactttcgataggctcttttccctctctgagcctcagttccccattagtaaaatgaggatgataaatagcactaagagacatgtggccctgtccctggcccaaaggtagtgctcaataaagatgatcgtagtggtcatcgttgttgctgtcataagcagagtcggggggctgtggaagagagctcatcgtacacacgggggtctacaggaggctgctcaggagacctccctttcctctttggcaagactgtacctgaaaggggattgggcgaggagtgataaggctggtatgggggaacgtttggggacaaggcggcccctcttgcctggttggtgtggggaatgaggcctggtgctgggcccagagacgtaaaagcctctccccttcaactttcctcccaaataattctggaggctggacaaagagttccatggggccccccttcccaatgcatgagccgaggctctgtttagcagcccccaccccacagacccgcctcagtcactgtgttggccaaagcatggttccctgggggtgggaaggagcctgggagcctcggtggggcctgcaggccgcggtctggttcccagaggccctggagggggccccttcacagcttcagcacgaggccctttgagggtgggggcagcctccgcagcgcggcatgtttgcgccgctgacactctggcagggtcactgtggataaaggcgctgcccagaccccgggcccagcctgcaatggggctttcttgtcagagaggagcctttttttcccagcgcactgtggggcggccgcagggggtcaccctgcctaggaggataatggagctttgggccaatggagacacaggactcagccggccccctccctgtcagacctggggaggaggggagactgggggagaccgattggctcggatcagccgccaccttggccatggctctctgggtggagtcagaagggaagacacagtggagaacctgggactcccccaggcctccaggtgtctgcgaatccagccatcggcgtgacgaggaatcttgggcaagtcatccagtgcttccgtttctaatctggctgccttgtggttctcaggagagaccaccagggccagagctagcacggccctttttagctgtgcctccctctcaccctggccattcagctactgcctgcctttctgttcctacagctaccacctgacctcaagtctaccccctgccccacctggaccatctcagtgacttctgaaccccacaaagcatcaccactgagtcttctaaactgcagctgagaccacattaccctcctgctcagaccttgggctccttatctaaaaaaatcaaggtcaaacagctgctcgttgacctggcccctgaggccttctctgcctgtccttgtcatcccacaaactctaggtggatgtcattctcatccataaactataggtttcatacatacatgttataaactcccatgcccccagatctttgttcaggccccagctgctgcctagaatgaatgcccttcttgcttctgcctagtgaactcctactcatccttcaaggcccaactcaaatgtcccctccttggtatatccttctttgtacttaccctcagctcttgattaacaattcttataacaccaaggtatggctaattttgtctacatcaccctcccccattaaactggagtgtagagactttcttgtcttattcatcgttgggcctccagtgcctagcacagagtctgttaccaacaggctcttgggttgatgttttatgaatgagagaatgaatgaatacattgtctgcccatgaaaataacttccccctctatcctagaggcttttacaactcagcatgacactcccacaagaccttggaagtaggaggaaattatcatgatgcacaggctgttcagatgcctctgaaactaggtagaacctggaatgagactggatctgggtctcaggccagaacaaggcagctcttacatcaacctagcctcgcagaggtcttggagttcatgctctaccttgaggcaagacctggtcaaaccatttaaagataaaaaaaatactaacttatcgcagagttgagaattctccacttaggggctggatggattcttagaggctacctggcccaaccccctctttggggatgatttatacagaagcacagatggctttgttcacttgggatccttgtcttagtttctcttcctctttttcctttgtcattttcttgttcctttgtattcctggctctgtgcttatctgtgttgatggtctttccaaagccaggagtgcccaaatgttctagctccccaaaccctcaagcatgtagtgatgatagtcatgagaataacagtttctatctccaagcatggctgggtgtcaggtcctatgccaagctctgctggtactgtacccataggagcttcctaatgaccccctgtggtaggtactgtcattaaaccccacattgcagatgagaaaaccaaggttcacagaagcaaagtaatttcccagaagtcatccaggtagtaaatggcagagccaggattcagatctacagataacttccgtgtgctttcctgttctagggccatactgcaattcaatcattcattatcgagccattcattcagtagccacttttggagcccatgtgctgttattagtcattgtagccatttactcattccttgcattcaacaattgtttactgaggaccaactatgtgcctgggctctgctgcagaaacttctaggggaggtgagaccttgaggttggcattggcagagaggaggaagagaggcattctcaagccatgatgcgggaacctctagaccaaggtgcccccacagtccttgaacggtttggacctgcagccctgggtcctgtagtctagcaggttggggaggataccagcagtgagctagtatgctcactcccaagtctcacctggcacagtgaagcatgctcagggttgcttttgtaaatctaatattttattttatttttaaaaattatgttgtgtacttttttttagcaacagggtcttgctttatcacccaggctggaatacagtggcacaatcatagctcactgcagcctcgaactcctgggcttaagcaatcctcctatcttggcctctccaagtatatgggattacaggcatttgccaccatgtccaactaattctttttgttttttttcttttttttgagacagagtctcactctgtcacccaggctggagtgcagtggcatgatctcggctcactgcaacctccgcctcccaggttcaagcgattctcgtgccttagacccccaagtaatagggaccgcaggcgcatgccagcacgcctggctagtttttgtatttttagtagagatgggggttcaccttgttggccaggctggtctcaaattcctgacctcaagtgatccacctgccttggcctcccaaagtgctgggattacagacctgagccactgtgcctggcctgtttagggttttggcttctagacttagctctgccaccttttccatttcaccacatcaccccatctctgagcacatttctgaagtgaactacccagacctagctcacctggacagtccacagcctcaaggaattcatctgtgtaaagggtctgtcatggatgatcagacccatcccagtctgagcatttctggggtcccaggcaggtgacccttggggagtcagggtgaggagaagctggtctgagcctgcgcagcagcccagaagctgggagtagaaggaagctgccctcccccacatgcccggcctggcctggaatcgttctcggatttgatgagtgattcataacctgacgctgcggaaagttgtgccgggctgcagaagggctgcccggggtttgcggttttgaacacagagaagaattccctcgtcggctcagactaggataacttacttgttgagagagacattttcacaaaataaatccttagagaaaccaggcgctgaggcagggaggcctggtgagggattatccaaataaaccggttttgaagcttcgggtccaaacgatttgcctgagcccttcgttgcttccttgtactcaacctgaggtccctggtgatcctgagatctttttcagtggcaccaatgcagccaggccctctccacctgggtgatgtccccatcacgtggcatcactgaaaccctcttcaactgcggtcactgggatatattgttcttttggggagtgtgtcatgatcagtctaatctactgtttttttctaaataaggtttctattcacattttgggtgggacaattcttccttttgtgggactgtcctacccaatcagggtgttttccacccctggctccagcccatgaaatgccagtggtacccagtatggtcattgtgccctcacaatccttaaaaggtgagacccgtggccctggggtcctgcggtctggcgggcttgggatggtacctctgtggcatcagcattgagtaagcatgccctcaagccttgatcatcactgcgacaaccacagctgcatttctgagtgccatctgggggacaccatgccaggcaagacccactggtctcaccagggcctcgtgtcccaccaccctgagtgtcttgccattcctggaactcacctgaccctttcaaacctccctgcctttactcccactcttccctctgcctggcggcccttccccgcccgtctcatccctcccagagccccacccttcttcagccccagacccctcaccatcataccggcccctccctgcttcctgatgtgggtggccttgtactcatttcttcagctttcggagtgtcattttcctcatcagtaaaatagggagcagaacagaaccttcctcccctggctggggggcggtccgtgtgaagttcttggtgtccagtggtgagcatgagccgtccctgcgatgccaagcctctccttgctgacggcggggattgacgatccagcttatgtgccctgctcccctctgcctgccccttctccctgtccccaggtctcccctgtggtgggggatgcaggtcccgttttcctatggggcactggctttggagaccacccctgccccgacccctgttctctgattctatctaagtgcttaatctctccccccgacccctatcctctgattctatctaagtgcctaatctttcccagcggcagccctgggagacatctcctctctcgctatggggctgctgggatctgtcttcccaacctgacacttcacaagtctgtcccctctactttatcctccccctaagtaaaactccttaaaaccgcgttcctggagccgtctgttttccctcccctgacgacacctggctgccttcctccagcctgcgccccctagtctccctcttatctaaatcccaagccctcctgtctctctttgggagataagggttccctgcagattaccttagttacatcctaggtgctcactgcctgatgcatagaataactctggcacatagtaggcacttaaatatgtgtcgagtgagtgaaaggaccctgtagcccatctattcctcctgttcggaggtttggaatgaggtctaaaagctcagggaaggcgggttatatttgccttgacagcctggttttcttcccagcaaaaaaaaacaaaaaaacaaaaaacctcagtttctcacgttggctctggctcagtgcaataacgaaaacaagggcaataatagttcacctgcgtggaagctgcaaatccccacacactgggcctgttgtcttacatgcctgtctcggggatgggctttatttttctccctgtttcagagatgagaaggccggagctcagtgtggttaagacacctgcccccaatggggaagtggtagagtcgggacttgaactagttctgtgtctccagtgcccatgtacttcattggtaccccacacctcttctgcaccattttattttactcatgaactcaccctgctacagatgggaaatctgaggctcggaaagaacagcttgcccgaggtcccctgggtgagtgggtgggtgggcagggtccaagccagcatccgacccaggcccctgctcatagggtccatccacatcatcctcctggcccatatgagcccagaggctgtgttggtctgcaaagctccaggctcgtggtatggacaagccatagggtccctgacatgaggaccgccctggctgatgtagaaggatgcccagagtgagacaggttggagatagagagccctgtcttctgcattcagggtgggctgggaacagttaggaataatggaggaaagttggtagaaagggtgggggcaggggcaaagctgagagccggagctctgtccaggttcccagctcctggacctcactcagatcaaaaggaaaatggggtgaatcgactaactgacattccagccagacttccttccttccttccttcctttctctctttcttccgagtgtctcactgtgttgcttaggctggagtggagtgcaatggctattcgcagaagcaatcatagttcactgctgcagccttgacctcctgggctcaagcgatccccccacctcagcctcctgagtagctaggactaaaggtatatgccaccatgcccagctagttttttattttttgtagaggggactcactaagttgcccaggctggtctcaaactcctgacctcaagtgatcctcccacctcagcctcccaaggaaagtcagacacctgactgactttcttttctaagtgctttgatgtctttctgagcagagaagtttaacccccaggtttgctcagggtccttgttctgtttctactttgacattcatttattatgaacttttttttttttctgagacagggtctcatactctgtcactcaggttggagtgcagtggtcttatcatggctcactgcagcctcaacttccttggctcaagcgatcctcccacttcagcctcctgagtagctgggactacaggcttgtgccaccacgcccagctaatttttaaatttttagtagagatcgagtctcactatgttgcccaggctggtcttgaactcctgggctcaaacggtccttcaacctcagcctcctgaaacagtgggagtacaagcatgagcccctacacctggcctaaacaagcctttttgagtgccaactctgtactaggcatcatgctctccggaatgtattggctattaatggtcacagcaacccagggcttggtgatgccgcccgtacacctgaagggctgctgacctccagtacagcttaccaggatcagcttacttcttgtgagacccaggctgaggcacttcacctctctgagcttcagtttcctcctctttaaaatgggatggtcatcactacttcataatacatttgggaggatttctgtaaatttaattttattttttaattttatgtttttgagacagggtctcactctcttgcccaggctggagtgcaatggggtgatcttggctcactgcaacctccacctcccaagttcaagtgattctcgtgcctcagcctccccaagtagctgggattataggcacgcaccaccacacccaactaatttttgtgttcttttgtagagatggggtttcaccacgttggccaggctggtctcaaactcctggcctcaagtgatctcctcaccttggcctccctaagtgctgggattataggtgtgagccaccgtgcccagcccgggaggattaaagtagatgatagccccaaagctctgagtacagtgcctggcacatagtaggcctcctcggccacctctacaaatggtaatgtcatctgcttctggactgggtcccacaagctctaagtcaggaagcttgatatggcatccggggcagcaggtaatgacgctgttcttatctgaacccccaaattacaacgtaggagttctaacaaagagtttataattgatgtgccaatttgtttctaatggaactcacccagtagtactaaaaagaatcagatcacatttcattattaacacaatgaatcaccatactcaaaataacaaaatcaccccaaatcatgatttccctaagaaacagattggggtaagagtatgaataaaatcagtcatataacccccccacccccgtggaaaacagtttagctgtttctaataaaattgagcacacgcctacctcgtagcccagtaattccactccctatttagtacatttgacccttgaacaatgtgggggtaggggtgctgacccctcacactgttgaaaatccacatataacatttgactccccaaaaacttaactagtaatagcctactgtcgaccagaagccttactgataacatagtcaactaacacatattttgtatgttgtatatatatatatgttatatattttgtatgttatatatatatatataatatactgtattcttacaataaagtaagctagagaaaaaatattatgaaaattctaagctgggcatggtggtgtgtgcctgtagtccaactacttgagaggctcaggcaggaggatcacttgaacccaggagtttgaggctgcagtgagttatgatggcccagtgagcctgggcgacagagtgagacattgtctcaaaaaaaaaaaaaaaaaaaaaaaaaaaggaaagcataggccaggcatggtggcatgcacttgtagtctcagctatttgggaggcagagacaggaggatcgcttgaggccagttcaaggctgcagtgagctatgatcatgccacagcactacagactgggtgacagagtgagactgtgtctcaaaaaaagaaaaaaaaagaaaaaaagaaaatcacaaggaagagaaagcatattcactattcattcagtggaagtagattgtcataaaggtcatcctcctcgtcttcacgttgagcaggctgaggaggagaggttggtcttgctgtctcgagtgtggcagaggcagaagaaagtccaagcataagtggacctgctctgttcaaactggtgttatccaagggtcagctgtatatacctaaatgagatgaatgcacatgttcactgaaagacagggactagagcacaatgttcacagcagctttgcctgtcacagctccaaactggaaacaacccaaatgtccatcaacaaagaatgagcaaataaattgtggggtattcattcatacgatggaatatgacgcaggaataaaaaagaacaacaagctgctgataacacgcagcatcatggataaatctcaagatcattacactttgcaaaataagccagacaccaaacaatacatacccgactggtttcactcataggaacttcaaaaccaggcaaaacgaatcaatggcaattaagtcaggatcgcgattgcctatggtgaaggaaggatattgatgaggacaggacacgaggaactttttgagtggtagttacatgggtatatgcatttgagacattcatcaagctgtacacttaagatctgcatgctttactgtatatgagctatacctcgattaaaaaaagcttcaaacatccctccccactttctaatggtttggctttgggcaagtgacctgtctgagcctcagtttcctttatctctgaaagggggtggtcacaggggttgagaggatgtgctgagataattataatccatgcagcagcctagctcacggtgggcgcttggcaatggggggctttgttgatgtcattcagcaaggctcgggctgggccttggatgatcggcagctgtgagcgcagcggggcctggcgtctgcccacagatgtggctggtgtgcctagccgacgctgctctggattctgtgacaatctgcagcttatctttcaaagcctatctccccacccatttctacacctcagcagtcagcctgcacagtggggacgcagcaggatcaggatgtttaacttctctatatgccagcaaggtttggtgagaaagacctccaaatacatagtgatcaactgctctgatcgaaatctggtaatgactgagtccctgccctgggccaggcattttgccagggaaggaggtgagtgcagccgtggaaagatcgcaccagacacctgccctatggaccttgcagcctctggcaacagatcagacagtcatcaaagaatgagcccacagacatggggcaactgcatctttcacaactgccaaaagaggctgtaatgattgggtctggtagggaggccagggaaggcttcctggaggaagtgacacataagtatggactgaaagatgagcgggagttgacctggctaaaagggaagggagggtgcaccaagctggggaacatcttgggcaaagatccagtaggagtgtgagttattggtggtcaaaaggaaccagagtggctggaactgagagctccatgaagagtggggcagggtgaggccagggaggcctgtgggctcctccttgagccccaccctgtgtgtcttcacacttggagcaacaggaagtcactgcagtgtgttctgcaggggggagatgagatggtgaaattagccttttgcaaagaataacaaaacttccatgatcgaccacctactgtggaccgtggaccatggaccatgttaggccctccaatacacatctctaaatcctgacctccttctgcacgggaggcctcacctccacctttcaggatgcagaagtcaggtcacaaaggtgtgaagtgtgttttcttcatgaccttcccacgagggtgtaggggagctgggattcagaccccgctctgaggccacatccacacacttccctctgcaccctcctgacctgtgaccccccgggggtgcaaatctcttaggttagccttgctttccccattcctggaagggggttaggaccagccctgcctccctcctagggagtgttttaaagtcagatgaaataaaggaagaagtgacaggtggtgagagcaggagagtccctcagtccaagcctcttcttttatagagggggaaactgaggcccagagagggagattggctggccccagatcacacagccaaactcgggttctgcatcagctgctgcttaccagaaacccaggcaaacagggagaactgccttctgctcagggttcagtcaccggactgagggcccaagcaaggcgggctcacgtcctctgttcactgtggtcacagcagctgtgggccacagatagcccaggcaaggttacttgtattaataatggctgaaatttattaagccctttttctgtgccaaagcactctgataagtgcttttacggagttatattacttaatccttgacattgcccccaggtggtgaagtggcttgcccaaggcccgactcaaaatcaaggtctgttgatgccagaccaactaggctgttccagagattctttgtcatcctggtagagcaaatcgagaggggcttgagattcctcaaatcccagctgccaaagcccttgcacagccacaggcaagggaggggggctctgagatgactcacccacccagctgagcaaagcaaacaccttggggtggcatgtggtctgtgagctggcattgccagacccccagtcatcagggacctctgccagcaggggcggcctgcaggagagcaggcaagcgagccgtcggggttcctctgctgtttggggactcaggtgcgacctgtctcctcacctggaatgaacccatttgttggtggcttgagctctagaacccatcgtgctgtagagcggagccggtctgcctggggaaaaggacaatgaagttgggtggccccactcagccactgatgagctgtgtgactttgggcaagtcacttcacctctctgtgcctcagttacttcattcagcacctgaagataataacacactgtggtggagctgtgtgaagccagtaaagaaccacatttaagggcctggcaggatagcatggtagctgagaacgagtatgactctagaactgaatttcctagttcacatcctggctcaacttcctgctaccacttgtgcaagttatttaatcctctctggccttagtttccccatctgtaaaatggagcaagtaatcttatcaatttcactgggttactgtgaacattcaatgtgtttccacacgtgaagctcttaatgcctgccacagagtaagcactcagtaagtttggctgttattcttaatattccttcatcataccctgccaacttgcttcctgtctcactttggctgctgggaagctcagagcaaacgttgtttcctaattaggttcatggaagaatgatctttcccttacctcaagggggctttctgggtcctttttttttttttcttttttttgagatggagtcttgctctgtcgcccaggctggagtgcagtggcgtgatctcagctcactgcaagctccacctcccaggttcacaccattctcctgcctcagcctcctgagtagctgggattacaggtgcacaccatcatgcccagctaatttttgtatttttagtagagacagggtttcaccatgttggtcaggctggtctcgaactcctgacctcatgatctgcccacctcggcctcccaaagtgctgagattacaggcgtgagccactgcgcccagctctgggtcctctttttacaaaaatttgattctaatgtcctgagatatatgtacatacataaacacacacatatatgatattaaaataaaataaattatataatttattttaattataaagtttcctccaattctttctagaaataatattaggttggtgcaaaagtaattgtggtttttgcctttgaaagtaatggcaaaaaccagaattacttttgcaccaacctagtagaatgtatcgcattttatgaaaaccaacaaggtaggctacacgtcatgggccctcttgtctgtgagctgctggtcatcggcgcctgtcccattctttcctttttactttgtggctttttttttttcttttgagatggagtttcactctgttgcccaggctggagtgcagtggtgggatctcgcctcactgcaacctccgcctcctgggttcaagtgatcctcatgcctcagcctccctagtagctgggactacaggcaggtgccaccacgcctagctcatttttgtatttttaatagaggcagggtttcaccaggttggccaggctggtctcgaactcctgacctcaagcgatctgcccaccttggcttcccaaagtactgggattagggtgtgagccaccacacccagcctcctttttactttctggctttgcttttggccagcatgttggtgccctggaaaaaaagaggaatgcagggcagggactgggatgtgcatttcttctagaactctctacccccaacactgcctcacccaggtctgggcacatgataaagatccaccagaaacctggaagtgaattgaaggattcagaccaaggtgtttggttctgtgggtgacaacaggtgtttcttggttgtcttgtgtcacagatcctatgtgacatcagctcccattgccaggggagctgtccctcctggctcctctttgagggaaggggaaaggaaggtgaaggtattgggcccaggatggagaggggaaggatgctgtctcctccccgtccacagggtggcttatgtctaccggagccattcattcattcattcgttcattcattcactcactcagctggacctccattgggttccagaccctatactgggggctgaagatactgagatgagtcagctggtccctgccctcatggaacacctagaaagacatacggacaaaaggatggggatgaggaggggatacatgaagttaccctaatcaagacgtgtggtttgacaaaggactttcttctcaaattttgaatttatttatagtaacaactgtcattcattgagtgccagctgtgcactcagagctgtgcaaagaccttaacctgcattatctcattaataagcccccaaggccccctgaagaaggcagttatattcttacttggcagatgaggaaacagaccagagcagggatgtgacttgcccaaggtcacacagcaagcaagtgtcagatgtggaatttaaagtccagaatccttatctcaacttctcccatgggccacctctctatgaaaagaaaggcagtggggtagtttatattggggcagccctacaatccagggaaggtagtggctggggcagtagaaggattttcagcaggcaaggggcagggggagcaggagagatgggctgggatgggtgctgaggcccggacccttctgtggcatcagagctttgctctcttctctttctggagtcctgggtcaccagagccagacttctgatgtgctttagtcctgtgtttacatgagtgtcagacggagcaggctccaggggaacacggaaatggcattaaataacgctgaatcacacagtaagaaagttccccttcccttctcctccgtgcctgctgattactcatggagaaagtctctgtttcctgccagcatgtctctaacacctctctgacagcccctaatctcccttttcaattgggaaaagcagacttcaagctcagaacctgctagggagctggaatgccaggacatcatcttgttttcatcatgaatagtttagcttatatatttttatttaacaaacatacaaatggcactttctaagtgctttgcaaatattacaaatatttcatccccattacgactttatgagacaggtgctattatccaccttccagatgagtaagctgatacacagagaggttgagtaacctgcctgggtcacacctccagagtgtcagagcaaggactaggaatccaggcagcaggccccagagcccatgctcttaagcatctccccagactacctctgattctcagaattggtgctggctctcttctagttccagcagtagcctgattttttcctttactgatgaatttatttccatgaaaataggtgagccaatttaaaagtaaagtggagttcaagtggttgtgtggaaatagccaaagtcctaacagtagttcaagggctactgaagtttgaagaacactggtcagtccaagcccttcatttggtggagggggatgctctgaagaacagagaggggatgggacctagcagaggtcacacagcgagtgagcctggaggctgccaggacagatgggagcgctcacctgccacccacgcccatctgcttcctgcacgcaggactgatggggcgccaggtggcaggagcacagaggtgtgctcacctgcccagaagtgtcccggtgctgtaacaggatccctgttatctctgctgttctgggaacaggcagatctgagccccaaggcccaagcccaagtcagcattttggccactgctgagctgacatctgttgtatgtctttaccttgtcttccaagtctcaacagagcctgagtggggagctctgtcctcagcctgctggtcagggctcaccttccctacctttacgcctttccagaagctttcacagcctctgccttgagagatgcgagctgaccctgggttcaagtcctggttctgccgtatacccactatgtggctttctttaggatgcttagcccctgcaagctgtgccatcctcaggtaggaaatggggatgtacaagatcaaagacagtgggctgggaggatcacctgccacacagaaaggcgggaatgatgtcagctccttctggagttgcctcgctgcagggctgcctcctttgtcatgaaggccaccagctttctccatgagggtcctgggaagcggagaatgaattagggccattgtccccatcatagagatgagaataccccaagttgggggctgtcttctttaaaaatcaggcttcggtctggagttccaccctgtgcacagtgacaccagtcacaggctttggatttgggcgttcactagttccgtgtggccttgggttggtcatttctccactcccagcctcagtttcttcatctgtccagtgaaaccatgcagggttattgtgaaacttaaacatgatgagtgttcttggaaatgtctgacctacttcacaggtgttatttatgattgtttttattccttgtgtaggcagaaaagtgtgcaacactctaaaattactaggtggggtgggctcacgcccataatcccagcactttggggggccaaggcaagcagattccttgagcccaggagttcaagaccagtctgggaaacacggcgaaaacccatctctacaaaaatacaaaaattagctgggcatggtggtgtgcacctgttatcccagttacttgggaagctgaggtgggaggatggcttgagcccaggaggttgaggttgcaccattgcactccagcctgggttacagagtgagaccctgcctcaaagaaagaataataataaaatataataataaaataataaaataaaataatacaaaaataaaataaaataataaaataaaatataaaattaccacgtagtcaggacatacaagggaattaaaacctgctttttagtaagagcctctgaagaaggcctgagcagagttggatccaggctgatctatatatttgtatataaaaatatgtgcatgtaaatacatttttaatattttaatattattttcatgtattttaatatttataaagtatatatttatacttacacgtacacacacacacatgcacacacacatatgttttgaattggagtcttgctctgtcgccccggctggagtgcagtggtatagtcatgacttgctgcagcgtcagattactgggctcaagcaatcttcctgcctcagcctcctgattagctaggactacaggtgcatgccatcatgctgggctatgttttttttttttggagacaggatctcactatgttgcccaggctgctcttgaactcctgggctcaagtgatcctcctgtcttggcctcccaaagtgctgggactacaggcatgaaccactacacctggcccaggctgatattttgtttcccatctgttcttccagtcaacagtctttttcacccactactggtttaggcattgtggtatggaagaaagagtgtgagctccagagttgggcaaccctggatttacaggccagttttcccaaatcttggctgtgtgaccctgggcaagttgctttcactctctgaccttcaggtgcctcatctgtaaaatgggggtcccttaccagattgttatgtggattaaatgagtcactgcacatcaaatgctcggcacacatcctggcccgtgctggacacttaaatgatggctcctcttgtcacatgatcacgaggcactgggtcctgcactgggctgtcatggtccagtcaggtggctttggtggatatccaaagtcagtcggtcccctgccctgatggaggaagcgcaggcaccaagcccagtctgggtggtcagggaaggctcccatgagccgagtcggaagggaaggcaagggctggctaggtgcagagaccagcacaggcacaagcgtggagtgcggagtgggaggggccttttcctttggctgtgcccaggctgcctgtgggggagaggcaggagatgaggctgctgagtggacgggccccctggggacagtttgtcggggagcttgacaaggttaaggatcttctttggacatcctttcactttctctcaataacctggtgtggatctatcatcccagtatttatctaaacccttgctggacccatttatatcctccgcctctccagcttctcggcgtaatgagctccagatgtggtgaaagggccttccccaaacctctgcctcaagccgggagggtgctgggattgcagggatgagtcttcgttcaccaaaagacaggaaggccttagagcctgcaactcaaccttagcttcacccttacacaggcccaagacacttagattcgtgatcccctggggttccaggccgctgtaaggaccccaaatcctgggcctgagtgttctgtgggctccttagggggcaccccagagacactggaccctctgtggccaccccaggagtgagacaggcagccaggaagctttcagcccatggagatagcagaaatgtccccaaaccaaaccaaaatggtggctcaaaggtgctcagaaacctcccgtcttgtggttcccagctgtcagtctcaatttctaccatctcaagccatgttctcactgttgttctacaaatgactcacttttctatttcctgggtaaatgtatgaagacagaaagtccatatcccgccataaataaaacaccagcatctcttgacaccacagaagttaactgtaactataaatacaacagaggcaggacagggtgaccatgtccggctccagcctggtgctcactctttggctgggcttctgcagaagggaggacacctgagaccagggctcaggggaccagagaggggcccagggagggaggaaaaggtggcgcgaggtgtgcagtggagcttaccactgctggggcagctggggctcgatcccccaggcctggtacggggccatggagagcacacctcagaactgccacccgccctctcttgtcaaggctgttcatggggagttgcctcccctacacgtgtctgtgtgccgtgtgtcaggaggcagaggctcttgcaggcactgggcatctttgtggccccagagcagaaaagagaggtcgacaggggaggtgagaggcaggggaagggaggtgaggggcaggggaggggaggtgagggacaggtgaggtgaggcaaggggcaggtgaggtgaggcgaggggcagaggaggtgaggcgaggggcaggggaggtgaggtgaggggcaggggaggtgaggcgaggggcaggagaggtgagccgaagggcctgtgccctagagacagctccatactaggccctgagcccgaggcccccctctcctgctctttgttgcaaaagaccagtgtgtttcagagaggtggagaggtgttaacgtctcagcagccccagtggagactttctctttgagggatcaggggattgaagagaattgaaaaagggaaaatgttctcagtttatgccgtcctagaatacagtgtcaggtgccactaaatcctcttgcagatggccccggtgagaaaactgaggtccggagccaggaagggacttggcgagggcgtggacatgccagaaagatggcctctcctgtcactgcaccgacctgctgtccctgaatctgtttatgctcactttgactatttttaaaaacaaagaccgaaaaaacatttttagatggatgcaggggaggggatgccccaaatcaaatgggcacactgaggtctgaagaaagaagcctcagaaagtcccatccatcctgctggcctacctgcctcctccctgcccttctggcccatgctcccagggtgagcttggaattcttgatagtagacaaatggtgaggacagagaggggagccatctcactaggaggggcttctgggggagctagatgcactgggtttgaatcctcgctctgccctgaaatggccacgtgaccttgggcaattacttcactgcaaagtgcctcggtttcctcatctgtaaaatgggactaatacggtgcctatgtcaaaggaacatttaggatattaaatattcataaattactacatgtaaatgcttccaactgtgcctggcataaacactgtgtttgccagtcatactattattattattattagtcacagggaagaaaggaaggaaactaacatgtatttagtccttatgaaaggccaggcactgtgcctgcaatttgtgtggctcatcttatgtaatttcaccactctagaaagatagttctttgtctgagactgtcattgacgaacccagggtcccatcattgtggggatgcagccacattctgaccctgggcacgcagatgttcactacatggactcaggacaagtggggaggtggaaacgcagggagaggagccgatagctgagccgagggcttctggggcggggatgggctgggggtccatcaggctggaaggggcggctggggctagctcaggaattccgtgggaagaagcttgcactttctcccacaggccctggggagcgacaggcaggccacgagtagggagtgacatgataaagggggtgttcggggaaggtctgtgtggctgcggtttcaggatggatgggggcagcggaagggtccggaggggaggcaggaagctccactgggcggctggcctgggacggtcccctgggagaagcacaaggagccttcagtcagactgaccgccaggacctcatggtcctgggccctgacccggccctgaccctgagtcccgcctgaggtgtggactgggccccagtccttcccttcgcccgtgggcggctttatctgggagtctccggagggtgtcccgtctgggttgagcaggcctggccgcctgcagatttatgaggtgtgggggaagtggcgggggcagcgggcgtgtgaggcagccctggtgggagaggggagagctggaggatgctctccagcccatggacctgcgctgaccccatttccaccccgaactaaccccaccccatctcactgggccagccccagaacaaggcggcacctgctgcctcagtttctcctcacagacaccttgaggggtgagtagagagaggctacaggcaagaaccttagatatgaggaggctgtagacagaacatgctagaagcttctgtacccgggtcagaagatgtctatgatacgaaagcagtttactaacagtatgctgggtatgattccatttgcaactttgaaaggaataaatatgcatctgtgcctctataaatacattttatgtgcagtaaaatgcctaaatgatgtttagtttgtgacttcttctggggaaagagctttgactttcactttatacctgtctatattgtttcaatatcttgtaagcatatacttttttcacttacaaacttttttaaaaacagagtaatggtagggggtgatggtgggtgggagagggcctttgtgtttatgggtgatagggggttgcttttgtggggtcctgagggtgctcagggtttgggtggttctggaatacttgagtcattctctgctgagagccctaccctccgagagaccccagcctcactggggagaccccacatggatgagctcccaggataaggcaggcacagacaggttccagggaggtgggtagagacagtcagggagggtttcccaaaggtggcggccattgaaaggtgagacaattagattagatgggaaggacagcctcaggcattgtagaagagaagctaagagcagactctggagtcagacaggtgtgaatccaaatccttgctcttttacttaccagtcatgggactctgagcatattttgtcatcctgagcctcaattttctcatctgtgtaatgtttaccctaaagatattaaaaatcgaccaggcgtggtgcctcatgcctataatctcaacactttgggaggctgaggcaggtggattgcttgaagccgggagttcaagaccagcctgggtaacatggcaagaccctgtctctacaaaaaataaaaataaattagccaggcatgctggcacacacctatagtcccagctacttgggagctgaagtgggagaatcgcttatgcctggggagttgaggctgcagcaaaccatgattgtgccactgcactccagcctgagtgacatagtgagaccctttccccccagcaaaaaaaaatcagaccatgctcactatgtgtaagctatgcttttttttttttttttttttttttttttgagacggagtctcgctctgttgcccaggctggagtgcagtggcgcgatctcggctcactgcaagctccgcctcccgggttcacgccattctcctgcctcagcctcccgagtagctgggactacaggcgcccgctaccacacccggctaattttttgtatttttagtagagacggggtttcaccgtgttagccaggatggtctcaatctcctgacctcgtgatccgcccgcctcggcctcccaaagtgctgggattacaggcgtgagccaccgcgcccggcctaagttatgcttttaggtgtagggatcccaaaagctgggggatggccctgagaatttgaaagcaccctgccagatgtccaggaccccagcctgaaaaggcatagggtcaggaagggtcatgtagagggacccagagggtccctcctaggagagaacagcttctcctaggagagggcttcctaggcagttggatgatatggcagcccgtcgtaagggcaccaggcagtccttagtcaaggtccatcctggtctgggtatccagtggcagctggcattcatttgcatgagcactgcctccctggggctcccaggacagccacaaagcaggacaccatgctgcccttgtgccacgcctgagctgtgatccaaagccagggtgggattctggctgcccccagagactgggactcaagtcccagtgccacctctcacacatggtctttccctgcatgatcaggtcacctttctaggcctcagtttccctctcggtgacacagtggtatgaggggcaagctggacctctctctgagggccactcaagattttatagtcagtgaggttggagctagctgtcagaaccagttcatatcctcattccccagcacagagcctggtacctattgggggcccagccaggtcctggtggatggatgatggatggatgaatggatggctggctggatggatgatgggtgacggatgggtgggtgggtgggtggatgaatggatggatggatgatggatggatggatggatggatggatagatggacagatgaatgatggatggatggatgatgggtgatgggtggatggatggatggttggttacctagttaactcatgaacacgccagaaaatgacagaatcagataatgatttgctccctcctcaggtctttgcacttgctccttcctctcggaacattttccccagctattttcccagctcgcttcctcacctgccatgaagcttgacttggaggccagcatagccactaatcaccaagggctttgagcaaaacccttggcctcactgaaccctagttatctcatctgtaaaatggggacactgaggctcacctgtttcctttatactgctcaggtgctccctgtgtacttctcaattcttcaggtacttcaacaggtacttctcaacagtacctgttactctttattgcacttaatggtggtctgtttgccccgggccattcctgccaccctgcccccattatctgtcttgccccaagggatggtgggatttcattcctcttggagtcggctgagctcagtacaaccctgcagtaggccctcagggaggctctgatgagtgtcttgagtgtccctgacagtgatgggaaggggccttgcaaactgtttaggactgcgctgttgcctttcaggaagctcagctgtgcctaggtctataccaacacctctgcccagccacctccctcaccaggtggctctgagcctttggccagggaattcaaagccctttctaccatcccatccccagccccttgagttcggtgacacactttagaggaggtgtcatcctcacaagggggacaattagcagctaaccttccttgatgactgtagcaccctctggagggattctctcaccacagccacacccactgcttcaaagccaaattttgggcctggctaacagcaggcctgcatgtgtgtcaggggaggcgagtggagaggctcaagaacctgccccggatcccacccatgcaacattctcgctgcctgtcaacctgaggcttgtgcactctatgggttcaagaggcacctgcatcctctaatttgctatagaggccaaacctctgaggcacgtcagatggataacacaagtcacccattttacagctgagaaaactgagacttaaagaagttcatgcttggcttattcagacagagcataacctgactcagtcttgccccccaagaccccacagtttggtggaggtggggcactcagaaataattatctccccgcatggaggatggggtggaggctcacagaaaatggggctgagggaaccccaaaaatgaccttgtagccaggtcctgaaagctgagcagaattttggcaaatagggtgggctggggaagactgtgggctaaggtcaattccacgcatggtagtgggggcctggattctttaaggacagggacaactctgtcccctgtctgcagaggcagtcttgatgacatctattttggttttgcttctaaaagcacctcctgccccacctgtgccctcttccccagcttcaggtgttcttgcctctgtcctcaaggagcagctctccaaccttcccaaagctgaaaagctgagctcctcagagtctgcctcatgtcatcctggccacaggagggaggacacatgccatgatcccctgtccgggagggtgatataactcggggagatgagaccgcagaggctgggccagctgagcacaccccaaggcctgtgtgagtcactcctctgctgctgtaacccatttctctcctctgctccaggggcctccccatcatcccatctgtacacccaggaaagtggccttagatcacttaggatgacaggcttgggagggtggctgtgtctcgggtaggtataagatcctgttcggcctttttctttcatcctcccgacgagcctgcaaaggaagatcccatttttccagataaggaactgcagctcagagaggtgaatgcatgtgaccaaggccacacagcccatcccaatgttgagccaggtgatgccagctgtctccagagccagtggtcttgccaagtgcaggtctgtaggcttcctaggctggcagcatcagcatcacctgggaggcttgtggaaaatacagattcccagccaccaattatgagcctgcccccatgattctcttctgatctcatggggatcagggaatgccaggactgatgtttttaaaacgtgcctgagtccattgtgatgcacagccagctgctaccctgtgccaccaccaaatgatgttcaaagtgtgacagattatgagaagcaaaaaaacaaagagtagcacgaacacaccaaaatgttggcagtggtcgcggagagcgggagggatcgtggggggagataattattattttgtactttatacttccatctgacttttctgtgttttccaaattgtctctaatgagcatgtattgcttttataatgaaaaaaataaataacagagcatctggctgggaactatttggagaggggtgagaataagcattggagccatgtccacacagacccgggtcagccaccccgctcttgggcagggcacttgacactgagcactgagcctccgttcccttgtctgtaaaatggggataggaaagtctcaaagtatagctgggagtgttgagtaagataattccctagagctaacaattctccttcctccttccctctcctggacctctctctccctggcaacccttcccctggacgcccttccctgccaatgcccagttgaagcagttgaagcctcctccccggctcatccagaccctcatggtgtgtgcagtctgccaggggctttcagggctgcctcagcaaagcccattttgcagatggggaaaccaaggcccagggcagccgagggacttggttgccagctctggctccccagcagagggaggggggcgtccacgtgtctgctgcgcatctctgcctgtcgttgccttgctcagtgtgtgtgagggggcagcaagtcaccatctgtgttttccaataaaagaaaatgaaaattgaagcacattaaaaatagctcaattgggattccgagcggggctctgaggcctgctgtggcagacgcccagcctgcctccccctcctcccagcctggcaccgacatcacccggagtcatctgaggcgaacgtctcctggtggcgtatgggaaggggccagggtgcaggcagtgtccctgatggcaccaggggctgctggggacccccaattccagtttcccagctcccagcagctggtgtcccaccagagacaggagaaaatggaattggggccatatgctgggcagactccagacaccctccactccttagggctgcaggaccctcagctggaacctctacccactaagaatggctcagggacaccctgtggcagaaaggaaggtagcctcttctgggggcctggaaaccaggttcccaggccaccttttcactgaatccctgtgccttgagcaagccaggaacccctctgggcccatttcctcctctgtccagtgaggatcttggtaggggccaaggggtggtgtgtgagtgggcttctgagactcctgtctccagcaaggctccttcctggcttcatgacctggggaagccccttcccctcactgaatcccagtgacctagttggaaatgaggatgatttaggagtttcctgtaggggatgtgtcagaggacaaaaggagacatcagcaagcacttagcttggtgcctggcatgggcagggacttgaccaatggccactattgtaatccatctcattatcatgattttctgtgaaatgggagtgtgatggccccacaccgtagcaggcctgggtgaactctgcgctggctgcagtggctcatcataaggaaggctagcattcacccaggagtgctggtgcccagtgattcccagcatctcttcctccctcgtgggtccagctctctacagcagcatctagtgcctatgaccagccaccacgcagaccctcagtgaggcagacaagggggcacgattcctacctcgaggcccagagagtgctgggcagagagcagccctggatccacacagctaggcccacgcaggggttccctgccaggatctgagtggtctgagagtggacaggacatccatggaggacctgagctgcctgggtctgggcctgtgcgagcagaacctgggctacatcctgcgggatggccttgggcaggttgcttcacttctctgggcctcaatttcttcatctataaaatggggctgataatagttcctgtctcattgggctttgggaagacgagtcctgggcagggtttggtaggtggaaaacactaaatccatggtgcccctgagagcaccagcccacccccacctgcaatcccatccctccaggacagaaacttgctgggcccaccagggcccagtcacacaggaccagcacctgccctgcctcagctccaagcctctcctggacaggcacacggtggaggtggggtggctcccctcaaccatagatgtcaactaaagtggccaggccctcccccccacttcaaatgcccttcagcagagggtctgggtggtttctcagcggcaaggagtgagtgtgtggggttcatggatccagccatcacggggtgtgagagatggccactttctcgactgaggatggtctgttagtttcttgttgctgctatgactaattaccaaagtcttcgtggtttaaaacaagacgcatttattgttttacagccctggaggttagacttctgaaatgggtttcactgggctgaaatggccagcggggggtgaagggcacactacctccagaagctcaggaggaggatccatgtccttgccctttctagagacttctagaggctacctgcatcccagagcttgtggctccttcatccccaaagtgtgtcattcccacctggcttctgacatcacatctctctaacgccaaccctcccaccccctcttacgaggacactcatgattacattagacccacttggctaatccaggataatccccacatctcacgattcctaatctcatctcatttgcaaagtccctgttgctacgtaaggcaacattcccagatactggggattaggaatgtggccatctcttgggggacattattctgtctcccatagatgagaaagcaagtctgctcagcctggcccgagggtgctggctgatgttgataataacaatatcataacatccgcttattgagtgattgctttgtgttataatttgagtgataatgaccacggtcaatattttactgagtacttactatagccaggctctgggctaagaacttaacatgcatgatcttgtcacagccacctgcgaggcaggtactaatcttgttcctatcccacagctcagaaagggaagctcaagacttgccctggggtagtgggttaggaagtggggttcaaatgtaaatgactctgccgggcttggtggctcatgcctgtaatcccagcactttgggaggccgagccaggcggatcatttgaggccaggagttcgaaaccagcctggccaacatggtgaaaccccgtctctactaaaaatacgaaaattacctgggtgtggtggctcgcacctataatcccagctgttcaggaggctgaggcaggagaatctcttgaaccagggaggcggagtttgcagaaagccgagattgcaccaccgcactccagcctgggcaactctcaaaaaaaaaaaaaatctaaatgactgctgaggccactctctcagaccctgggatgtgccgctggataggccattaggccatttccctggtgtttggacctaacacctgggttctgctgccaggttcccgctcccctgcgactcgctccagtggcagatacaagaactgcttgatggggtttcaccctcgccagtttgggttcctccaagcaggggctgcggttggggcagatgcacgggaggcgctcagagagggagtgttaaaatgggaggagggcagaggctggaggacaggcaggggtgctgagggctgcttgtgggagagcagagtgggtgtctgtctgagtctaattctgtatctgggtgagggtgaggagccggacattctgggaaccaattctggccacaccactgagtgtttgacagggagccttggcccagaactctgaggctgtctgtagcataggacccccactgcactctgctccttgcaaagcctttagggagcaccagtgtgtagaaaaccctgagtctagccgggtgcagtggttgacacctgtaatcccaacactttagggggctgagacggaaggatcacttgaggtcaggagttcgagaccagcctggccaacatggcgaaaccccatctgtaccaaaaatacaaaaattagccaggcatggtggcgggcacctgtaatcccagctactcaggaggctaaggcaggagaatcacttgaaccctggaggcggaggttgcagtaagccaagatggcgccactgcactccggcctgggtgacagagagagaccctgtcgcaaaaaaaaaaaaaaaaacattgagttcatcccgtgagcaccggcattctcctttgctggaaccctggggcccttccccagttctgtctttccacctctccacgagctttccgtcactctgagtcttaggccccacacattgctacctcaccatgggatcttggaccaacccccaggctgcctcagtctttccgtctctgcattgggtgcagagattgctgcatgccagcaatccctaaggcctcagctcatgatgtgaccccttcacaacctttgtgggactgacaaggaacctccccaccctgggaacccgccactggccagttctgctccctggggtgggggcagaggggacagaagccaggtacaggaagagggcctcctgcaggagcatgtgtcttccctgctccttcagttggaggctcagggaggattccttagacattccctgtttgtggcatcctcctccatcagggtcttcccgcctccccggagagctcagctgtagccagtgggaaatgggacagataattgcaagtttaaataaggccaagtgaacactccctcccaggcccagcacaggggactctctgagctttgaagggaggcagccgggaggaagcctcaaatggcactcagagtcccagcactaccactgcctccctggtgaccccaggcaagtcacagcccctctctgaacctcagtttcctcatctgtgaaatggggaccacatggcatcacctaggaaaagtggctagcacagtgcctggtacattgagcacctagtaggtactcaatagctggaaatgaggattatgattattatccctgttcaaatgcagcgtcccgctcatcccaccccactccagaggtttctttgggagctgttctcagtcgtgttggcctctaggggaatgaggggcaatgatgattgtggtactagcctcccctgagctaggctgactgtgccaggccttgtgcaaagggcgttgtgtccatacctatgagtaggtgttatttactattcccatttcccagatgaggtcactgaggctgcagtcctatggtggttggggggaggagagggctagcagggaaggagttgggagcccatcagcctgaggggaccacccaccacacaccccatcagagaagcatcctgtcccagtgggatgcgagccagcgtggtgagatgcttgaggttccgggtccaatttgccctttataggaaaaaatttctgagcctgctcccagcatcagtaggtctgactgggctgccccaggctgctgctatcaccaccaatacagaattcctggtgagaaggaaccccagtgtggggctggggagctgatgaactgactgggcagggcactgggcccagctgtggcctgtggtcctgtggcctccggctctcatgtgaaccagcggagtggcacagccagcagcttgggaggcttctgtttggctcaggaacaaggccgggtctgccatgtttgtgggcttagcacaaggccatctgacatagcctctccttgtgcctcagggaagctgtctccaggtcacactgggcaccaatggccttcatcctccacttagcagcccagcattgcagggcctcaggcccagtccaaaaccagactaggaaagggcatcagacacactctggagggtgaattggagcccagagaaggggcatctaactcaagctggggaagtggggggtggtctgattccatgctgccacctgagcccttcccgacgccactacctgcatcagctctcacctgagactttcaactcccaaaaggctccttgggatcatgaaaggagtttgggtcacacagcccagaaatcaaagcctgcctccctcaccaacttgcagccaacttgcagggatcttgcctgcttacttgttctctctgtgccttggtttacttatctgcaaaatggggacaatgatccatcccttgaagggttttggaaagcttagaggagctcaggtgctatgctgggtgtccgttgcatgggacagtgcctggcaggtcgtaggtgctcagtaaatggtagctatggtgatagagatgctaggggtggaagtagcattccctcacctcctggtccatgtcctccttcccaccactggcccagggtgcccctcttccccctgtgtcttctccacctcgaaggctctcttgatttcgagccctgctccatgtcaagggccccaccagcccccattccagaagctggctctttagctggcattgcctctcagggtaccagtgggaaatggtgggaaagcaatggtcactaatgatgaagacatggagtctctggtgaagatggtgatgggaaatcactgagcagctctcctgagaaacatcgacatgcgagaaaatgtcccagcagagccgtgactgcttaactgcctgagatgccaggtgtggttggcaagagagcccagggagtcacactgagcagagatggcaccctggggtgttctgtcactgcatccacactgctgagggctgcggaggcggtcctggagccaagcgttactgtgggagggatgcaggcattctggaaacgtctcctccgaggcagcagcctctctcagaaagagcgagggctttggagccatcagacctaaagtggaatctcttctctgctcctgaccagctgtgtggcctggagaagccctccatacctttctgatcctacagtttcctcatctgtaacatggatcctttacacaagagaacacagcaacagctgtcaggccacttcttctgtggtcctctgctgtcttagggatgaagtcttagtccttcaacctggtattcaagactctttgtgaggccaggcacagtggctcacacctgtaatcccagcactttgggaggccgaggtgggaggatcacatgagaccaagagttcaagaccagcatggggaacatagctagaccccagtctctactaaataaataaataagcaagcaagcagggcatggtgatcacacgtgtagtcccagcttctcaggaggctgaggtgggaggatcagttgagccctggaggttgaggctgcagtgagtcatgctgccactgcactctggcctaggtaacagagagagatcctgtctccattaaaaaaaaaaaaagaagactctttgtggtgtctggagttctctttcccctaggccttccttctccctcctgcaggttcttgaaggggccctgatcattctctcctcccggcctttgtacaagctgttctttctgcccgagacaccttttccccttctcctggtgcttcctctttccctcctccttttgccttgctgtctcctactcaatttggggttcaagccagttgccactcacttgggaagtctcctctaacctccaggcagggttaggattcctcctttgctgtgggatcccccttatagactgggaccccttatgtctgggatcccccttacagactgtaggacaggggaccgtggtaggggtgaggctgaacctggtttaagttaccattcactggcccctctttggggtgggatgggccccagccatgtccatatccataatgtgatatggacaacagattcacaggccagatggggtcctcgtgaagcaggctatctgaatgcaaagggaagccaggttccagggccacagaacagagcccaggattccagactcagcaagggcccaatccacaggtagaatgtggagcttggaaagtgcttgggaactagtggcaggagccagacagggcttagggtttgctccaaatcagtaaatttctttaagtcagtgatagtatctatttttgattctccaatacttttttctttttcttttttgagacagagtctcattcactctgtcacctaggctggaatgcagtggtgagatctcagctcactgcaacctctgcctcctgggttcaagttgattctcgtgcctcaatctcccaagtagctgggattacagacatgcaccaccacacccagctaatttttgtatttttagtagggacagggttttgtcatgttgttcagggtggtctggaactcctgagctccagcgattcacccacctcagcctcccaaagtgctgggattacaggcgtgagccaccacgtagagcctgattctccagtactcagcatgggcctgacacatagtaggtgttcaacacatgcaggctggctggatgggaggagtggatagcagatgtatagatgtataaatgagtgatgtgaatggatggacaggtaaatgaatgggcgagtggataaatgaatggaaagaagagaggtagggagggaggttgcttcagaggaagggaaaaaaccgaagtgggatgctgggcataggggtgagtggataaattggtggtgtaaggatagacagatgaatgtggtaaatgagaaaatgagtagatgaatagatagatgggtgagtggaaggcaagatggcagaatgacttcataaatagctgcttggattgggtgatttgacgaatagatggatggatggataggtgagtgtgtgggtgggtggaatgttgggtaagtgaatggatgggtacacgggcgggcagatggataagcgtatagatgtgtgcggatgggtaaataggtaggtgggtgagtgagcagatgtcaagatagtttatggatgattgcaaggattggatggttggaaagatagatggatgagtgggcgtatgggtcaatgggtgaatgaataaacagtaaatttcatgtagctaaatgcctgacaccctgcccagaagcagaggggtggtctgggttctgggatttgagttaattgtccttcactgggggaaaccagtgccaattaggcaaatacatcaagtcccagcaggtcctgcagcaggcttgctaattgactccaacccaagagaccccagcttggacttacagtggcctgtgtcttattgatttgtaatttacactccattcacatgcagagggatttgaggtgacttataagattaaacctgcatgcaacaggacagttagaaataaagtgagacagctaagaggccacatagcaaagtgattaaaagagtacctggttcagctcctggatctgctgtgtactcgctgtgtgatgttgggcaggttacttaacctctctgaaggttatttcccccatctgcaggaaggaagggatgaagggaggttggttcagtaggaatatgaatggatacatatgtgagatactagtggatgaacaggtggtagaatactgggtgagtggagtgggacagatggatggggtgacagggtgggtaggtggatggatagatgggtgggtgggtaagtggggacaataatcaattatcgcatggggcattgtgagcatcaaaacagataatatgtgtgacagctcagcgcagtaagtactttggattatctactatgtggagccatcttgataccagcgactgcatttcctggaggaacagctcagacacccagaatgatgatgtcagcaggaaagagcatttaaggtctgggtgggcctgggtgatcaggagtaaggtggttttaatagagaggctggtggctaccacagtgaaccagacttggccctgcctacaaggcacttagagtccagttgagggacagatgagtaaaagaaagttgcaggacaaggtgacaagtataatgatgggagacacatataggactctgggagccccagcaccagggtcatcagggaagccttctcagaggagaagacatttgagatgggtcttaatgaacatgtctgagtgtcctaggcaggccaggagggcgagggacatggcagggagaaggaacagcacctcgagtgccaactgtggagtgaggctgtgtccagtgggcagaggggagatgcacacaacttagaaccactcagaaggggtgcagctataagcaactggggttcccaggccccctgccttcattagccagcctgagggtatctcagctctgccacgtcttgcaagtgactgcctctctgagctttcctcccctcttctgtaaaatggccctgacaattggtcctccctcagtgggtcccattaggatctcaggagatgagtattaacgtggcaggcattgttccatgcacacggtagctgcccagtaatgccagctgccatgatgatacttctttacctgctgaatagatgtgaaaactgtgggttcatttaagtaaaaaggctttaaaaattaaagaatcactgggcaaatgctggctgtgagatgcagcctggtatgtcgggaaggcttgagggcgactggcctgggttcagtttctgatttactatgtggccttggtcaagtcacctaaaatgggaccagtagcaggcgtccctcagggttgtcatgggaactaaaggagcacttaatgtgtccagggctgttcccgtccctgcctcccttctttcccttccccagcaagccctggtgttcatttaccacccaccccacccccagcaaccccgtcccagacccccatccatcatcctgtcctttgccgaggttaagtgggtccccaagtagcgaatccaaactctcccaaagccctggctgcacaatgtggcccgctgttagtgagcagccaggctggcccggaggattgggtttcagccggggcggccagtgctggcggatgcccaggccagcggcaggcaggcaggggacagagcagaggagctggcgtcacagggactcctccgcctaggcctgagaaaacaagagcaggctccaagcaggcaaccgaggcagagaagggcctctgagtggtgggaggacgagaaggggtgtgtgctatgagagtcctcgggcagaaggattttacattagctgggttctctttcctcgagactgagggctgagcagggggccgaggtagaaaaacaacgtgctgctagttggtagatttcactttagaaaatctgcattcttctaggagctagtcgggggcttctctggcatctccacctcttgccttgctttgggccagtgaacccaaggccatcctgggctcccattctcatgatgtttatagaggagagggctcaggaaactcagtcaggctggcctgggttcaaatctcagcttggcttctttctggctataggacttggggcagatctctgagcctctgcagtctcagtttcctcatctgtacagtgggataaaggtatgggctttacagggcgtgcagagggtttagctcagagcctggcaacgatagcactggtagatgaaagcagtgattcttccttccctttcctgaggcagcatagtctagtggcttctgggatcagaccaaagggatcaaattttaccctgccccttactggccttgtggccttttggaagtccttgatctctctgagccttggtttccccataagtttgctctgggatgtaaatgagacaatatcgatgaagtgcctgcccctaggtggcctccaccacctttccctatggttctgtatggtccagcctttgcatactgtaaaaacctttggctcccaatgcctcctttgatcctcaaaacaacgcagtgaagtatacagagcaaggattttgtcatctccattttacagatgaggaaacagaggctcagagaggagaagtgactcttccaagcttgtcagtgtccttgtcttctcctggaatttctaacttggaccatgaaaagagtgctgtgaccatggacagtccgggtcaggcctccaggctgtgaatggcatcttaccaggccacgagatcccagccaggcctagcttcaggccacctcagccccaccagccccagacagggtgcaacaggaaccgctgggaagagcctgggctggcatctgctgcatgggtctcacaccaggctgatttgctgcctaggctacaggccactggtcagtctgtaggcgaagacccgtgggtgtagctatgaggtgtctgttcatcttcagcttcaacccttcccccagctggcccccaattctagcctaatttcctctgccaagaccactctgtgacccagcggttctcagagcagaccacatcactaccctcttcaagaatcttccatagctccctgctgcttatgggagaagacccaacctccttagccccacatttgagaggccctccacattctggcgccctgtcctgtgctaccatctccttctgtgaagcattttgctcccactacatgggacggacactccagcatggcgcagtggctaaggacatgggctttggtgcgaggcagacccggctccatcgcttcctggccatggaaaccttgaacaacctctccaaactttgatttctccatctgtaaagggagatcctaaagtacttacttcacaaatagttaacgatgaaatgggataatgagtgctaagcgcttggcctagagcccaccactgagagccagtcatcagttttacgattgcccagccttccccgatgtcttacacttctgtgcctttgattctgctgggccctgtatgtggcgtgcccttccctctcctcccagctcacatgccacctcctctgagatgcctttccaaatttcctgctcaaagctactcccttcttcctctgggtttcctggctcctggccgggaccagccgtctcactccgcctctccctgcagtaagttcacacgtcgggcactagtctgggagctttttgagggaagggcctgctgatctgcctctgtgtctccagtgcctggctcagggcctggcacacatcgggtggaggagatgttcattgaatgaccatgactttgttacttaacccagccagagcaggaggagtcaggacagctgccaggaagaaggaagaaggaggctttgagctcagttttggaagagaagttagccaggctaacaaagcaagaagggccaggcgttccaggcagaaaaatctagaaaggtcaagtcaccagtgttcagggaggtaaagtgacttctgcaagcaggaggaaattttggatggctggatacgagagacacggaagacggtggctggaaggtaattagctggcctgcttggcaggggcctcgagtaccttgttaagagctaggacttgatccttcaggcagcaggagctctgaagggcgatcacacatggactttaggaacatcacccagctgctgtgtggaggttggatgcatgtgctagtgccaggcctagttctcagtgttgagggtacagcggtgaacaaggtggatgcagacctcccctacatgtgggccctgggagacatcagaagaacaggattcacctacatggtgtcatttaattctcacaatgacccattttacagatgtggaaactgaggcccagagagcagaactggcattcctgcaattgtacactagagtgccagagccaagattctggcctgggcagtctatgtcccactcccctgctgccctcctcctgccccttgctattctcacacaggcccatgcagagagagaagataaatgcacacacacaagccctgatgactttgttgttttgtgttgtctgttttttaaggctatggccatggcatcttaaaaataacacagttgtgaaaatagatggatgtgggttccagtcctagccctgcctgtgtgcacttatgcaggttggttctcctgtctggcctcagtttcctcgtctgtgaaatggggttaataatagtatatacttctggaggttgcgcctgaaatggcatttagagggccctggccagcgcttggcatgtataggtgcttaatgaaagtttcttcttcatgactttggaacactcacatactgtcattagtgcagacaaacagcatctgtggtcctagagaattacagcccacaaggggatcagacagagctggctaggggtggatcggagaatagggagcaaccacccgctccagcctgagagcaggcaggccccctgcagccacctcctttcagcccaacgctaacgacttcagtgtgtctcccctttaagttcaaatatttctgaaatgtacactgctcattcacacatagccagaggggccatcgggcctccccagcccggcagtcagggcctcctgattgctttcttctgtgcagcctccaggaaggagagggggtgtgggtacggtagggatagggccaaagtcactcccatggctgggcccctgttttcacactgaggaagatgctctgggctggtggccctagttccagcttttgcctggatgctaagaatctgtgtagcctctttcttcatctatccattgggattcttttaaatgggcactaagagcagccaaggtctgggaaccggacatttcaacagggtgggagggcctaagggcaggtgaaacggcaaagttggcagagtgggaggtgggtggtaccagcgaggctggcaaggatgtggggagacagggatgatccagcagaggggcctcagagagctgctaaccgttcatggccctgtcctgtgctacctgggcagcccctgcttaacccctccaggctcagctcttagctcccaccacttccagccccacccttcagccagcgcttgattcccacaaaccccgctgtggctcagctcacctcctggcctttgcctctgcttcccctctgcctagcgtgcccctcccactccacatcagtcactccccactcacccagtctttaagcctccatgcaggcgtcacgttctcctggaagccatccctaaatttggcattttcttcccctccttccgtattcatttcctgtaacctgcaataaaccatgtacatcctcattgtgatcttagccacatagtgtggtgattaattatctgtgtacagtgacaacagcttcccctgcaggagagattgtcaccgtcacagtggggatggagatagaaacatttccagagcttcagaggcagctcgagggagcccagcagctcccaaagtatgggaagtgaaatgatgttccgtactttgcagacaaacatttttaattgtagtagtctgtgtttattttccttcctgtcatggcaagagatattggttttccatttataatcatgattacgctttttcctctttaagatgcatttaagaaagaaaaggagtcaagtggaagaaaaagtagtaactaaataattgtacaggttgtagttggaaatggctaaagtcattaatgttgtctgtatgaaaggctcaagcctggccaaccctagtggagcagaacactggcgtatgctcaagtctggcagatggggagaggaggcccgtgtgccaagccctgtgctaggtcttagggatcccaggaccaggacccagcaccacctctcaggggaccacagagctttgggagatgatagcaaataggggtagttaccacccagaatatcttcaagtgccgggatatctcgaagcacccgtggctgcagagctttggggcagaatggatttaagaggacttgctagaggaggtgacctgagtcgagacttcacagatgaacattagggcaggccaagaagatgtagaggtgagaaggtcagaaggaacagtatgtgtgaggtacaagggtgagaaaacaccacattgtctgtgcggagtgagacggccagtctctccacctactcatagctaactggagtgcagcttgagggtggaatagatgtgtgatcttgggcaagttcctggggctttggaagcctcaactttctcatctatgaaatgggacagtatcaagtacctcttggcattgttgtgagaatgttggtgagagattctggctcctaatagggtctcagcagacgtgagttctctccctttgtagatttttgggattggacgggagacgtctggtgtgttacagggtggaaaaaggatgtgatggtggtggaaacagagcttggtttcctgaacccactaagttcttgaggcaataactattaactccagattccccagagaacagaatttgacttttgtgcttagtttgagaggaacaaagaggaaactcagggcaccccagggaaagcagcatcagatggactgggacgggctccatggaggctgtagccacggagcaagagactgatgcttgtcagatgttggcaggcatatctgggaggtgggggaggccaggcagactaagttggagcctcttgggcctgcctttgctttcaggggcacctagtaagcccaaaggaggaagcagtatgtgcaggcactgggtgggccaaaaagcactgcacaccatctaaaaacagcagctattactaagtgaggatctactttgtgctgggctccaagctgctatacttccagactcggaaggtattttggccattttccaggtgaggaaactgaggcttaacaagaggtagaacaaataaaggtccgtttgtttgtttgtttgttttgttttgttttgtcttcttagacatagtcttgctctgtcgcccaggctggcgtgcaatggtgcaatctcagctcactgcaacctctgcctcctgggttcaagcaattttcatgcctcagcctccagggtagctgggattacaggtgtgcatcaccatgcctgactaatttttgtatttttagtagagacggggtttgaccatgttggccaggcttgtctcgaactcctgacctcaagtgatctccccccctcaaaaggtccatttgtaatagtctgtgtttattttccttccttttatggcaagtgatattggttaccaagcaaggaagggacagaactggtgttagaatccagatctctgttacctccagagcccaggtctgtctgctctgctcatctgctcatttgccttttgtgcagaggtagagggaggggttaaaattgaaaagcaaaagaccaggttggggagagagcatgcttgtgctgcctcctgccacaacccagaggggtgacaggtttcccagagccaggcctccaggcaaagccaggagtggcacaggagaagggagcagaggagatgccggccctctacctcctcccaaggggatctgcaaacttcatgtcctttgcgttccctttgtgtctgcaaaccagccagcccatttacttccagtccttctgagatcctcccactgctttgggccactgctttgggccaggagaggtagaagacacagggggacagtggggccccccaccctaagcttcttgggagcccagagtatgagcaccaacttttagtgtgtgactttggcaagccatttgccctccttgagcccaagtttccacccgtacgatgaggatgtcagttcctggcccctccttctctgggccatggaatcctctagtgtttggcctctgggtcagcccaggaatctagccaagggatggggccacctgcttggcagccttgcctcccctgcccgaccctcttcttgtcccaagcacagtctctcctctgccttgttcgacacagctcccagcagctgttccctgggcccaggcagagagcccggcttggcgcgtctctggctgaggccgatgagagaaaacaggttaaaagttcagcccttgttctctccaggaagaaaaatctgtagcattcggagtgtgaaaaggaacccttttttcagctccaaagctgcataatagaacttccctccaatttgccatcaaaaagatgcccttggcactggctctaccatccctggcacccttaccccacaccccctccctgtgccagcccccagtgcaaagggacacagtgaccacaggcagtcatggggatgccagtgcacagggacacaagccacaggcagttgtggggacacttctgcatcctctcttgtcagctcatgggtctgactggggtcacctctgaccaaatgcttcctcctgtccccaccctttatcccctccacccctgccatagttcaaaccctaattatctgccatttggaccttctcagctgcctagacactgggcacacagccccagtctcctggtccttgtcatttagcccagaccatcaaactaattgtttcaagtgactgaaagtttataggctaggaggcaagacacctgcacttcccactgtgtcaccaactcctatgcaatctttggaagccccttcccatccctgtgcttcagttgccctgtctccaaaaggaggcggttgggctggaccagggatagcatctcaaatggttcgtatttgtttcctggaacactgtggcaagaagcatcatgtggccacagtatggggactgatgagtgatgcctgccctgggcacagaattggagcatggcaacaagcatacctctcacccactctcactgagcaaggtggtgtcactgtgaccttctaggtctctccccctactctctcatagctatttatattcacacctcatctccactaccagaccaggaactgctccatggtagggtcttgctagccacggttttctctctcagggcacccagtgcagcgcctggtacataatgggcatcaggatattttgttgaatgaacgcttgaaaggggtccatttaaattcattcggtgtattgcaattccattcagaaagtgtttggaagccagagaggcaaggaaagggtagaggacaggggtcctgaacctgacctggggagaatgggggtctctagggccatgtggctcttcttccccctaggccacatggctccctgcagctgctggaatcgggggaggcaagtggggcccaggatggtccaggtgctgacatgtctcctgaacccccacaggccatgtgacagttggcccctactgggtgcagtgcttgctctcaacacttctccactcctgggaccctgtcctgggggcagagttgcctgagccctgggggaggggccccagtgataggaacatgatggaaggctccaggtttctagagaaagggagagtgtcctgacaagatgtgtgcgccagaggagcaacgaggggaaactgaggggtctcagctgggacacaagcacagcccctctaaggcccaagttcgtttttgagagtttgatgcaagctgaaaagcaaacagatcccagagtttgatgtaaaatatcaagggtttagtggcagagcctcggaaacccatccagtagactccaggtttagtggatgtaagaccctcctcgtccagaaaaggaagggaaggacagtacctaggttagtgagactagactggcctagaggtagagcctgaccatgatgtaagggtggacttggcctggaggggcggggcctagaggagtggcatcagatgattggctaggctgtgggggtaggcgggataatggagtagagaggcggagtctaaaccgagggcagtctggagagttagagtcagatgactggggcaatggaagtaggcggggctctcagtaaagaaggatgagggcccggccgtgagggtctggccgggcacggtggctcacgcctgtactcccagcactttgggagggcgaggcgggcggatcacgaggtcaggagatcgagaccgtcctggctaacacggtgaaaccctgtctctactaaaaatacaaaaaattagccgggcgtggttggaggcgcctgtagtcccagctactcgggaggctgaggcaggagaatggcctgaacgtgggaggcggagcttgcagtgagccgagatcacaccactgcactccagcctgggcgacagagccagactccgtctaaaaaaaaaaaaaaaaaagaagaagaaggatgagggcccaacagaaagattgacagcgcctggtaggtggggcggggtggtgactctttgctctccccacagaaacgctaatggactccactacagcgactgctgagctgggctggatggtgcatcctccatcaggggtgagtcagtggtccccaaaccttgcattggtccccaggatccctcaagccctgctgcagggcccgaatgccccctcatattctaacccctttccccctcttcaggacccagagccaggcctctctcagccccaccctcccaatcccctaccattgatggagccatgatcccctaccattgatggagccagttaccatgacaacaggctggatgctttcagcctttatcccgtggaatccttagggcaaggctgagaagtaggtgctctcactacccccgttttacagatgaagaaagtgaactgtcgtttcctgagtacccattctatgtcagatactgtattaagtacctttatacacatcatctctgatcccatggagaggaattatctccattttacagatgagaaaaccgaggctcagaaaggtgtagccacctgcccagggccctatagataataagtgaaagggctaaggtttgtattcaggactatgactgagctctctgcccgctttctgggtccccataacacaaagctccccctcctttggttcttatcatcctagggtctatgctgtgagctctccaagagcaaaatctggcataagttacagactgtggggtcaaatactcctgaaaatgtgtcttagctctgccactcaccagctgtgtgatttggggcacttccttaatctctctgagcttcagtttcttcatctataaaatggtgatgatgttttagacctcacaagactgttgcgaggttttcctgcaaagtgtctaacacaatgcctggcatagattgggctcccagtcaagagtagctataatcatcatcatcattgtcattgtcatgaagttgaatattcatccctcatccccgccgtctctggactctataacccagcccttcccttccccccaccccagttcctccgctgggactcagctgctgccccagggaactgcattccccccaccccccaggcctgtgctctcaataggcagggccccagggtcaggccgctttctgtggctctttcttgtcaccaattttccatctgcgaaggcggctgggcccacagccccaccttgccagtaatgaggccaggctgggctgcagggcccccggacgcaattatttggggtgtttaggctgcagggcctccgcatgttaattagagagaggggagaaaggcagagtgctctaattaagtgttctaattaagttctgaagaagagcagcggttgtaacaaggggctgactttgtcacatggtgccaccaaaaagaaaaaaaaaaattaatgcaatgtagggagcttcagagtcgccattgaagaagaggctgagccagtcagctccagacctgccctccccatgtgtactcacccttcatcgcacctgaccctccccaggctgccagcccctgctccacacgcacagacttggcccagggaatctgagtggcacaggataaaggacacccacttgagggtgacacctcttccatcagctgccacccccacagtcacatttggcaactggaggcccaggagggagaaatgacttgcccaaggccactcatcaagttagtagagctgggactagaacccaggactcctagggcacacttggtgtccttgtgtttccaggcagcacaggcaaccacacgaacagctctgggtctgtgtgacctgggtcaaatgacctcacttctagtctctactccctcatcctctgtaaaaggggtctaaccatacagaccatgtgcgataatcacaccaaagaaatgagatcctgttagggtgcccatccccagacatggataggagaggggactctgctgttggggctcctttgggtctaccccaggtgaagccagccaacaccaaagggggcacgggagaaggacaggaggggtggtttccctcagcaagctctcagtcccactgacactggcccaagagggctgagtgtactgggcactcacgcagggagattgttcccgaaggccctcgggaaagttggtgaatgcaaacagcaggcagccagagagcctgctgcagaggagaccagagacgatgccccaggagggcacagaagtgtgcaaaagactcagcagtgggaaggagcctggtccgtgagtgtgaggagataacccgggccctaggcccttcctgccccaactttccaccacctggcccagccccttgcagcggtgaggcttagcatctctctgctgggtttgtgagagcccagactgccccagtgagggtacaggagtactctccccaggcaggaagggtgggcggcctccctccaggtacccaagaggaaatgttagcagctgaaagccccagagcagagctgttctcatggggaaggaccctgtcttccccatcatcctaggcgttcattgaggatgaggactgtcttcctccatcagaccgagagttcccaagggcaagggctgtctctccctggtcagacagggagctccccgagggcagaggtcctgtctcctccatcagactggtagcccccacaaccacaaagctatgtctactttcatcagaaggagctccctaagtggggaagggttctccctattttccccttccaggtgggaacttcctggccagggtccctgtctcctttatcagattagtgtacccctgacagtaagggcaatgtctcccctgtcagctagcagaataccaagagcaggatgtgtgcctttcccacctgattggcatgtctcccccatcagattgggaattctctgatgtcttcaccattagactggagggttccctaaggcagagtctgtgtcttccaccttagactgagtgtgtgctggggctgagcccttacctccccacctgacgagcattttacccacagtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggtaagggccagggtggggcacgtgcccctgcaaatgcatagaactggtcttggctgcagactcgggctgcagacttgggcctggcctctgaagcttagagctgaccatgaggcactctagggccagggtttccaaaccagcaaccatcgttcagcttcttagagggaggcacttgaatatagcactttctgaaaacgatccgcgcacatgccgcaggtggtataccagataatctgggttggcacaggataaaggttttttgtttacatcatcatatgagtatgtcaagtggtgtcaatttcttcctttacaaaggtgatatggttccccttttaagaaaacgtatgttatagtaagtaacatttatatattaataagttaacatattttgagcttttactctgtcagtatagaccagacaatgctgaagtgaccaaacaataaaagtttatttctccccttaatgctccatgtccattgtggatcagcttgggactcctccctctgagagccaaatggatggagcaccaccattcgggatgttgccatctgcagggcagacagatggaaggagtgtggcagttggaatactggctttaaagcttccacctggaatgcgcccccgccataacctctgtgcacatttcacgggccaaagcaagtcacaaggttacttcctattcaaagagatggagaagtgcaattttactgtgagccaggcccacgactcccccttgtactatgtgctgagcacttctatgacttaattcatttaatcctcacaaggaccctgtgacagaaagtactgttgtatatgaagaagctgaggctcagagagcttaaacagggactaagtagaggatctgggattccaaagcccaccctcttaaccaccatgccacactgttagcttaaggaaaactattaagtaagtataagtggtgtttgaatatggtaaagaaccatgaaggtggtctgcaaacaagctttgcaaacacgagaagtttgtgagaggtacaccctggtgctaagaaggctgtgaaggttgaaggacctgggttaaatcaccccttccactcactagcggtatcaccttggccaagtgtaaaaccctccttcctaggctggtgtgaggagtcaggaacttgaggcatgcaaagtacttgtaatggtttccagtacacaggaagtgcttaatagatgttaactaaatgagatgatgtgtacaaagcccagatgctcagcctgtgagctgcaatggtggtgctgggggtataggggacttgaagctacttgtgtcatgtcctcttgcattccccattggattcagaggttggggccagatcctggggtgcctcagatgccaggttaaaggtttggaccctaatccagtggccttggagaaggccagggatactttagcctgggggtggttgcagtgatccttacgtgataaaatgcttgttaaatctaccagctctgtgcttcctccctcggagacaagcaaggcagcttttcaagatacctagaaggacagatgggggtgccagagacaggaggaaggggcctataagggaaccattgttttcatctcaagagacagcctggagtggggcatccacctgtgctggggaagaggagaggcgagatcaaaggatgttttgccaatgaaagggataggatgggaaggaagacaggatggaaagggaggagaggtaagagtcacagggaacagggcattccagcttgcagaaaggtgatggttctagaaaagaaatgggcaagttaggagaaagggctggtttcttggggaagataacaaatttggttttacgtccttgggtataaaagtgcacagccttggaaggtggcagtggtgagacagtgtgtgggtggcagaacaagtgaatgggaaaccagccactcactgttgatggtttgttcagtcatcaaacttttactgagcctgctctgtgttagaccttatgttgagcatcaggcagtacagagaagaatcagactgtggctctgccttctggagctcagagtctagcaagggagacagacaaataaatgtacaaaggtggtgatgtgttagacttgttttaataggaactgctcaggctacagtgggcgcagaaaatgacagaaggcttcacagaggaggtgacattggagctgagtcttgggtgggtggcccaggaatgctggaggatggagctgcatgaataaaggcctgggaacatgaatcaacttggcccattagggaggcagttttggtatggccatggctaagggctggaggagggatgtaggaagaactgtgacaggcggggtgttcagatgagaaggtatattcattacctattgctgcataaaaaacaaccaacagatcaggtatggtggctcatgcctgtaatcctagcactttgggaggctgaggcaggaagattgcttgagcccaggagtttcagaccaacctgggcaacatagtgagaccctgtctctacaaagaaagaaaaagaaaaaaattagccaggtgtggtgatgtgcatctgtagttccagctacttaggaggctgaggtgggaggatcgcttgaggctgtagtgggctatgattatgccactgcactccagcctgggtgacagagcaagaccctgtctctaaacaacaacaaacatgcattatctcatagtttctgagggtcaggaatccaggtgtggtttagctgggttcttctggctcagattttcccatgaggttgcactcaaggtgtggcctggggctgcagtttcttctgaaggctggaccagggaggggtctgcttttaaggtcactcacggggttgttggcaggactctgtccctcaccacatgggcctcttgcatgtgcagtgacattccccagagtgagagagccaagagagaataccagcaaacacccaagacagaagccacaatcttttataacctaatccagaagtgacatcttgccacttctgccatattctctgcattaaaagcaagtcacccaattcagcccataccccaggggagggaattacacagggtgtgaatgccaggaggtgggatcatggggccatgttagaggctgcctggcataggcaggttctcagagtcagagctactccttgcagatggtgagggtgcaaggtggggcagggttaaggtgtgcccagccctggctcccttccaggctcccttccactctcatcttcccctggacctgaaagcctccccaaggcctcagcccagcccagccatccactgagtgtgagtggggtccagtcagggtgtgattaatgagctcagggagcccagaaggacaccagctgttgctgtggcctgtgctgctgtcacccagatgtgaggctgctgcagcccaagccccataggcactggccctgctggagcaggacgtgcaggaatggtgattccagctcacatccaagtaacattggccaagtgctttctcgtcctctagcttagggcttctcaacctttattgtggatcagagtcacctggttagttggttaaagtgcaggtttctgggtctgactcaaacctctcccccaggtctgggaatgtggctctgagatggggccaagaatcagcagggtttattttgttttgtttttttgtcttttgtttttgtttttttttttttttttttgtgacagggtctcactttatcactcaggctggagcgtagtggtgcagtctcaactcactgcaagctctgcctcctgggttcaagcaattcttgtgcctcagcctcctgagtagctgggattacaggcgtgcaccatcatgcccagctaatttttgtatttttagtagagatggggtttcaccatgttgaccaggctggtctcgaactcctggactcaagtgatccacctgccttagcctccctaaagctgggattacaggcatgagccaccgtgcccagctggaatcagcatttttaaacaagcagtcctgatgattctgtaccaggaccatgagctcagacgcacgatgtgataacacatgtttggctggaccaagctgggacctaaggccaaagaaaggacactagcccagccccaacaccaccccagggattgtcctccctggggcagtggaacattagcagaatctctaagaggatgtggtttgaaaagatgcatttaatattgagatataatttaataggaaaacatccattgctttgttaatataaattagagaaaataaggctggattaagtcttcttggcagatggagagtgggggagtcctcagagggagtggccaccattcctggtgtgggcagtgatggtgaacaaaggcttactagttcccagtgcagtgagtgggctaaactgattcaatctgaccaacttctctggtgcctactgtgtacagggcacagcgggagaggggaggggcctggggaagccaaccattcaacatgcatgttttgagtaacctctgtgggtcatttagccctctaacaaatatgcgttgcatacctgctgtgagccagacacattccaggtgcagggagatacggaaatgaacaagacggacacatcagtgccctcccagagttttttgtctgagtgggtggataggagaagacagaagaaaaagtcagtgagcaaataaataaactagttgcagaatgtgatgagtgaagggggaaagaattgtgcaacaatagagatcaaaaagtggccgtgcttcaggaagggcttcctggaagaggtatcattgagctgatgggcctgagaaggctgtggggaaagcattccaggcagagggtccctgagaaaccctgacactcagggcttggtctgaagtggctcctgggtgagcaggggactcagacacccagggaacgaggcagagtatggtgctgccacaaatgagatccatccaggcaaagtgctttgagaatatgaggaaaaagccatcttgtatgactgggtatctcagaaggcttcaaggagggagtagcatttgaattaggccttgaagagtgagtaggatttggatgggtgaaggtagggaggaagggaattgtaggcagagagaactatacgaataaaggccccaaggtgtgacagtacaaggcatatttgatgggtagaaagggctttgcagtgtatagggattaggacacaattttcccctatttattcacctgttcattttttatcgcatgcctaatcggggtctacactgggcatacagctgccaggtgaggattcctgggacttcctttagaagagccctgttccctccccaaccccagtccccgctggggcttcctgccagcaggtctgctgggagtggcagaaggtgtccctggaatgccttctttgcagcagctgcccgcacccaagtctgtttctctgactctttctagagtatgataggtgtgattgtgaatgttcccctgccccagtttctccaagcctgcctgtctccagatccctgttctccttggtctctccttacccacctcagtcccacttctgcctgcccagcaggaacccccaacctagccttctttggggaccttgctctgttctctcccagtggccaacccgcatctgcgagggatctggaggcagttccgcagtgagcatgattgctgcgatgctatcggacgtaatgggatttttaatatttagcttggatggggagaggggctgctagccagctcggggtggttgcacgcacatgttgattcgctggctccagctcagactccccagttcccagctgctgggtttctcctcccagcctctccctcttgtctgccctgccctgctgtgcagcccctgctctctccccagctcatggcctctccttgaccttggcttcagagacctgctttcaaaccccagccctacctctcactagctgtgtgaccttgggtgagccactgaccctctcccaacctttgttttctcatctgcaaaacagaataaacagagggctgttatacagagtaaatgagaaaatacccagaagagtgttataaaaataagattaaggacttttatgaacactgtctttgcctgtgaactttttttttttcctggtgagctttttattttgaggaaaaaataacttttccttatcacaaaagcaatgcaggttatttgtagaatctttagaaattactgataagcaaaaaggaagaaattaaaatcacccataatcctatcatccagaaataagcactgtgaaacaaactggtataggttcttccaggtggatttatgtgtatttacacatactgattttttgttttaagaaaaaaatggacttctgcttaaattacatgggtttctttctttctttctttctttctttctttttttttttttttttttcctttcagagagacaggatctcactatgttgtccaggctggtcttgaactcgtggccacaaatgatcctcccacctcagcctcccaaagtgttggaattataggcatgaaccaccatgcccaggaggagaatttttgataataatattttgtggacatctttgcatatcatgtcagagctataacatcattgtggagaagctcttaggatcccatagaataaatgtaccgtaatttatttactactgctctgttgattgacagatagattgcttgcagtatttcactatcttaaacaaatgctggggtgagcctcattgtttctctgtctttttgcattgctgctgatatttgcgtaggatacatttctaggcgtggaattgtagggtcaaagggcatgtactttttttagagcttttgacaaacattgccaaattaccctccagaaaggctggaccaagttaccctccaagcagctgcctttgagagtgcctgtttgctggcatgctctccagcatgggatgttatgcctgtggctttattttctgtttcactccagaatcctgtgcttcccagccaagggagggaggggccaggggtcctttctgggccttcagagttggatcctccttcccaccctgctttcagctcgagcccttcttacagaggctggaccagtggcccagaagtgtctgggggagtctgcgggggtggggtgcggtcaatggggtgggctctgggagggaggccgccagctggcagcctgtgctatgctgactggggaagggtgtgagggttggaatgctgggtgggaggggaggcccagacccccacatagaaattctgctgcttctcttcaaggacagggtggagacacccagttgagggagaaggaggggggacagacaactcctgcagacccccaggctcaggccagggctgagaccacacaggccagccttttgtgaagggaattagatagggaccctggccaatgtactcaagtgattcaggcctttgctcttaaaaataggaaaaattctacaccctccccaacttcccctttcctatccatccattggtccatccatccatccatccatccatccatctgtccatgatacatccatccatcagacatccactgaaatcattcagctcttgatttttcttcttcttggagggctcagtgatgtcttcattgaggaccaggaagctaacacttgttgagtgtcatgtgccaggcattagggggccttggaaatggccatgatgacccctgcccccaaggcccacccagcctagagatggtgacagatacatctacagacagtgaaggtgcagggggactggggttgtgctgaggaaagcagagcaggcagggagggtctgtggaagctgacggaggcacccagcccatccaggggagcgtcagccaggaacaggcggtcagaggacggcctccaggaggaggggccactgcggtggaagctgagcgaggagcaagagttaggcaggtgaggaggaggtggaaaggcctggaggcagccagagtgcatgctcctgggaagggtgggggtcagtcacctcagtcctctctcctctctgagtcagctaaatggaaggttctggatctcaggacatgagatgattctttctctctggtcttcaaattcctagtgatctgggtaggaaatatgggacaatttgggcttcagaacagctcattcatttttcactcaaataccacttccaggacacctgctgtgtaccagttcctaggccaggtgtgggagctgcccagatgctgaaggccctccgtaccgtccctcgggctgccagtctagggcgcaggagagagctctatccataactacagacttggggtgcttaggagggaatggggagagagccaagaaggcttcctggaggaggagccattttcccagggctttggaggatgagaagaaccaagggctgaaagggcaattagtccaggaaaaaaatggttggaaatggtggtggtttttttctttttaaaccctagcctcttgcttatccccagacaaggtgcagccatccagggaagagcagaagaaaggtgttcttggccaagggaggatggtggaagtgctgccagggtttcagttctactgccctcgcaggctgagggtagtcctgagaggcctggaggaggcccgagacagggaggtgaaaggtgccacctgtgtgtcccgcactgtggtatatgctatgcttccattatcttattgaaacttctgttggtattattagctctattttacaaatgatgagactgaggcccagagagggtcatcaagctgcccaaggccacacagccactaagtagccaagctagaatttgaacctggctttctgcagcttgctgggacaacttattaacctgaagagattaataagttgtccagatgtactcaccttttatacctgaatgtactcaccttttatacctgaggcccatgtcttatccacatggtcattgagtcccaatcctgtagaccctatggagagtgaccagcagggtgtgatagaaagaacctcagtttgcttacctgggaaatggaaacattacaccctggcctgcctacctccagatgacggaggatcccctgagatggtggaagtgaaaagagcttggcagataaccggctaaggggctcatgtttaggactgtgggacctcaaaggaaagagggggctgaccctactggggtaaccaggagggcttcttgggagaggaggagacccgggtctgggccttgaatgacgaggtgctttcctatcaagcgatgcaaggcaggatggaacacagtcccaggacgaaggctcgggaataaggaagcctcagggaaggaggcttccccaccctggctgacctctggccagagagaaaagcccccagtctgtcccacaccgcacataccaaatgctcacccggatgggccgttcctgcccagtcacctccttgaatcctctcatcagactaggaaactgagacttggccaatgtcacacccctcttaggtggcagggacaggtctatgcctttgtgccttccacttctgatttcttctgatacaagcagtatccactggccctcagtcaccctacagggttagataaggtcatccctatttcacagaagaggaaattgaggggaaaagtccaagatgacccagctaggaagaagtagggttagaacccagggcatctgaccctggagccctgcactgtcctctctcggccccagactggctcatctggaccctgaaaacacataggctgcctccagatcactccagcaggaccataaacagctgggaagttccccgccctccagccactgccttttcatctggctgggctttagaatctggcaagagaggcccgttgattgaggaagtttatgcatttaacagtttaagcctttctaagcctctggtacaacaggatttgggagctgttaacaattctgtgtggttaagagcttttcattgctctgcggcagctggcacaggccccactggcccactctggcctcaccccaccctgtttgggcacccccgtccctggggcctgttatcctcactccccccaccctaagccctacacctcatacctcacaagaggaaccgaggcccagagaggggaagaaagttacccaaggctgcatggcaagtgagagacttaaaccaagacctgcctgagtccctggagaggagggaacattctattgttaattctttattggcagaacttgcagagcctccctaaaatcaacatctgtttgattccctaccagggctccaaggcagggagtcggaggtggctcgcccaggctcactcaccttatcaggtacatacggagctgaaatcaaaactcaggcctcctgaaatcctaatgagaattcttcacgccatactgaactggtttccgttttgttttgttttgttttgttttgttttgcccccatagcttggtgggagaaatgccatttgtaatgataatgtcttacatatgtacagtatttatttacttacaccctgctttattccagaaaagattggaggctgcttttgtgtaacattcggattcactccatgagatattttgatctaaatgatacccacatgagagaagcatggcaaaggttattggcaccattctagagacaaggaaaactgaggacacgaggaggcatgactttctcagcgtcccatatactttgtcaggcagaagccgggactagaacccagtgctgcaggctcctagacctggctctttctggagccccttgtcatctctaagatgtccaatcagacagctccccccgccgggggaggttttccgggacctgttaccatcccgccaacccatccacacactcctcttcacacgagccacgtgttctcaggtctgtgaggagctcacactgaggctggcctgcctcttcccacccagggcagagaccaaggtctcaggggagcccaggggtctcactcctgctaaggtggaagtgggtgcaacaagtatttattgagcaccttctgtgagctcagcaccatcctagaacctggaaatacagtggtgaacaaaacagacaaaatagctgctcttttggaccccacactccacctgggaaagacaggcagttggggaatacagtgggaaatacacagtatgtcaggcggtgattaggacgacggggagaaacaaatcagggaaggggatgggctgcgtagcccccatggctggggggccaggggttatcctgcggggtgggctggcctgggactgctgctcttgctggtatcctgggctttctgctccttcctcgggccttcccagtctcttcccatgggacctggtggaggttggtttaagttactgttttcataacgaggattttgttttctggtcacagtaacctgcttgcccaatgagacaacaggccaaggagagggctgtgagtgcacggccatttccatctcacttgcaatccgtgagctttgtctcctgtcctctctgtcccccccatcccccaaacaaagggggccaaggccacagcttgccagcttcacagctgtaaaaactgaggcccaagaagttagatgaaatgacttgtctggggaccggcactcaaactcagggtctgacgcctgactctgtgcctcttgctggaatctacttgtaagtaacagaataagaatacccggaggaggcaggcacaggctcttatcaattgggtgctcactctgtgccaggctgctgccttgagcttggtgaacactctgctgaatccttacagtccccagaagctgggtacaactattgcagaacaggaagcagaagttcagagaggttaaataaccaagccaaggtcacacagctaatggacagaggagccagaagtgaaatccaaagcctgtacttgtcctgctggaatattcgcagtgtctcatcattagtacatttttttcatgactgttatctcattggattctcaaggactctaggaagtaaaagggctattgtccccattcttcagatgaggaaatcttagcatggtgaagtgacctgcccaaggcttactgctagaaagggtcagagctgggactggaacgggggtcaccgggttggtttgattctgaagcccccttgctgctgactcccgttcctagggctcatgaacacattgatatcagacattcgtccccttcattccactaaaacagctcatcatcgaggcctccagtgatgtccatgttgccaagtcagtgggagacatggacgtaatgtcccagacctcatcttcttcgacctgccagcagcatctgacaaagtgactgctccctcttctgggacctcactggctcccagggtcccacccccctccacctctcgctctgagccctttgtggctagttcctgttcatctcccgacctctccaccttggagggccccagtgctgtgtccttggcctcctcttctctctccctgatgactccacccagccccacagcttcaaatgccttctctgggctgatctctagcccagacctctattctgaagtccagactcactccactgtctcctggccgcctccaccctgctcccaccctgcctcctccagtctggggtccctaggatgcttggtctggccagaatctttaagactccccatcctgcacagtgcaaaagccaagctcctaaaaatggctcacaaggcccttcatcatctttcccttctctcacctttctgaccggtctcctcccgtttcctccttccctcccgctctctaggcactctgacctccttctgccgggaatgttctttccctagatatccacagtggttgctccatcgtcttcttcaggtctctgcccaaatgtcacctgctcactgagatcccgcatcacccaatttttatacaggcacgcagcctgtccccttccctaatcaccatcgtcctaatcaccatctgacgtactatgtatttcccactgtgttccccaactgcctgtctttcccaggtggagtgtggactccaccagagcagctatttcatctgttttgttcaccattgtatttccaggttctaggatggtgctgagctcacagaaggttctcaataaatacttgttgcagagtcccacccaccccagtctcagacatggaccctttcaatcctgctgggagtaacgctactaaccaaggcccatggagaggctggggttcttcctgccacctctggagggctcctgagggactgacatggccagggcgccccacaggtctgtctgtggctgggatagatgtttctaagcacggatggagactccttattcctgatactcagggtttccctaagatctcaaatccctcttggagctagaggccttagagagcatttttcagtcttacccatttttttttttttaacataaaccactatagtttcagctcctgctcccttctttgccctggcatgaccatgttctgaatctctgcagtgtggtcctagaccagaggctgctgtgggactcgattctctcataaggagctggtgggagcccaccgtgtgtctgggtctgtgcagacccggaattggaagttgccagggggagccttgcacagagagagctccccgccctgccactagccacccatgagactgactgacttggttacgtccttttcctgagcctcagtttccctgttgttaaatgagaccagtagtctcatttaacaacaggtttgaaggtttgaagaggctccgaggagtcaaaggagctcagaaggcaggagcaggatgagaagggaggcattgtccggccgcaggatggatggtttctcagggtggacaccagcccagtgctggcagagtttctagaaagcaaggcagtatctacatgtctaaggtgggggggacatggtaatggatgagccttcagttttaagcaagtccgagcacacagcaggtacctaatatgtgcgtgtgtcacggcactgttttaaccagccagggtgcattgattgaatagtgcaggagcagctcacaaagtcagaatccctgggtacaaatttgagttctgggaccccagcagagcacttcccctcgctcctccctcctgtggagctcagtgtcaccgtctgtagaatgtgcctaacagtccctgattccattctacctggtccttgtggcactcctcgagaagccatcaggacagctgtgaccttctgtgacatgaggataaggaccctgtgttgcctcccaccactccagacacccacaagcaggaaggtttagcaaaataggtaagagccagccacctgggttcaaatactggctctgacatctgctacctatgtggccctggacaggtgactcacctacccaagccttgatcgcctcatctctaaaatgggttcagtaataaatggaatatgacagagcaagttgtgaagactcaaggagataatgaaaagaaagtgtctgcacagcacctgacatgaggtgtgtggtcagtaaatgtttgccctgtttgacacagcctggcccctgcgatctaaatgctcgaagtcatgaccatccccttttgcagatgagggaactggggttcagagaagccaagtgacttgctccagtccacacagcaagtaagtggttgtcactgaacacaggtcgtttggtggagcaggaggtatgacctgggtgaggcttaggggccatgcagagctatgtctgtcgctgtgtccccagcaaattttgggcccagagcctcatggcagccttagagagaaaagattccgccctggggtctttgcaggcctgacctgggacctgtcagggttatactggctccttctaggaaaccagcctcaagttcccagttccctcccttaaaggcattgccatctgattagcaacattttaaagacctaagagtggtcactggcgtgtctgtgctgcctgggcaggccatgcagctttgagagccccacatccgtatccctggcaaccctggccctgagctgccctcccccacaccctgctgtcagagctgtctgtctgtgggagctccccggagacccgggagggatgtgcacgcatgtgctgggtcagcacagagcgtccctgtacgcatgcgtgtgcgctgggcctgctgggagttgtttgtgtgcccatacgtgcactagcgtacccactgagccagcctctgcacatgctgttggaacgtctcggatctatgggcatgtacgtacatttcaggggcgggctgcgcacagagcttgcctgtgtgggtgacactggagcctgctgggagccattcctctccctgtattggtgtgttcctgtgtctgcctgacctgccccagcatatgtgtgcagggaggagcacactcatgagtgtgctggatcaaagcacacacctaagaatgtgtgggtgcagccgtggagggaggtccccatctgtgtgtacacgccactgctgttgagtacgctcactgggtcatgcaggtgtgtgtttgcatgggtgcccacccactcacagggaaatcagccagagtattcagattcatgtgtacatctgtatattttatcaagccagatgtacgtgaaaatgggtacttgttagcatatgtgagccctatctgtgtgagtatatgtgtgtgtgtgtgtgtgtgtgcacgcacatggctggatcaatttgtggagtgtgtgcgtgtgtatgtgacacacacacacacacacacacacactctctctctctttctggggaccaagatatgtcagggccattgattttctgtctcttagaaattccctttgaggtcctattcatgcctctttcatgaagcaaaatcagtggttccagtgttcttaaagcaaaccaggcctgttttgcgcaacgctccatccctggcccgcccatctcctccaccggttgtgcctgcacacacacatatacccacaggacctgcttgtcgtgctcaggtgggcacagcagccctgcaggggtacagggggcaggctccctggccagactctgctgctttctagctgtatggccttggccatttcccgtcatttcctgagcctcgggttcctcctctgcccgataggcacagggtggtggtgaagatgtgagtggtgaagcccctgccaaggctggaggttctctctcatctgtcccggctgttacgtttacgaagcactttcatctggggagagaggcttgtgtctgtcctcgccaggccagcagaggagctttgggaagggacacccatgaatgccccccttcctgtgggccctctgctccaagcattttgctgacatcccttcatttttatcccagccaccgccctgggtggcagctggtgttatccgccttccacagaggggaaaccgagccccagagaactgcaagggctttgtcgaacttcaccgagagcaggtggcaagccaggattgggacccaggtccagtggactccggaaccttcccaccgcattccaagaacgcttcctccagcaagcaggagtgagaggccaggccttagaggatgcccagaccccacacgaggggatggcctacaggcccaaggcaccatgtgggcagaggtgcagcatagggaaactccagcctagaggaaataggccctcagcctctgtcacttgccttgggctctcccatcccatccccttccccctccagatgggcagcccctcgtggggtcccctcccgccccctcgtgctgcagtctttgtggcccaggaagaatgcctctctttatctcccagacgccccttccctttgattctcctctacccagcgtttctgctgacctctgcgtgttgggaatccaattagaggagcggacagggagagtgacagccgcgccgaatcccgcctcagcccctccgagcacgctcagccaagctgcaagcagcgcggggcctgcttgtcatgctgggccctgcgcagggctttgtggggattagctgctggggggtggggtgctcgcagatgggaccagaagtgatgctggtgaatgtcacgtccaggcagagagtggaggagggggcccgcccagtgttgaatccagcttggggaagagaagagaagggggctagggggcagactagcctggcctataggaggcccatgggggaaatgatggcccagttgggttatttggttccccatttgagggttggagggtagagctggcagccaagctcagctgtgtctacagtggagtgggcaccagaaggatttccacctgggaggggctttgggggattgattggattgcaggggtgggtattgactcttcatttgcaaaacactttatgtatgatggaggtggggaccctaagaatggggaggtggcaggctttgagagatgtgtctagagaatctgccaccaccagccaccccttggcagggccaccagtctaaggccaaagactatgcccttccccagccagcaccatgaaagttacccttctggtttacagctgtggaaactgaggctccgagaggagaaaggtctggctcgaggacacaagggtagtccgtagcagagatgtctcatccccctgtccacccgcaccacccagccccacccccaactccctggacctcctgagtgatgagagtccctgatgcccttccccacagagggatatggcatctgaggaggtggatttcaggccctcaggggaagcagtatcaggtagaatatggtctgactctcagctcacggaccagcaaatgcccctgcccctctagaaatgtgtcaggccttgtgctgggccagaacacagtgggatctgccatggcctctgcccccaggagcccacagtggacagagacaaggagcccctggtgcacagagagggtggagtgtgtgcatggagcagtaaggactatggggacccactggggagactaggactaggatgtggggatgggaccaccctgagcctgggagtcccagaggcctttctagaggaagggccaccagcacagagacctggaggacaagcaagaaatagcctgaggaggctctggctatcctaacctgagaggcagggtagttgtggggcttctaggggaagggcatctcctgtccctcaaatctttgtgctcattccatagctgcctgggccgggcaggactgacccacctcccacccgctgccctagtgaggctgcacagctgcagccgctgtggagttggcagccactggatgttcaggatcttctgtaagaatcgtggttaggccgggcacagtggcacacacctgtaatctcagcactttgggaggctgaagctggaggatcacttgagcccaggggttcaagactagcctgggcaacatggtgaaaccccatctctacaaaaaaattaaaaattagccaggtgtggtggtacgcacttgtagtcccagctactagggaggctgaggtgggaggatcacttgggccaggaggtccaagctgccgtgagccatgatctcaccactgcactctaacctgggcaatagagtgagaccctgtctcaaaaaaaaataatatatatatatatgtgtatatatatgtgtatatatatatatgtgtatatatatgtgtgtatatatgtatatatatgtgtgtatatatatgtatatgtgtatatatatgtatatgtgtgtgtgtgtgtatatatatatatatataaattagctggggtgtgacgatgcatgtttgtggttccagctactagggaggctgaggtgggaagatcacttgagcctaggggttctaggctgcagtgagctgtgattgcaccagtgcactccagcctgggcaacagagtgagaccctgtctcaagagaaaaaaaaaaagtgtttagagatagtggttaggaggccacagtgccacaagccaaccttagagatctggaatttctgtggtggtgctaggcacattccatacacatcttcaccaatccctgggagcaggagttgcccaccccgtcttacaagtgagaaaacaggttccaagaggcagaagggcttgtgcggtctcacagagcacattaatggaactgccttttacactcaggaccgcattagacctttcccaccatcccaggctgccgcggccagtgtaggaatgagcttattgggttggctggtttggtcctcctgcccagcactgtgcctgccacacaggaggtgcttagtgggtgggggatggatgcatggatggagaaaaccaatcaatcaatcaatcaattcttccttacctagtgcctttaaggaaaaaatctgcaccaccccccatcctgccagcgaaggctgtattaaatatgaattaatctttcagctcagttctcatgaatataaaatgcagagggtgtgtgaagccaagagatcaagacgagacaccccagtctgcctgggcctgaaagcgcacgctcacacccactcacacttggaagtgcattctcacagtcatgcagactcactcacagtcctcagccaccctccttagcccctctaggaacctccccgccccaccctgccctgctcagttgggccccttccaggtcaggcttctctgggccaccactggcccagctctttcccatcccacacccttcccgcccctcccagctctctgaacttgactcttccctcccacctgcctcttctctccttcctccccttgtctctttgcccccgcctctgtcccctgctccttcagtgtcctcttgtcttccttttccttgtcttagtctctccatctcccctcctctctgtttctctctctccctcccctgcctccccacttgtctctctccccgtctctctagctccctccccatttccttctctaaggggaccacttgcctgtgcctggacatgccagggaccctgggcaaattgtgggctagagagtgaatcctccctcctcaacccagacacattggggtcaggacatgccccccaacctccccctctagcaaggggcacaggtacctacataccagggccacaccttgccccctctccttgcccccaccacctcccagggctggcatcctgcaggtacgggatgagccatgcacccggagtccacaccagacatctgtcaaatccatgtcccacagggggcctggcctgttgattctgaaggacttcagaaaatggattctaaagggacagaagtgtgtcctggttcgaggtgaccccatttgtgtgtctctgagccgtacgcagtctctctcagcctcagtttcccccccaggcccttgaataaattaaacgaggggctgccagcccagagtgggctgagataaatgtctcctgacctcctgtggtactccccaaggtgaacattccagacctgccactcccctgtggcctgactcaggccctccctttcaggagctgacctccctcccactgcctgaggactctggcacaggatgctctcaccctctgcccctctccccacctctctacaaccacccagtccagacagctgggctggaggggatcagagactgtgagcagccacctcccacccatcctggacccagggtcagcaaggagcgggtgggggtgcaaaggctgtgattcttttgggtgggaatgggggtgagggtgagaatcaggcaggtgcatgtacatgtgtgtatgagagagagagagagattgggagggagagggagctcactagcgcatatgtgcctgccaggggggctgcagatgtgtctgagggtgagcctggtgaaagagaagacaaaagaatggaatgagctaaagcagccgcctggggtgggaggccgagcccatttgtatgcagcagggggcaggagcccagcaagggagcctccattcccaggactctggagggagctgagaccatccatgcccgcagagccctccctcacactccatcctgtccagccctaattgtgcaggtggggaaactgaggctgggaagtcacatagcaagtgactggcagagctgggactggaacccaaccagcctcctagaccacggttcttcccatcaatggaatgctagagactccagccaggtacaaagttggataaatgaaagaatgaataatagccattgatgtttgtaaagtgcacagggcaaacactttataactcagtaatcaccccccttttacaggtggaaaaactgaggtgcacagaagtgatgtaacttgcccaagtttatacagctaataagtggcagagccaggattcaagccagcaggttccagagtctgtgctcactgtacctcttagaataccaagtccttgaaccgcaggaattgccacatttctgtgcccccggctctgagcactggctaggcacatagcaaatgctcaacagtgcttgctgagtcaatgagtggatggatggatggacggacggacggacggacggacggacggatggatggatggatggatggatggatgggaaaggagttcaccatgaggatggcttcccaggccccaggatcccagcttctcagcacagtaaggtcctactgcgtgtgcttggctcctgccgcccctattcccacccccgccaggcaggtgttagctgtgccctccacagggccaggccccacagggacaaagccgagggcgcgcctgggcggcccagcgcctgcataggctgaagctgctaacaggctggaaatctcttttgtcaaagcctgcactgcctccaacctcctttaattaaagacaattagtgctttcagcccctctgcacagctcagctcccctgtttgcaaacacacagctgcgggagctttgtgggccccccctcgtcaccaccccccagccctacttccccagagacacacagaggtgcctttattatcagcactccggctgcagcaccaagaggcaggcgcctctgcttaaaggaaggatgggaacgcttcccagctaggcgggggagcaggaatagttgaggaccctggggtggcctggcacatgtgggccatgggtcccacgcttcgaggaacagccacttggggcacctctgagggacctgtcacctccccttctccccttctgtctcctctgctcctctgggcctgcttcctggaatttgggctgtccacatgttttctcccagaatcttgtctctgacttgggcactgtagggtgtagatgctggccctgagtactaccttaggaaggaaggaaaagggagaaatggcttttattgagcacctgctgtatgttagggcgcttgctagactctggctctacacaccatcattctgaaatatccccattttatagatggagctgccaaggcgctcagaacggcttggtgacttggtcaggcatgacaaggacatagcagaaccagcatttaaggtcaagctttctggcctgagcatactggttggatctacgcatatgaggagcccagcctcctagaagtcaaaaggtcagctggtccagctccctcccagcctctacccccatggtctgagcatgtgccatgtgtactagggaagtcacagccacatccatgccctccagatgctcccagtaaagggaagatgccaccaacagacccttacacagtggcagtgccctacaatggtggagggctctacagaattcccggacagcacagaggagggagtgactttgcagggagaggtggaacatttgagctggttctcaaaaggtgaatggttctcaaagaggacagtggggcaaaagtattctagccaaaggccaggggcataaaagaaaagcaaattctggccaggcacagtggctcatgactgtaatcccagcactttaggaggccgaggcaggcggattagctgaggtcaggagtttgataccagcctggccaacatggtgaaaccctgtctctactaaaaatgcaaaaattagctgggcatggtggcgtatgcctgtggtcccagccacttgggaggctgaggcaggagaattgcttgagcctgggagacggaggttgcagtgagccgagatggtgccactgcactccagcctggccggcagagcaagactgtcacaaaaaaaaaagaaaaagaaaaagaaaagaaaagcaaattccaggaaaggtgagcagttcaggcaggaggggtatcactgggcccattgtggatgaggggactgaggttccccaaacctgaatgcggtgctgcacccaccccatttctcagctcctgcaggaaaccatgactgtgctcactctcctttgaatcccaggacctcagccagtgcctggcacagagcaagggttggggacatatctgctgagtaaataaaatgtcccaatgatggcaagtgagaggcccacaagctacctgtctcccttcccgggcacagggcagacataccaaattaaccacggccctcttccacccagtccagaaggggcccgaggccaactcctgggagctggtgagtgtggtgaaactgacgtgtcaccgcagagtcaagtccaatgctcacattttgcagatgagaacatccaaatagtatgcttctgaatggggaggaagagataataagattaatagcttaacatttactgagtgatatttatataccaggcacagttctaagctcttaatgtatatttaattcccgtaacacccttatgacacgggtattaatcttcatcttctcattttacaacgagaaaagctgaggcacaaagcagttaagtaacttacccaacaccacacatcagtacgggatgtgcagggccaagattcaaacccaaggaacctcactccagagtcatgctctcaaccactatgccatatgtcctgtcctccatcgtcatgggacctcgtggcccccagagctggccaccctgcgggctgctgggcatcctgccttgctataaggccttggcttctcccactccagtggagaacagacagctgagtcagagctggtggggccgggccaggcctgggatccatctgcctttcagcagcctctgggcccatttcctcgggcccagacagcttcccggcggtgcctctgcaggcccttttaagtcccctggcaccctcagccccacttcctgtgacccctggccctggcctgacccactccgctcagtttcccaagatgagttgcagaagctgcagggtctgtgcagagaagggaaaattaacgagctgctccccggcaattggcagtttccaggcaccagctggcctggagtatttactcggcaccctcagagcaagacaattaagtggagcttaggttggggtgcagagatgtctacagatcagacagaaaccttcctaagatgtttttccaagagatcagtgcctaagaacaagtttccagggaaatacagtctttattcatccttattagtatctgatatattaatatacataacgtatatgttatatacatactcatttaattatttagcattcactgtgtgccaggatccttgttgaatcctcaccatctctctgcaaggtagacatcattatccccattttacagatgaggaaactgactcccagcaaggttaggaggcatctgccaggtcacacaggagagccaggatttgaacccaggactgtctaactctaagcttctgcttcttgcatagaacagacctccctcttggtctctggttgattgtatgtagcactgtattaggcaccaagactgcgcgaggagcaagagaaaacccagtgtgtgctgtggacttatgtggtgctccacagcaggcacagagaagaataagagcatgagaccccttccctgctctgagaagtatcattttgaagatatatgttggccaatatgtgagcccaaggtctggtcagcttgactggttctgaaggtagggtagggcttcacttaggaaacaaaccttgtgctgggctttgaaggttgaataggagtctgcctggtggagatgggtcaaagggcattccaggtggagaattcagcatggacattatagtgctttgcgtgctagggaagtgacccggagttcagcctgatggggtgtttggtaagatcggtggggttgggggacttagagggttggactaggcagctcttgtgcgggagacctgggcaccagccaagaagagacacaggagatgggagcgggaccctgccactgccaacatgatcctacggcaggaagggcctgctcaacaccatgcagcaggggccctgggctcggccaggggtcccccagccctccactgttctcctgtttcctgtgccccacagtggtggggtggagggagctggtggattgcttggccattgagcctccccttcgtgctgccctccaggagcttcacatccacctgtctggcaccaccccacattgggccattactaactcactctgtgacctgaggcaagtcacctctctctgggcctgggttccccaaaagtcaaagaaggcactaaaccagaggttgtccttacacctctgcatcctagagttctctgagagaatgagtggtaaatccccacctcttgggagtttcccagtgggtggggatcagggcagggggtgcagggacttcccatgacaaggggcacattcagggacacaaccgaccccagcagagctgccagggcaggaagtttatcttccagtctctctgccttcccatcccactcccatccaggccccatctgattccttgtcacttaatttcccctgaaatgtcacctggtccctgtcatcccaccccaaggccgggaaagaagtatagttcgaatgagggactttcaggcaccctaacacacccaagaggccctggcagccccaagtccccctcctcagtgccacccagcccactggcagctcccaaacaggctcttattaaaacaccctgttccctgccccttggagtgaggtgtcaaggacctaaactagggagtcagaagaaagggtcctgtctcagcttgacaacccatgtgctgcgtgacctgggtaagtcccttgccctccctgagcctctttttcttcatttgtaaaatgagaggggttggaaagatgaatgatccgtagcccatgtgtgtatgagaatctccgaggcccccaatcccatgtctgatgctgttggtctgagaatgggaccagccatcctgtgctttgggtaccactggcgtaggagatccctgagggccaagttcgggtccaacgtttgtgaactctgcattaggtccagattctctgtgcttctctgtttaattcctcggaccctaatgaccagcaagcaccacagagcaagacagcgcccactccatcagtccccaccatacttacgatgtccaggccaggtttaggcagaaagtcatcttttcccttctctttcactctcaggatggctgtccccaagcttgtctgtcctcatgggtggtgagataaggggctaaagataattgcctgggcactggggatggagggcagaaagtttatcttccagtctctctgccttcccatcccactcccatccaggccccatatgattccttgtcacctaatttcccctgaaatgtcacctggtccctgtcatcccaccccaagaccgggaaagaagtgtagttctttcggaccatgtacaggaggcagaggggagggagcctgcagagtcaggcctgggcttaaaatcccagccccttggccgggggcagtggctcatgcctggaatcccaactctttgggaggccaaggcaggaggatcgtgtgagtcccagagttccagaccagcctgggcaacatagtgagaccccatctctacacaaaatttaaaaaccagacagacatgatggcatgcacctataatcccagctcctcaggaggctgaggtaggtggatcacttgagcctaagaggtcgaggctgcagtgagccatgatcacactgccaaactctaccctaggcaacagagcaagagcttgtctcaaaaaacgaaataaaaaccccagccacagccctgcttagctgtgtggcccggggcaagtcagttcacttctctgagcccccagatatttgttgtgaaatggaggcgccacatctacctctccagatactaggaggatgaaattgtagtgaatgtaggcaccaccagtcataccccacttgtcctgcctggccagggagggaaggggagcttccaggggagcagtgaagctgcggccctgcccgcggggcctgagctgctggaggctggcgcaccttgggcccacctggggattttccatgaggcttccactcggagtgggcagcaatgatgtcagtgaaatcatggaacacattttgtaagaaaattaataagaaacggatgaagatggaaattatgaacccttggaaaccacagcaggaggggtgtggtactcagaggtgccagacccacccggttgagtggggggaccctcagaatgaaggaaattgggggcgggggctgtggagagcgagacgttgcctgtgaaggcaggagggaggggacttcagggcagccagagggagagggacgtggccccacagccagaagggccactcatgttgagctgggtcctggcctcaggctctctgagcctcggcgtcctcatctgtaaaatgggcatagtaacagctatagggatgaaagaagttggagcaagcctggttagatgggactccataaacagcagctggcattgctgttcatcgtgggtgggagtcgagcattgccgtcttcaacccatctgaggctggcaggagtttgatgagtgttggtagaatgaccagattgacgacttggtggatggactgacagacaggtaaagggatgagtgaatgactacaaaccaccttcactggccacaggagcctaaatctgtgtcttgtatttttcttctgtcacccacaagcccccagctggctgctgacatctagtacccttttaattgatgatttgtaatttattataatttggcatattatatacttgcgttatacttcagtatcatactctgttataattctataaagtctagcacctacctagtacttttctgtttacaaagcatatctagacccttcaacttgccagtcaggcaggttctcttgttttgaggtgaggaaacccaagctcagagaggttcagtaacttgtcacaggtcacacagctcctgagtggcaggaccagaattcacactctgggtattttgtcttcctggggcactgccggcagggctaggatatttctggtgatctggagcctgacttgaaggtgtagagtagggtgaggggtccactaggcatgggatcaagaagaatggggtgaagttgggcatctgagatcagaggctgagggtggggaaaaaagctcaaggccttatctgtggtgcagtccggctccttgtgggagcacaaagggcctgtgccacaggaggttgacctcgagatgagcagctgaggtgggtgctggcagaggctgtggaggggccatctgggaggtagggtcagcagtaggcaccacgaggcattgggagatgggtgggcatgcccggattttcctgaatgaagtgtcccagatgaagcatcactgtccaccagccatgtgaccacagcaagtgacttcactctctgaacgctggtttcttcctctgcaaaatgggggctacaatgagagaagttagggagccttcacagccctttgcccagagcactgggcaccctggctggccagtattctattcatcccccctgaaatatgccctctggccctccaaagaccacacccctgtatctgaggctcagaaatgatagtcacatggctgggcacagtgactcacgcctgtaatcccatcgctttgggaggctgaggtgagcagatcacttgaggtcaggggttcaagaccagccggccaacatggtgaaaccctctctactgaaaatacaaaaattagtaggacagggtggcgggcacctgtaatcccagctactcaggaggctgaggcaggagactcttgaacctgggaggcagaggttgcagtgagccgagatcgcgccattgcactccagcctgggcaacgagagcgaaactccatctcaaaaaaaaataaaggaaaaagaaatgatactcaccacatggatttgttggcttatctttatgtatttactgaggacccattgagtgccgaacttgaacattgctcagtgaggctagtagggcactgggtccaggtgctcaagcttatctgagaaacaacgaagaggccattgcagctcagggtgatgactgccctaatgcaagtcgacattcagggtgcagtgggagcaggaggcggtgtccccaacactgcctggaggaggtgggcttatatacctatgcagggtgatgctggaaagtgggggggtgcaaatggagggaaacagacacccactaagcacctactctgtaccacgctctgccctttccatccatttccctgtcaagcctccttgcactgcatcatggtagtctcctcatgcccactttacagatgaggccactgaggctcagaaaggtgaatgcactgcttaaggtcacacagccacaaagccaaccgcagctgaggtgtatctaccctcaaagccactgaggttggttgagtgggcctgaggtagggcccagggaggcggggaagaagcatgggctccgagcccagtggcccaggagctatgttctcaccaggccagccgaggccactggcagccgtggtttacaaggcatggggctggcctgactgctttgcttcacaaatgcacgccggctcatctggggtacatttgcgcctttatgagtgttcttcaaaagcccagctcggctctgtgcctgtaaccatggagacagctctgggtggctggaaccagtcgccctctatggccacgcgtgaaggctgccaggtgctggggccgtcaccacgctgggcagggcacccatagaggcctttcctgagaggtgcttgtggatgccaaggggtgagggtttaaatccagttcccaggaaaagtgaaaaggtcaagtctgcttcattgacggcagagccatgtgggccaagaccacctctctggcccaccacgtgcctgctcttcctgggtaaatgtgagccttcccttagcccgccgcccttggaatcaggacaggctagagatggaaggtggggggtggttgtggggggtacaggaggctgggtttgagtcccaaagtgcagccccacacagcctaagaccctcacaccgaaatcccattttccaaatagggaaaccaaggcccatagaaaagaaatgagttgcccaaggccacccatcaaggtagaggccagaggaagcctggctggaccctggctccgagttcagtgctccctccaggccaccatgaagcttctcagtgaaacctgaggtggggctgggcccaggatcaggccgtgttgggtgcagccagcccacgctggaggctggcctgagccctgcattggccccaggcccttcttggctctcaattttggtccaagtctcaggggccgttcaaagattccgaaggcatgtgaacattttggaagcaatttgtcagtcctggaagctgcttggaggctccaaagactgtttaaagattccagaatctgttatatttgcaagggctgttgttcatagtttccagagtggtttgcaggccctgggcgaaggtccggaggcagtgtgggggtctggggctggaagcatggctgggagcccggggcggtgctggaagtggaactgacggctgtctaagctcccagttttctctccaagggctcagtctatgaagccaccatgtccatcgggcatctgctgttctgagaggcagaaggtgtgtgggtgttggcagcagcaggagaggatttaaaatccaactttaccattcacgtgctgtgtcacctggagccaattacttaacctctctgggccttcttttcccccatctatacaatgggacttagaccacctgtgctgcaagcctaactgtccaccacccatctcatctcaggcatctgtcggattagtcagagaacatccccatccagaactagttaacactgttcctgggtgtggacttggtgtctctatccagggtggaagcctggccttctgtaatagccctgccggccctcctaaaaccagacctctctgagccccagccctgctgtgtctgtcactggggaggagccatgcactgtgccaaaggccctggttgaccaggatgtctgttcctacccatgccccgtggaagtttctggctggtcacaatcccagtcctgcctcctgccttcttcataccgcattgccttctccagcactcttccttccaagcccattggcccaactcccccatccccacccaccagtaccttaggtctcaaacttgcccttgccatcctctgggccttggctcacgctgttccctctgcctgtcccatctctgccgttccccctgccaccctcccacctggaccccttgcggttccctctcctccagcctccaccctgtctcacgttgctgattagagtggcacagtctaccctccaggtctgcgttgcctccttgccaccaggtagcccctcacagcaactgtaggatataggcctgactcccagggtggtcatgaaggtcagatgagatgatggataggcaggagatgtataaagtctaaagtgatgaggctaatggtggctgagtgatttgcctaaggtcaccctgggggagatgggggccaagccaggacctcagtccaggtctcctggccaggacgtcgaccactagagccccagaccatcatgggtgcccctctgagaagttttacttttctccaactccctgacccacttgcagagctgcaagcaggcaggctggctcccagctgggataatcactggccgctggctgaggtgttaaatgcatcgtgccttcctggtagacaggaagatcaataccaaggtggatgggcagcctcgctggatgccacagccagcccccaagggtgagaatgggccaagaataaatataaccaggcctgctccctccacagggtcagaccaggccagatgaaaatgctgtagctttgatgggaccacctgtggcattatcatcatcatcccaagcaacatgattagaccataaactcttctaaacttgtttgttcctgacatgtgtaaactcactgaatcctcataaccacgctctgaagcaggtcctgatattattcccattttacagatgaaatgtggcacagaaaggcttgtgactcaccgaaggtcacacagctagattagaacccgcagttgcctgggtcagagcccatgcctgctgctgggatagtctgctgcctttttagtcatatggaccatcctgtggccacacatgcccacaggctccttcctgttcagaaatggcaaatcaggggccttgtctccagcccccggtgtgctttgggcacaggggtcttcagtgcctgagcttcttggagttttcagagcttggactgtgctttagccaagagctcctggacatgtatagacacgtacctagcagatgcccatgctccctcattcttctagagctcagagcaggcaggctaaaggcgagcctggtccccatagacactctgggcatgagtgaccccctgcttggcatgaactctcagggatccgagcccttggactgcagtggtctcagcctcactgcccatcggctaggggcctgcatagccatagccaaagatgggccttcctaaagggcgggacgggaagaggactccatccctgagcttcctggggttagactgggaggtgggacagaggtcagcgtataagctgtggaactgctgaatgggaagggcccagcccatttatcttttccctgaagggcagcccgagtgataggaaatgtctgggctttgggattcaagccagcaaagcccctgccttctgtgtcatctgggcttagacacttaacctctctgatccttagtctgtcgcttcccttactacagctgaccctttcaccctctgccagaccacgtggtccacctgccttcaggtccttgtgctcgatccatctgtctcaagctcagtgtacctggccagccccccacgacctcttcttccagtcccaccccgagtcatcctccagccctccctcacctcaggctggctatggggacagacaccaagtcctgcccattttctctcctaaatatccctgagtagttaccttccctcctggccccatgaaccaccgccctggctctgcagaccttgtcatcattctggatttgggcagtggtctccctgcgccccctgcctgccctcttccccatccagccattcccctctggcagctccagaaccatctttctaaaatggaaatctggtcatggtgtgtatctacctaaaacatgtcctgattacacacaggataaaggtcaaactccttcctatcccacaaggaaagcctgacaccctccggcccagccttcccattctgccttcagccatgctgtgcaactgggatgtgctgagtcctacctctgagccttggcacatgctgttctctaggcctagaattcccctctttctcttccctcccctgcaccgttcatcttagcatccgtttatccgtcaggtctcagttttgacgtcacctccaagaatcttcccttaaccactccctcccccaagactggggtagttgaccatcccctgagctcccacgcttcatgcctcccctgtcactctgaattgtcaccatctgtttatgtgtctttctctccactacacagagtccccgcccccaggctcagagatggcccccataggttagagtgaatgccccccaaccccaacctaggctcccccctcccaggggaattcttacttcctggctcactgggggcagctaatgaagtcctagtcccacctcccccggagccatgctgtgagaccttaggatagtgtcttcccctctctgtgcctttgctgccgaggagctataaaaagacaagcctgaattagatgacttctcagggccttgccagctctgcagttccacagcctggtcgcccagcagatgtctctctctctctctctctctctctctctctctctctctctctctgctggtctttgtgtcttttcattctgccttgaaactccatctccggccaccgcctctcacaacctctgttccagtctctctggcagcccctcctttccctttctgccccaagacttcttgtgaagactgaggtcttctttatggaattccggatccaggtcgaagggcagtcctggaagcctcctggtacccccattcatcctcctgtcttgggacctgccatctgcatagccccagtagggccattaagtcaccatgagtcaaaccaagttataaataagtaaaggggtgagggtccccaagggcactcaaccccagctggctgccctatctctggccagatctggggtcctgaccaccccgggacagactcagcctgacagatcttgacatgtcgtcactgtccctggagagtgatggggaaatcaccaggcctccccagcccccattagtgtcagtaattgccaatcaatttcctgggagcctggtgaggaagaggcccctgggtacctccagtgaggaagccacatctaatggcttttatttggattactacaaattgatgattttttttttttttaatggagctttggttttcctctccgtgtcttaaccaccccctcagggccagttagaccaaaagatgagtgatggcatgactttcttctctggaagagccgagaccagcctggtcatacccacaccactcatgtatcctccatgctgaagacaggcacttcctgaagccatagctacagctcccatttctccagcagtaaccccaccccagaccctccccaaggttatcaggttgaaactgcaaaacaaccctgttgagatatatctcaccatccccaggaaaaggggaggcaggctcagaaaggtggtgagacctagctaagatcacacggttaataaatggtaaagttgagatttgaacccaggtctttctggcattgaagcctcggtgttcccattcttacatgtgtcatcccacgtataacagagagtgaagatggttcccctgaaagccagagagcaacaggagtgacagctttcatggggctcctagggcagagattagctgatgagaataataataatgatagctgtaacaatagcagctattgctgagcgcggtggctcacgcctgtaatcccagcactttgggaggctgaggcaggaggatcacttgagcccaggagtttgagaccagcctgggcaacatagtgagaccccatctctacacaaaatacaaaaaaattagccgggtgtggtggtgtgtgcctatggtcccaactactcaggaggctgaggtgggaggatcacttgagcccaggaggttgaggctgcagtgagtcatgattgcaccactgcactccatgcactccagccggggtgacagagtgagagcttgtctcaaaaaaaagaaaaaaaattagcaactattatttactgagcccttaattatgaaacacagactatgccaatgggtttacataaatgttttattttctccttggaactacaccaagaagtatttgttattataaccatttcacagatagagaaaccaagacttagaggttaagtgacttgcataagatcgctcagattattggtgctagtagaactaggactcaaactaagtatgtttgaatccacggcatgcacttttaaccatttgcatcagtttggattatgagtaacagaaaataaaaataatggtggcttaaacaagattggagtttattcttccctcaagtaaatgaaatccagaagtaggcagctggtacagctccataatcgtgaaggactcaggttcctgtcttggtcccaagatctaagctggctgctaaccctccaaccatcgcatccacattccagccaggaggaaagaggaagcggtaaagatagacacgcatgcttcttttaaggacaattcccagaaattgcagctaccatttctgctaacatctcatcagccagaacgaaatcacatgactatactacccagatgcaagacagtcaggaagcataagcttgattctggaatgccatgtgcccagctaaaaagtagagcctattgttaaggaataaggagaggtcagatattgggacaatcatcagtgacttccatcagcattattctaatgctgatgtttagatggaaatttacagtgcagtctagtaagtcatcaaatccagctttctggtatcccagaaaaggaacctgaagcccaaagagaggaaggcactcacccagaattgaacaaaaaatgggggcagaatcatgttcggaagcctgtctcagtaatcacaaaacctgagttattggcacaagaaatgccctctgtccctcctacattctgggacatttcttctggttcttggattgttcctctcactttcccattttcctctctcccttgtctgggccttagggtagttgccctttggggcttctgttaacctttggattgagtaacagaggatctgattctgttcccaacatggatacaaaagatgtctgaccttggcctttagcattctggtctgaggatcttaaaggtctttcctgctcggacagtcagtttacgagatactctgaagctaggggtggtttttgcttagtgaatgtggttactggtaccaatagatccatatattcctcagcatatgaggctccggtggtggtacttgtggaaggggcaatggataagggagaaaaaaaactaaggtccttggatgatgctgggaggaaagaataatctttattagacatctactatgtaccaattacagtgctacaataaatgtaagtaagtatctccttattgctagacaatggctcttagatagggttaaaaaatagagtaagtccagctatgtgatcttttgaaaggacacatctaaagcaaaatggagaagggtcaaaggtgaagggatgagccgggctcagtggcttatacctgtaatcccaacactttgggaggccaaggcaggaggatcacttgaggccaggagtttgagaccagcctgggcaacatggcgaaaccccatctctattttttaatttaaaaaaaaaaggaaagtgatggaaaagacctaccaaacaatgctaaaaataaatttaaaatgaagatgagaaaagaaaacaaaagtggcaatgttaatataatgcatatttcacagttgaggctcagaatgataaagtaactcacctgaagtcatctagcccctaactggcagaggtgtgatttgaagccaggtctttctgtctcttaaattccttcttccttgggaatgtctggttgcctccagtgaagttggccagcattgtgaccttgccctgatgggatacgggtctggagccaccatcacagagcaggctggagcaggcaaaagtgaaaggaaggccctgttggccaaagggaccagtcctgggtcaggacatgcactggcatctgggccagagcctggaccaactctcagagagccagccatgtgctgctatggcctgccgtccagtttcaggcccagtgcccacaggggtctccactccctgccttccaatccctagtctcaggcagaggctgagatgatagaggacccgtcccacagagccacatggctaaggttcatgcctggaatgtagttccctctgcgtggcagagaacagcaggcctgaggcctccaggagacagtttggctgtggttcggctgagccctaagctaggagccactgagacctacatataccctatccattcccagagcaagggcaacagtggggccagaggcaggtcctcattgtttcttaggaagagccagacaggagacctgggtccaagttagctctgccacatcccctgcacacatcaggctccagtcatcccagatggacccaccacggctcccaaaaagcaccctcaactgcctcgctcctctaagttttgcacacgaaacacaacgtgcaaatggcggttagctggcctatgtagctaacctggcccatccttcataactcaacttgggtatcacctcctccaggaagccttcgctgactcctcttcaagtctgtattataatgtatagaacactgggtttggctttctctttacttgtgtgtctcttcagccagtgccctgtatcttgaactaatgtgtggatggcctttaaggaggtttgtgaacctcctttgtgaaattgttcacaaaatgcttcctgtgtgtatatatgtgcatttgagtgggcagcagtaataactttcatcagattgttttgagaattaccactctagactgtgatgctcatacagttaggaactgtgtctgtcactgtctcctcaagtgatatataataatagaagtaggtgatataataaatattaattaaatgaacattggatgaataatttgcggggtgaccttaggcaagtaacttcacctctttcaatcttgattttctcatctataaaatgggaacaaaagtgaggattccactatctaagcttttcctcatctctgttttccttctctaccccagcacctagcatagtgcctggcacatagtaggtgttcatagatatgtatgagaggaatggaaagatgagcgattggtaggcaggtggaagaatcagtgtttagatgaatgaatgacagtgagcgagtgagtggctgctatccactatgtggagagaagacccagtggatgtgttggtaggttcactggctggacaggtaaaacagtgcctaggaagataggttgatggatgggtggagagagtgagtggacatattcatgctaaataaatggctagatgaatggctcagcaaagggaaacttaagtatttgggaggggctggataggtaggtaggttttttataaaatcatcagtggatgggagaaaatgatgaatacatggatcatagatggatttgtgaatgcatgtgtagatatatgattggatagatggatggaaggaaggaaggtctaactgatggatgggggaaggaagggagggagggaagaaggaaggaaggaaagaaagaaagaaggaaagaaagaagaaaagaagaagaaaggcctccatccaactcaggccagtgagtaggaaggcagagacagagagtttcctgtgaacaaggctggcttacagagcaggtaagccaccttccagagctgttgtgtattgggccccagctgcgctcttcctttccatgggtccagggtctctctggcggtgccaatattcagaaactggtataggatggagacaaagggagtaggcagataccagggccagaaggagggagggaagacgggtggaggctgggcctgccattgggcagccgcccctgtttactcagctccagaatgaagccccggagaagggctgttcatatttctaccttgaacagggagctgacattaatgaacagctaattaacatcttggagtgcgatggttccagtgtcagtgtccctaattagtctcgcgctaatctgctttaattaactgtccctgtcgtggttttaatttaattttcagctccagcctgggatggcagccccgtgagcattccgtcccagggcacctgtggccagggcagggtgggttggccagtgccaggttcccaggggcattgccagacagcccagcgatgggcagagctggtaacagagcctggctcctctgcagccctgcgggaaggggacttggggatgggacactttcctcatcttctcaaggaagtattctcaagtcatcaggagctcctagaacattcataggtcaggagcatagtctgtgactgcaccttgatctcaagaagaccccgtaaactgaccatactttctggacataagctccgattcaggtaaacctggattcctgtgtgaccttaggaaaagcacttgacctctctgagccattctaggttatcagccccattcgttagttatacagttggatagatggtcagaaggaaggaagatctaatccatggatggggctaatgagatggggctgataacctagatgctggcatcccgctttcaccaaagatgcagtttttcaggggtgatctgcatacacacctaactcctcggatgatccagttggaacacacactatgacagccacccttgggtcaagagtggagagggctgggaaggagcctagatcagggggtgagcggagcactggtccaggactcaggatacccaggtctcaggcctagctttgctgctaccttcaagtctctcaccctctctgggcttacacctcactcccatccataagttggaaggggcaggaagagggagaacaagatgctctctgaaccccctcatgcgttggccagagttagagaatagatgtacagctggctcagaaaacctgacatctggagcaggagaactaagtgggagccaggggctagggccaccctgggggccaggtgtggcctctgccttttgcaaggcaaagcaggaactagctgaggaggcagtggctgccttggtcaccaggaccctgctgcaggtgggaaaccaaatcaacatgtctgcccctggcaggagccagagaagcatctgccaagagagttagacaaatgaggatcgtctggggggatgctggctggtgtctgaggtggggaggggagagtccaggatctgagtcagatcccttgtcccagagtggctgggagctaagagtgcagggtgggttgaaggctgaggcctgaggagtgaggaggcccctgctgaggctggatgccagctcagggatttaagctgtaaccctgagggcactggggagccacggccagattctgagcaggagagtagctagatcagctgattggccactggcagtgcgggagtgaattggagtgaggaagcaggaggcagggaggctgccttccttcaggcagtgagtctactaagtgcgttcagtgtgacctccagaagcatagatagtgcactctttagaaaaaggtgggcgcacctgcctctccccacggccttgggcttaaggagtatgtttggcatttccttgtagtaccagttcccagaatatagctcacactttctgcaactggggtctgcaaaccccagaatggggagagggtcccaaatatattctcaggggcccaggaattctaggagaatttaaacttttgatgtttagatttggatgctgattctaacagacaatttggttttgaccagttctaaagcaacacttctctcccagtgatctctcaagggggaaggcatccttgctcctggcatcggaggactggagaggtagtctccaagggccacaaaagaccatttccgtttctaaagagtctgttcttgtccagccctgagaaatgctgtcacgcctgcctcccccaggacagtgagctcttccagccgtgctggagctggtctggctcactgtgtctccgcagcctgacacaggtccggacccagggagggtttatgaattgaggcaggttctttctggatgtcccacagctccctccttgtctggccctgagaaatgctgtcacgcctgcctcccccaggacagcaagctcttccagcaatgctggagccagtctggctcactgtgtccccgtggcctgacacaggtccaaacctagagagggtttataaattgagccaggttctttctggatgtcccacagtcccctccccctgcctttgacctccagttgatctttgctttcagtccagtctgagctaaaccagtttttcctgaaattcttagtaaatgagtatggaatccagagctcctgccccgcttcctccctaccagagcacaagatttctatgaaaggagaagaacccctcacctttctcgattcccctcccttgctcatggaaactcctcacatttcttcagatccagctcagaccaggccacctgcagagagccctccctggcttccccagatgaatgtgtcagtctgtcctcggagcccctggaacatgtgccgcccccaggcccaggtcctctcttttgtcttgcattgaatatattcatggcaggaactggattgctcccatctgtgtgtgctctgctcccaacctggctcacagcaggggcccgcaggagcaggtggaagagaggtgcccctcgtccccagtgtattctccgcaagggtccagtggccgccagcctggcctttagcatggtagtgttatacatagtagtggctttgctgtccgtcaagcctgcatgcaacctgactgctaaccagccagtgactttgggatgcatctcctgaaatctcaattttctcatctagaaaatgggtaatgatggcacttacctcgtgaggtcactgtgaagacttaatttaggagactcatgtaaagcgcctgggtcatagtaagtcctcaatcaaaccatgccagtgatgatggtggtgaagtgctagagcccagagtgctttacacagagtcagaagagttaaaagaagcctaattctgagtgctacctgctaaccctcctgttccctgtctcactcacgcctggaaatggctccgccaggactcaggcgactgcagagataacaagccaaaaggtgacagacccttggccttgctccaggggccttcaccatccacatgcatttagagacctgcacgtgagggacatgcacagtgatacagagacagagccagggctataaacgtgagcactcacagtcatgtgtgtgtccacacagccacacactcagaataaggagaaagaggccacttttgatgcccaagcaaagacaaacatttcaaagcagaggtggccatgggggatctctgttctgcttccccagccctgggccactgatgggctatagccacccccactcagttctctctgggttgagccagctgcccaggctcatggctgttttagatcttgtgtcagtgactagagcagggacaccaccaggggctgagctcctcagggactgcagtgtggggttcatgagtgggtgcatatgcctctccatggaccctggcagaagtagcagcagggcctacactggtccatgactcacccaacactgtggcttgggaagcagtcgaggcatccgggcccctccagctccccagcccagccgtgcccaccccacctagcagctcctggagcctcttctacatctgcacggatgagcattgagttgacccaatccttgttctggcaggaagaggccagagggtccagactgtaaaagaaagctggagacctttcggagagaactgtgaacactgatagaacggtcaagcagccaggggctagcagtaggggaaggtgacgaggtcagacaacccaagatgacaggctcacgtgacatcacagtcaccgcctgtcacggccacagaaatgcacagtgttaaaatcacagtcaagcaagaattttagaatgttacaggcctagaaaggttgtaatcatagaattatagaatgttgcaatcatttaatcattgaagcactaagacgactaggcacagagaggccaagaggcaggagctttagaatgttgtaggcataaaagggttaaaatcatagaattacagaattgtaccaccatagactattaaaattgtagcctcacaagcaggaattttagaacggtgcagtcacagaactgtagactgttacagtaaacacacacgcatagaatattcacttgtagacttacaggcaggaattatagaatgctatagtaatagaatgtcatagtcaagaactgtggaatattcaatattcaggtgccgtagtgtcacatcaagaattagagattgtgagtgctgcaagaacattttacgtgtcttgtgccagatcctgtgcaaagcacgtgacactgactgactcgttactcctcagagcgctggtgaagtgggcggatccactatggggctgggaggtaggagccacatgcagcccccaggccctggagccttggcagggaaggtgggagcagttgcctgggcctgcagttggcccctccccacccctagcacacacccagccgggagaggctcccggtcagcgtctctccttttgttaatgtgtgtcttaggggcccaccagatcagcttccagcttatgggcaggatgcctgcagcctgatggggtcggctctacaggccccacccagattccaagccagggtgtaagaccatgggtgcgtggtccccagaggcctccctacaactggccttgaccctcacctgcctgtctagtgcacaaatagccacattgattttcatcaaacacccttcccccatccatcattcatccattctgtcagttgtcattttcagatcaccttctgaggtcactggggaggtggacgtgaatcaagacagccccctgctctaaggaatggaatggtagggccatttggggacacagaggaagtgctgtgggggttggggatggtggggatggccagggcatcacggagggcttcctggaggtgaggctgggtctcagactaggcagaatttggctccgtagggatgacggatggcaggggcattccaggcagaggaagtgacaggacaaaaggcccaggagacagccgcatgtgatgtgttcaggaatcattaggagcttttgtttgggcagcaatgaaggctccaagtgatggcaatggggcaggagaggtaagtcgaggcaccgagcagaggcttttgagtgccaggctaaggaggtcaggatttgtaaacaataaatggctgtgcgagttcatgatcatgctcaagtttgactggtgggaaggggggactagggctgacaatttgcttttccttcctttagaaacaagaaactgcaaattccttcccaggactggtgggccaaccctgggctgggctccaaaaatacagagaaagggctttggcgggaattccagggctgcactgaggggtgctggctgcccagcctttgtccccagaggctggcatcagacgccatgctctgaggagaggggcggttcgcagacactgaaggggacccacgtgattccttcaagttctttgcagtctctgtagaagcctgctcagaggaggaggccatgcgcaccagggaaagggccagacaggcctgtgcttgaatccctgactggcctcatattgctgagtacactgggcaagtgatattatctccccaggccttggtttctcaatctgtaatgtaggaactaacagcagaacctccctcacagggccaccaggaggcaagggatacctggcccttaatgtgttcaaaattcatattcatttcttttgtttgtttgtttgagacggagtcttgcccagactagattgcagtggtgcaatctcagctcactgcaacctccacctcccgggtgcaagtgattctcctgcctcagcctctcgagtagctgggattacaggcgcccaccaccacgcctggctcattttgtatttttagtagagatggggtttcaccatcttggccaggctgatctcgaactcctgacctcatgatccacccgccttggcctcccaaagtcctagaattacaggcatgagccaccgcaccctgcctcatattcatttctttatgccaacggtcttagatcaacaagaagcatttagtccaatcaccccattttacaggtaggaaaacagaggctccaagaacgacagcagacatttcaaatgtagaatggccaagtgtgtgggtgtcaggaagaggaagctagatgaaggaagaggggtaatgctccacgttgactaccagagtctgaaagtctgaacctgggatgccaggcaggcagtaaacccaggggctccccagatcaacccagcagtactgactgcatctttgcaggtccacactggcagcctgtacactttgaagaacagcaggtccactggggatgaagggcggctgcagggatggtgatgggcattgagtgaggtgatttatatagggcaacttacagagtgtcttgcacatagaaggtgttcaggtcctgggaggtaagtgagcaccagatacaaacccagaactgggatggggagtggctgccccttgctacctccccccttagcagaaagtgaaagcattttgcacaaaaactcagctgtaggcattgtgtaatagcattgatctatccaaaaatattgagtgcctactgtgtgccaggcagcctgtgaagccttttgcgtgaatcctctcatttcaacccaggaacccttacaagtcagtctactattatttccattttatggatgaagaaactgaggctcaaggagcctgagtggtttgcctaaggtcaagcagagcagggcaggaatccagggctttccaaattcagagccttaacaccatgccacactgtgctggcagagatagcaagagttgttggagatgattataaggggagggccaaaatgatcgtgggaatccaatccccgtggcagtaggtgggagatgctgacctgggcttcctcagaaaggtgtgaaatgttgacaccctccccttgggctcttcaagggctcaagaggggctgtgttaggctgggctggaaacagagggctgaccatcatgggttccagagggagctatccacccccctacctagccagaggcagccaggattccattaacctgattctctgccccacataaacctgcaaagggagcccctggagggaggggtactggggagaggaagaattgggcttccccaggccccaaatggagcagccagtggtgctagtttcctctcttgcagtccaggaggaccttcgaggcccctggctgtttgagcggggaatagggagagcgatggagagccagaaagtagggacaagagactccaggctggggtgcaacagcaggaatagcaggaacagggtgcacgtcatcagaacaatgggtcctgagtcactctgtgcctgcccagccctgcatggccctgggtgagtcatgtcacttctctgagctgtgggttcttcctcaatagtaagggcaaaccaatgccacctctcagtgttgctgggctgattcacaataccgggcctcaagaaatggtggctgttgccaatgctataattttacaatcttgaccccatgtatcccttctcagcttgcaagccacattcatcctttttctccttggagcctcacaatacttctgcaaggtgtccaggattcttaccagagaggttaagggacttgttcagaatcacacagcttctaacccttggcctgggatgcacccctagtgattgtcatggagtgggccatcccagccaggctacgccactcttcttcagtctgggtggttgctattcctctgccatgattcacgtcagatgcctcttcctccaggaatccctccctgaccacacaagagcctggttagtacaactctctgctttcccacaacctttgagacatttatcagagtgtttatcagcagtcatcacaaccgttaggtgctcccacctaagactttgagggttcagccaatactttataatagaagaagagggggtacaataaatattttgttaatgactacagcacctgtacaaagggacagataggtgtccacagactcacatgtataagtaacagtcatgcatgcacagccatgcacatgtggcttagtgaatacacatgtatacagacagggagaatgttctggaacatgaattgtgctcatgtggatgccccatccccccacccccatataaacacataaaaatactagagatgatattgatacaacctggtaagagagaaaggaaaatccttgggtgacttggtttttcatttaagggatttttttttctttttctttttctttttttgagacagagtctcgctcttttgcccaggctggagttcagtggcgcagtctcggctcgctgcaacctctgcctcccaggttccagcgattctcctgccttcagcctcctgagtagctaggactacaggtgcacgccaccatgcctggctaatttttgtattttttggtagagacagggtttcaccatattggccaggctggtctcgaactcctgaccccatgatctagcctcctcggcctcccaaagtgctgggattacaggcgtgagccaccatgcccggcctcatttaagagatttttgaaatagtaggtggaacaaaaatacagccataaaatagaagctgggaggaataggattggaattacaacatactaaaattgtttgggaggtagatagggatagcaattaacttttggcttggttgaggccaatgtgagtgttaaaaatgacagggtacccatgaaagacagaatatataacttctgaagcagcagagggaataaaaaggcatacagcaaatacaatcaattccacagaattaagaaaggagaaaaaagttttaaatggattataaataaaacatacaagagtataaagtcaaatacgtgttagtgttcacaataaatgaaaatgggttcaaaactgttaaaaaacagaaattcatagtttggatgaggaaaaacagtacagctctatctgtttactgcagacaagcctaagagataatgaggcacaaagggtaaaaggagagaaaattatgtatcagcaaatattctctagaataaaataggtagcaagatacatttcagaggataaaaagactttaagacaaaacagcattattagggacaaagaaggtcattatatcttgtaatgacaagatataataatcctgaacttagtctcaaaacactttaaaaaaaaaagatacacttgtaagaagaaaatgtcaaatcagatccaattggtgggatattttagcatagctttctcaaaaatcaatggagtaagtagacacaaattattagactcaaatgagctaactaataagagccctgctctcaacaaagaaaaattacactttttccccctcagatttaccacacagaatgtctcatacaggaccacaaaccttccccaggtgtgtaagtacctgaggacagagtgacaagtgtgtaggaacagttaactctcccaaagacatccagatatgagagggggtcttgtatggtggccaaggtgtttagctaactaaacaattccatgacttcggacgattaaaataccttgtctgaatcttagtttccttatgtaaaacatgtcaatttggggacagcagactgtaaagggccagaaagttaaaattttagcctttgtgggttttacaatctctgttgcaaccactcaactctgccattgtgacataaaatcagccataggcaacatgtaaacaaatgagcctggctgtgtgccaataaaactttattttcaaaaaaaaaaatggcaaggccaggcacggtggctcatgcctgtaattccagcactttgggaggctgaggtgggcggatcacttgagggcaagagtttgagaccagcctggccaacatggtgaaagcctgtctctaccaaaaaatacaaaaagtagccaggtgtggtggcatgcacctgtaacccagctacttgggaggctgaggtgggagaatcacttgaaccagcgaggcagaggttgcagtgagccgagatcacaccactgcactccagcctgagcgacagagcaagactctgtctcaaaaaaataaaaaaataaaaaataaaaaaaaggcaagcccaaattggcctgtgggggcatagtttgtcaacctaataccatttgccttgccaggattggcgatgacatagagaatgataagaaaaggaaagcattgtatacagcacaggagttcaaaaaaggggtacctattggccgggcacagtggctcacacctgtagtcccagcactttgggaggccaaggcaggcagattgcttgagtccaggagttctgagaccagcctgggtgacatggcgaaacctcatctctacaaaacatacaaaaattagctgggcatggtggcatgtgcctgtagtcccagctactcaggaggctaaggccagagggtcgcttgagcctgggagatcaatgctacagtgagccatgatcacaccactaccctccagcctgggtgacagagcaagaccccatctcaaagaaaaaagagtacccattttgaaagaggacataacaggaagatgtgtacacacatacacacatatgtgtacagagacacacagacatgcacatatgtttgcatatggatatataaagactgggttgcacatgtaagcacattttatgcacgagtagacatgcatgcatgtgggcatgctttcatacatgtaggcaaatcatctagaaaatgggataagaacatggacctcatggggttgtgagtgaacgagtccatggtgctccgtgcaatgcctagcccattgtaagtactcggaagtcagctttattccatatgggaatgggtctggagcacggtaaggggtacctgacaccacacacgttcacacaggcacgcacaatgcagtctgtgtgagctcattttcagaggaaagccaggctaatgaggaggttgtcttcgtagccagcgggtgcccaggacagccctgatggggacgccacttggctttctcctgagatgttgggcaaatgaggagaaaaggcgttttaatccctcgtcatgtctgtgagggctggaggacatgtgctgagctggaattctcaacttcagccttttttttttttccttgacacatccatcccagaaacatctgtgagatgaaacagagaaaggtcttatgaattcagctcgtactcggcctgtgctcccacccggagcaagcgagacatgaatcaccggcccaggggctcgggggccccacagagcagcctctccagaggggccccggcctttccagcgtagccgcttttgatttccccaaagccttctgatcgtctacactccacagagcatgtgcgtccaagagagagctcggcttgcaccagggtgggggagagccgctcattcctcagactgtgctgagtccaactctacaccaggctctcggaggcacaaagatgaaccagacaaggagtgcgccgaggccctttcacttgtccccatcttcccattgtttgaaaacactggaggaagacagctattgtggttttgtgagcagttgcttcaatgggcatgtattttggtacattgatccgtagaagccgtagaatgttgtgcgttggacatttttatcctgcatgcaggagggagtgcgtaatggctactgctaggtcagggatcaaccaggtaaggtcttaacagccagccagtaattgaacttgaccttctgggggcctgtgcgtggcctgcagcctcagatcccgccagatggctgaaatccctagccctctcccaccttttgtctcaccttttctgtgtgtttcaagaaaatgagtagatttcagagccgcagtgacccctggccttttgtagcatgcaccagggccaggaagggggcagaaatgaggccagccctcttgttcatttcttctgtccaatggacaaagctgtggtgggcacctgctgtgctctgggccctgtgctgggcactggggaaacggaggagaagacagagctttctttaaagagcccacaggctcaggaggtagacagcccagggccctggtagaaaactttttgtttcctcaaagatgcagacaaagtcctgtgaggtacaggaggtgggaagagggcctttgtggttccaagtggctggagcaagaccaggagaggccctacacggcgggggaggggggcctgaactggatttgagtgtgcagagatggagaagtctgcagacaggcttgggcactggatcagcaacgtcagggatgggagagctgtcagtcattcaaaagacgtcccaaccagagggtcctaattatttcagctcccaatgttataaagaaagcagctcaggcctgaaggggggaagccattctcccactgtcacaggggcccctgggacccccagtcccctttctagggccatttccacagtcggggagagagacttactagtatgactccctgcacacacatagatgcctgctttccttgtgctggccagctgctgtgcggggtggggaggatgtgatgtttacagagtcacaagtttatgagagggatgggggttctctaacatgagtgtaggtgggagagataaaagagtttctctagtcctgaagaatttgggcccattttacagatgagaaagttgagtcacaggagaccaagtaacatacccagagttgcacattgtttagtagattaaactaggcgtgtatgaagcaaggagagggagaaggtgaacgccaagtttcagccattttcccatctgtttccagatcatccctgtcttcctcaggacagtcccagaccagtccttcccattcagcttctcaccttggccttccccactccttcccagaattcttagcaacagaccggcagcctgagaggggctggaatcccccagcccacccccattccttggaagggctggctcttgtttacccagctggtgtgaacccaggctggggtcaccaggaagaccgaggatgcctgtcgtccagctggtgccccactgcttgggtctaatgaccccttccctccctttctaggcctcccccaaagaggtgacccaaggtggggcttggcctcaaggaataggggagcttggctcctatttcatccctttatgtctctgttctttcatctttcctgaaaaagcagaggtggccacgaggaaagagatggaatcaaacttaagagctagttagtaaggggcagataaacagagcccggggtttggcactgaaaaacctgggtttgagtcccagatctgtgtgaccctagcagatcccatgccctctctggacatccatgttccactctgccatctcagggcaatggtcacccccgatcccagtgaagctcaagtgcaataaccaatgtaaaaatgctttgtagagtcaaaatgcaataaggttggtgattacagtcattattagattgacataagggaacatatctgttcagaaaggcacattaaactaatcaggggaaggggcataggccaggagtcagaagacccagggaatagtataggcattaactgtgtggccctgggcatgcgcttttgcttcattatcccttttagctccgcttacgttaaaatggaatcataagccctgttctccctacagagtcttatggtgaccaagtaagattattcatccaaccagcatttactcaagaccttccatgcaccaggccctggggtaagctagcatgtagctcctgtccccgaaaatctagtatgatttttcggaaaatgatactagaggccaggtgcgtggctcacgcctgtaatcccagcactttgggaggccgaggcggatggatcacgaggtcaggagatcgagcccatcctggctaacatggtgaaaccccgtctctactaaaaaaaatacaaaaaattagccgggcgtggtggcaggtgcctgtagtcccagctacttgggaggctgaggcaggaaaatggtgtgaacccgggaggcagagcttgcagtgagccgagatggcaccactgctctccagcctgggcgacagagtgagactctgtctcaaaaataaaaacaaaacaaaaaaagaaaaaaagaaaaaaagaaaaatcatactagagaagggtgtggggttcagaatcctagagggtcaggtataattgagtctagtctgctcattttgcagataggaaaaacaaagccctaaaaagcaaaacagctttcccaggatatcagaaatgaggaacacctgttgccacttctctgctgaatccgaggcagacagtaccaatcaatcacgatgctcttcctgccaacccacatgctacttcaggatcttctgaatctcaacgcaacactctgggcaaccaccagtcaattggtcagagttggagggcaatctgaaactatgcataccaaccctaaatcctaaccctggacttgcccaaggccatttggccagaacgatctgttctgacactcagacgcagggtctttcactcactctgcatctccatttgctcctgaaagcaactcttatggagtatccaccaaagatgagtaaggcctggtgaccgtcagcaagaggctcaaagtctgggggagaagaaagtcaaaggggaagtaattgtgatatggggagaaagtcagggatatacacaaatccctgtgggaatttggagaagagaacaacctggctattcaaggacagggttagggggcagggtggtggttaaggaaggcttcccaaaggaaaggacattgaaatcagcactcagccagcaaatacatggcaaacatggggtcctggatagggtccagatgcctcaggtgtctgaggatgaaggacatctatgaactgacattagaaggcatcgtagcagggccaccaaccctggtgaatgggcaaagttgggacttgggaggagaaactcaggaggtaggaagggaagtttctaggctgttttgagctgaagcccagtgaactagacggtcaagcccctactgaactcacctatcgtaccctacactccttcacttgtagccctcatcatactgctaattatttaacataggtctaggctgggagcccggatagggcagggactggatctcatttgttactagctgggacttgaacgtagccctggcgcagtgcctggctgcttcattgtaagtactcagtaaatcttggacggatatgtggatggatggatggatggatgaatggatggatggatggacagagagatgtcatgcagcctctctctaagcctgttttctcctttgcaaaatgggagaaatagtgccaaactcatagggatgttataaggattaaatgagatgatgtcactaaagcctctagcgtggtgtgtggcattcaaaaaataatatttattgaaggaataacgatgactacttaagcacaagtgtaaagatactcttgatagataagctcctgatgaataaattttgcatactctaccaggatgattaaaagaggaggaagtctgggacacaattgttagaaatcaagcctagtagtgaccatcagggtggtaaaaccttggatggaaaatgccccaaatcattttattttttattttatttatttggtggagtcttgctctatcgcccaggctggagtgcaacgatgtgaccttggctcactgtaacctccacttcctgggcgcaagcgattctcgtgcctcagcctcccaagtagctgtgattacaggcacacacaaccacgcctggctaatttttgtatttttagcagagatgggatcttgccatgttgcccaggttggtctggaactcctggcctcaagcaatccgcccacctttgcctcccgaagtgctgggattacacacataagccaccatgcccggctccccaagtcattttagaacatggaagaatggagctaaccacccattccgtgcagacacattatcctagcactttacacatgttaatttatttaatccccacaacaaccccctgtgttaggtactgttattaccctcatttatcatatagggaaactgaggcacagaaagatacccaaagtctcacagccaggaagtggtctgactcccaaagccactcttttagccacctgaggagctcactgtctgacagaggagactaagtagcaattactaggagcagagattgcatctctgtccccagcaaggtgcccaccacatagcaggttctcaatcagtatctgtggaatgaatgaatgaataaacaaatgaatgaatctgcataccaccaactctagagcagtgtgacgggctctaatcatggtattagtagacgaatggcagcaggttagtgcctgaatgatccaagattactgtgtcttatctaagtagttgtcatggtcagttataaagcttgtggaggacacatgctttgctgtccattcctgtgtgtcactacccataaatggcctcttgttgttcctgtgatcttaaccagggcctcttgctgtcgtttaagtccttgtagggcaggagggagtctggactgcagggagggctcagtgcaaaggaggccatgctcaactccaagccagtggggaccttggcccacttctgccaccaacaccccatatatccctggacagagacttccctctctgagcctcactcccctcatcaggacaggggaatagagatggcatctccctcgaggctgtgggggtggaaggcatgcacgtggccacatttaggaaacacagaagcagaaggtaggattgttctagaaagaggcgattgtcaggctggtttcgggggtgactcagtcttgaaggtgggagcagggggaggccatggcgagatgtgaatggcagccccatgccctgtcggccccatggtcactcctgctgtatatgtcacagtgccggaagtgtccatcatttgatgaacatctgggatgaaggcctgctgtctccaggagggatcctgttttaatgcatgcggggtacagacagtgtaacattttgattccctggcaaagacacatccctggcctctctcagcatgagctgacatcagagagaatggggcagggctggagacagagggccgatgccaggagccgggcaagatctgagacttccagcaggggtcccatggggcctcgggacagctggaggagccacatgcctggggttgggtgaggggcaacaggagaaccctaaaaatggagcaaagagctgtcgggagtaactttcttctctttcaactttttgccaaggagcagcgtggctacagactctgcatagcccagagaggaggctctgccagccccccaggcacctgtcccagaagtctaattactagctctcgatgggcagccagctcactgattgcgagtccttgcagagaggcggtgctgaaatcatgaaatattccaaaggaaatacgtttattcctttgcagaaggataacacagcatctcactcgtcactacctcgcattcgcgtggggtgttaccgaaggctgaagaacttacttatgggtccctgttagatctgaccgcccctttccacccctcactgtcaccaccctgtccatccatagtcatccgtgcctgaaccatggtgcagcctcctccctggccaccctgtgcccccatagcccattcctcactcagcagacagagggaactgttcacatcacaagccacttcccagccccaccaaaaccctcccatggtttgccatcacacctagagccaccctcagcctcctttctgtggccatggggcccacagttttggctccttcctcctgctctgccctgtttcccactcagttcccccatattcacctgcttcagcggccagacctctgtacagcctgaaactgagccccaggcttattcattccctctgaggaagagcctttgtacattctgttccctctgcctggaatacccttccctgcactccccctctaactccccctaactggcaccttcttgtccttcaggtctcagctcagatgccacatcctcagagaagcctcctctgaccaccagccaaagcagccccccagcactctctagcacatccccctgtatttatctaatacctgtttatttttcattttccccatttgatgataaattctcaagtaggaacctagctgttttgcttgtggctgaatctgagcaattagaacacatggtagggtatcgtatctgttgagtgaaggatccctgcaaggagaaataggtaatactaatggccacttactgagcccctgcaagtacatggcaccatccaactgtaacctcattttgtcctcacagtataaaaccttgcaagggagtgtccccattttacacctgaggaaactgaggctctgggggttcaagcaactttcccaagaccatgcagaaagcaagaagcagagacccaggtctgtctaattctaagtccttgctcttgccactgtgttttttttctcctaacttttattttaggagtacatgtgaagatttgtcatatagataaattgcatgtcatggggatttggtgtacagattatttcatcaccccggtgataagcatagtacccaataggtagtttttcgatcctctctctcctcccaccctccaccctcaagtaggccccagtgtcttttgttcccttcttctttttctttttttctggagacttagtctcactctgttgcccaagctggagtgcagtggtgcaatctcagctcactgcaacctgtacctcgcagattcaagtgattcttctgtctcagcctcccgagtagctgggattacagccacctgccgctatgcctggctaatttttgtatttttaatagagacagggttttaccatgttggccaggctgctctcgaactcctgacctcaagtgatctgcccacctcagtttcccaaagtgctgggattacaggcgtgggccaccgtacccagcctcttgttcccttctttgtgtccatgtgtattcaatgtttagcttccgcttataagtgagaacatgtggtatttggttttgtgttcctatgttagttcacttaggataatggcctccagctccatccacgctgttgcaaaggcttttttatggctgtgtagtattccatggtgtatatgtaccaccttttctttattcattctactgttcatggacatttaggttgatcccatggctttgctgttgtgaataatgctgcagtgaacatacatgtgcatgtgtctctgtggtagaacaatttatattcctttgagcatctacctaatattcggattgttgggtcaaatggtacatctgttttaagctctttgagaaatttccacactgctttccacaatggctgagctaacgtacattgccacactgttattaaaacaggcttattgcccttgtttaacacataagaagacagagactcagagaggtatatgctcatgtgcccaaaagcctcagccaggaagagcagggctgggattggaacccagagtgctgctgctgtctctgcaggggcaggggctggcaggagacccaggcagctgagaggctggcccagccaggcagctgtctatagtgagaggggtcttaggggtaggcaggagcctgtccagtttgacagcagggtctaagtgcttcatgagtattagctgtcttctcaacaaccttaggagggagagtgttattatccccattttgcaggtggaaaaactgaggcacagaaaagttatattatttacccaaggtcactcagctaggaagtggtgatgccggctccagagcacacactgctaaccacagcacagcactgtttctctgaggagacgaagctgggccaggcaccggatcccccaggaagcccccaagaaggaagcctatagcctggggccagcatccttgggaccttgactgatcccagtcctttggggtccttggtcagatcaagagggcattaggtcctgcctgcagctgaaggcctttggcagctccataccctgcaaggtactcgggccctggaaccaggcagcaggagtagaccctggctctgcccacacccggatttgtgtgctcctggccaggccacttgaatgctcagagcctcagtttcctcagctataaaacagggccaggagttcatcaggatgttgcgatgagagcagaggaggtgacgatgatgagttaggctccatccagcgtggagtcccacctcctgagtggtgagcgagcagtggctgaaagcacatggtgtccagctcaatttagatccctcctctaccactcactgcatcagtgacattggacaagcgacttacctctctgtgcctgtatcccttgtaagtggggataattatagtataatttgagattacatgattaatccatataacgcacttaaaacagcatctgccccacggtaagcactaagtgtgaaccgtcatttaatagaagataaatgttaaaacattagttctggccgcttttggaactaaagagacccttctaagcagagttcccatgaggtcagagaaaataagctaggaagttgtggtctcaagccctcacttggtgacagtgtgggctatctttgcaggctgcccttcaccacaagttgcctcccgactcctcatctccagttttctcgaggattagtccttgtctgtgggtgctagagctaagtgcttgtcaagtttatgaactttcagagccatttttagaaacaaccaggactcctcatttttataagggctgagataagaatggtctgtaagattagaggtttgtcattttcctctgctttgattctctctctctctttacacacacacacccacacacacacgtacacagacagcacagcagccccaggccctataaacacattgttcaaataaaggagacatttaggggaagtctgaagcaccatttaaaggtgattgctctaaatggccatgtctaggcaatttgtcataaagtctcccggctgttggccagagatcacttttgctgcaaatcttgctgttgtcttgtaattttcaacttttgaccctttaaaactgagaaggtgtgggatcttggtgagttttggggatgggagtattttaaagtaacttgttaagaagccatttggccctgggaaagtttgggatcagttagaccctaaggatccctgcagaggagcccaggatgcccaggtacctgctctgctgcaaaggacttaatgattcaagaatgtcccagggcgtggccaggtgcggtggttcacacctgtaatcctagcaatttgggagcctgtggcaggcggatctcttgggtcaggagttcgagaccagcctggccaacatggtgaaacgccatctcgactaaaaatataaaatagtcgggcatagtgacgtgcgcctgtaatcccagctactagggaggctgaggcaggagaatcacttgaacccgggaggtggaggttgcagtgagccgagattgtgccactgcactccagcctgggccacagagtgagagtgagactctgtctcaaaaaaaaaaaaaaagaaaagaaagtcctaggtcagggaccgggcagacttcttcctgatttctccagaggttcacagaccgccctgccaaagacagaactgcccgatctgcaggccttgggcatggagaggttggcacgcacctgttgctgggtaggcggcttgttgcctctccagcctcgtgtcctgcatctctgcaaccatagactctgggttccagctgcctcaaacgagcagcaggtcctcagccttgccatgcagtttcccatctccacccctccgcccacgctgctccctcagcctcgcatgcttctcctttcttgcttttgtcttgtcattcttagtcttccaacgcagctcaagtgtttgcacctccaggaaaccacagtggtagagacccctcctctgggcttccagacccagcgcctcttccccacaggcttccccagacattgtttggaaactgcttactgaccggggcatcttccccaccaggctgggagccccttgagctgtggatccctaagcccagcccaggcaccagccttgaggaggtgaggccatgtgatagagtagttaagaccctgcctttggcctcagatgtaatgctcccacactcccctcccagttccaacactagctggagtgggttactcagccccgcagaacctccatcacctcttctagatgtgggaatatcaatagtactcatggggttgctgtaggaattgatgatgcaagcacacactctatgcttattaactccaagtcttcactgcaggtaagtcctattcattaatcgatttttcagatgaggaaacggagatgcaaagacagtttgaggagcttgcccaaggtcagtggcagactcagagttcaaggccagaaggaccctgttgcagagcctgtgcccctaaccactgggaagcacagccccctgataacttatatgaagcctggaacacagcagctgctcaataaatggtggctgctgttgttaataggtgctcagttcgtttttaatggtaaagaggtggggctggacacaacaggggaggaagggctcaagacctagggaagggagagaactggaggaaacaaaaaggaaacaggaaagctttgaaacgggggagagggccatctgaggccagggcaggtgggctggagtgtgaggggcccagggcccaggcaggctgctggaggaaagggctgagggcaccagggctatgtggccatttgggcactggaataggatctcccctggcttccctgctcttggaaaataaaaccccaaactccatcaccaagcacacaaaaccctttgtgacataatcccagatcaactgtctcacctcgtgtctgaacccttccccccatacaccctgtgctccagtccctccatgcctccagcacatgctgttctgcctgtctgaaatgtccttggtctcttctgaccctgacagactcctactcatcctttaataccctattcaagtggctcctgttctggagagccttcctgggtacccctagctaatcatactctctctcccctgctagacggtgagcctcaaggccagggactatgtcttattcaactctgtgcctagtgcctgacacagagctgggcacaaagtgatcattgagaaacagcttgttgagtttttatggagtaagtctatcctcaaatcaagggcaggccctcatggaaccacacacacgatctcaaatcctcagtgtccaggagggcttagatttggaggtaggagccaagtgagattaagaagagaactcatacttcttagggatccagactagggaattttccaggacaagtaggcctccagaactctgctgtgtgcccgtgactgctgctgagagaattcatacctgggacctcaccccgatccactccagcaccactcagagatagtggaaaacaagctggaggcctgagatggcctgtccactatcgctcggtggacctccttaaaatgtggagcccaaaactagccctgcctgagctaccaggaggatgctggctgtcactctacttctactcttacagcctacaatcacattggctttttcagcagcttttggcttgtggtcaactcaaacccccaggtctttttcactggggtggctgccaagccacatcttgtgcatttgatttatggcttgggttagctgaggccttctcctgctccccagaagtcaacaggaggaaggtgacgggttctgtacccctaggagggagagtgattccaggcctcccaatcaagatccttgttgtttgtatttcctaatcccttctcccagagatgccaaatgctgggacctcgagtgggattttcattagcattcaagtcacaggccactggggcacaagcagagcaaccttccaggtttccgggggatacagtggttctggaagacacttagacaaggcagggagagagaggcaggtggtggaggctcaatcttctgagcttggtgtccatgtgcgctggggatggcacttcattgcttggagcctccgtttctcatctgtacaatgggggtgacaaatctccaacatcatagcactgttagaacaaaggtgcccaagcaggacgtccctcccagagcttagtacttctttctgtctgggatcacgggcagctggggttaagagcaaatgggtattaagtctctgttaataccccactcccactgctgctgcactgatgaggatctgtggtgctgagattttcccacctttgcaaatattgttactgctgagctgaatgctcttctcctcaggtgttgcctcttcaaggtcacttttgcagaaaggccttttctgcccacagtccctaaagtgatccctctgaggaccgatctcagcccttgtccgtctccttcgtgacccatcgcgaggtgtgtgtgtcatttccatctgtctattgcttctttccctccttctctcacccactagactatcagctccctgaggtcagggcctgtgtctcctcagtcctcactggtccccagccccagcacataaccagaaccgagcagtctatgtggaacaaccgttgcagatttcagaatgttctctcagactttggcaacaaattctaactgtgggatccagcggaccaggggatccatatagaaccaaagacagaagcatgtttagtcctctctgccctgagcaaggcctcagtttccctagctgtaaaatgaaatgataaagagactaactttttctctaaagtccttcgagccctaaaagactctaagtcggcacaggaagtgggagaaaattgtattgaatggtattgcctcttggattgaaaaaaaacaacttctgctaggaatctctcttgctctgtcactttctccactggcctggaaaaaaaactgccctgcacaggcccaggcctgcagaacccacactgaaaaagttcacaggtgccctcctgccctgggcccgggtaaaggggccctgaaaggtgtgtggcagctgcatccccggggggtccgggggtttgttgccttaaccgagctcaccaagcaggtaaaaaattccagacatgttctctgctgacagctaattgtgtcctttattaatgaccatggctttcttggggcaggtgggaggagggaggaggccagtctcagcccggaggggctccctcaggtgcagctgatgaccacatttctggatcccatagaaggggaagtgctacatgaggtgaccctgaaaaagcaccctcccttctggagggggagggggctttcccaggctccccaaatcccagcaggggtggccagtaccagacaccgacagaatgatgtagggatttaggaatctgagggccagggttctgggccctaagttcttctctgagaacacagccaacaaggtacagtggatggcctgaacaggggacccgcacgtggggcggtttgggagatgctccccagctccgccaggtccatctcaccctcacggtaccaggactgggcctgccaggccttacctcggtggcccactacaccacctgtcaatacagcagccagatgtgcgggaggggcctgggcctggccctgccagatgtgtcaagctttgcaaacacatccgacttcccctcgggcacatcgtgattattgtttaacactcgctattcctgcatctgtgagtcccagggattacaggctgggaggctgcagcctgatgagcccactggcagtgatagtctccagctggggagaaggggatactcgatcggtccccattttctcaggagggtgagggatgtggcatgaaccccaaatatagatgaggagatgaggcccggagagaggctcagggaagaactgatggaaccaggacttgaaccaggcaggagaaacggcgcatgcacaggccctgaggctagcagaaggctggtgttctcagggcagccaagaggtcagtgtggctcagctggagtgggcaagaggccaggcgggtggaggggagttcagagaggaaaaaggaagctttgtaggctattgttttgtgggtttttgtttctttttggaaattcatctttgtttagatacagggtcttgctctgttgcccagattggagtgcagtggtgggctctcagctcactgcaacctgaacctcccaggctcaagagatcctcccacctcagcctcccaagtaactgggaccacaggcttgtgccaccacgcccagctcattttttaaaatttttttgtagagtcaaggtctcactatgttgctcagactggtctcaaactcctcagctcaagcgatcctcccgccttggcctcccaaagtgctgggattacaggtgtgagccaccgtgcccaggctattggtttttactccaagtgagatggaaactgttggaggcctttgggcgacatgagctgatggctgttctgcaggatcctggctgctgtggaaggctgaatgcagctggaggagggcaaggacatgggagagcaagggagaaagccaggaagccagttaggcttttgccgtgatgtgaggatgctcccactcctctgccccttctcttccctccaatgtgggcatcagcatagctgggctgcaaccccagctctgctggccactcatttattgtgtgaccttaggcaagtccctgtccctgtctgggtcttgtattttgtagtcataaaataaggaacttagcccagaagatcgtgaagattctgctgacttccaatgtctgagaccctgccttactctccagcctcatctccttcctctcctggccttgaacctcacgtgctagcaaccctgaactatttgtagctctctgcacgcacaccatgctgtttcacgcctctgtgcctttgcacactccctctccctgcaacaccctgtcccagcagcagccctgcacacagatggcctgtgttcttcagcaggtctccagcttgggggcatctcctccagaggttgacccactcccctttctcagtgccctgagcacttttacagaccacacactgattttcagaagacaatagaatgaagaggctgtggagtcagagctggcctcaaattccagctacctatctggagttgttcatgtttttgagcctccatgtcctcgtctgtgaaacagagatcatcatattcttcctcccagagtcaaggtgaagatgcagcaacattgttaagcacctaccccagtgcctagcacgtggtagccaggatttttgaagtcagattctagctacagagaaagagccattgaatgaatgggagagggttaccctgtatagtgtggccccagattcccagaagagttccagctcggaccccaggacaacctcccagcagcccattttggggagggggttcctgcccacccctcctgtcaccagctcctcctgatatcagggcttggtcaacgctgcctgccggcagccacacaacacttggaaatgtccttccttaattgcttcaccagagtggggagccaccctgcaggcagataattaaaaagttcagagcttgattaattgggaggaaattggaggaatggggctgcctgctgggagggcgggagctctcagcccccactgtggggaagctgggatatcatgaagggaggccagacctggggctgggggcaatgcgggggtccaggggctgggagagccaggccatgaaacaccctcaccagctcaccagcctttacagactgtggggttcagtgtctggctcccctgggagactgtgagctccccctacaactggggaacacacagcagtcatgaaagtcccggttgctccggccttggggccaggggaccttgcagcctgtcactcagagagccgttatggagcatctgctctgtgccagctctgtaccaggcagtcagcagggcaggtgcagtggctgccctcatggagctcacagctggtaggaggaggggagatgggaggtggagagacagatgttaatcaaatgccagggacaaaggtaggatgccttgagagcctgtcaccaggggctccaggaggagctcagaggattccagaggcctcgagcaaaatctccagtccacacacaagttgaatgagcttaagcacaagattccgcctttcggccgggcacggtggctcatgcctgtaatcccagcactttgggaggccaaggcgggcagatcacgaggtcaggagatcgaaaccatcctggctaacacagtgaaatcccgtctctactaaaaatatgataaaaaattagccgggtgtggtggcggacgcctgtagtcccagctactcaggaggctgagccaggagaatggcgtgaacttgggaggcggagcttgcagtgagccaagatcgcgccgctgcactccagcctgggcgacaaacaattcctgaagcctctatcgatcacctctcagccagacactggggctggtgccagacctcggggttacccaccatcactgtcactgtgctcacagcctcctaggagaggcagacagtcaccatcctgtatactcatgcagtggcagaggtacagtgccaggcactcctggagcacagaagagcacccccagacccagccctggcaggggacatcctagaaaaggaccaacagttgattcgggctggagtgagatttgaagaaggacaagaaggagctgggtgggagctgggacagcatatgaggcagagggaactgcctgagcaaaggcccagaggcgagaccaagcacagcttgttccaggaactggcagtgcctgcggtggctggagctcaaggtgtgactgggagcatgagggagctgaagctggccaggtggaccgtggaaggggaggctgaagcaggccggactctccctgggcatgagggagccaccgaagggtcctgagcagaggagtgactcaacagatggcaggggtgggggcctggctggcgaggcctgggtgcccccttgggcaaaggggaggcatgctcatgcagctacccacctcagccttgtcctgtcagctgctggctgggttccacaaagccgggtcccagcaggggcagacaggaggaacctgggcattggggcaggatgactgacagcccctgggtggtcccagtgggagctaccggccctgaggcacttgctggacttaagctgtcttgtctaggaagggggaagatggaggaagggaaggagtaaacgggcaagaagggaaacccttcatcaagtgggaaggagctccagggaccttaaggatgggggttttagaaagaacatggactaaggctgggcatagtggctcacacctgtaatcccagcacttagggaggtcagggtaggaggatcacttgagcccaagagttcaagaccagcctggacgacataatgaaaccccatctctacaaaatataccaaaaattagccaggcatggtggtgtgcacctgtagccccagctacttggaaggctgaagtgggaggatcacatgagcccaggaagtcgaggctgcagtgagccgtgattgcaccactgcactgcagcctgggtgatagagtgagaacctgtctcaaaagaaagaaaaaaaattaagaacatggactgtggaggcacatgttctgaccctaagtctctatgtgatttggacagagtgcttcctttctgtgagcctcagtttcctcatctctaaaatgggaataacacctcccattgcacagggtggtccaaggaggccatggaccagggaggctcctggcccagcactgggcacatcctaggcacacagtgcttagaagcacctcctctccatctcaggaggtagctgcctactttcagtgcagctttgcccacagtacggaggaggaccaggcatcatgcccagcccagcccagcccagagggactgactctgctgggttaaccttacagcaaaagcaggaagcaggcaaaatataaaagccactttgcatgaggcagaccccaaaaccccacccactcaacccagcaagcccagccctgccctacacatggcacaaacccctgaaaatatgcaaatcagtctttccacagttcaaagagaatgtaagagcccagcactgggtgtctgagccacccacagctggagtcccaagctggaagaagccctagagggggtgccaggcagcgccttccttggattgtggattgaatgattggattgaattgtgtgtatcaatccgttcaaatccagtagagctgaggcccagagtgggcaggaagtagcctgggttcacagagcaaatggcagtgaagccgccagcccccctactctgggaccaagactcttttctccatccagtcaaactcctctccccaactgaaacccagaactgacttcctagagattccaaggcaggaaagcgagctggctgcacttcaaacctgccactgctgaccccagaacccgctccctggcccctctgcccacagcagccagcaggtaagcctggttcaaggaaggcatctcagccccctgcttagtcatggtctcttatgttccagggctgaggctttttgtttcaaagtcccagtacctggcacctactggggactcagtaaatgcctgtagaataaatttacaactcactgtctccctaactagacctgaacttctgaagacaaggactatgtcttctttatctcagtattatctccagtgcttagcacatagcaaatggaggccaagaataaatgaatataataatagccaacacttacatagcacttaacatgagccagacagacactgttatgggtgctttactttcattaacttgtttaatcttcccaacaaatataatcaatattattattcccattgtacagacaagaaacttaggcacagagaggttaggtaacttgctcatggtcacacagttaatgagaggcaggactggaattaagccctggccgtagctccacagtccatgcccaggttcaatttcatcagacctcctgctcaggtctggggagtaggaactcaaccccagggtgcagaccttttcagatgccacctctacccagagccacagacagcgccctctggtctacagaaccccaaggaagacagagatgctccttccaagcctcggcagcctgacacactgggcctgacccagcgattgactctgaggtggcatcagttgtctttgggattaagccagagtccctgggaggagaggggggagcagaggcagcaggccagccattgaggttttgaggatcacctgatgccaattaacagccccaccgtgccaggcccagatggagtcctgcctcggcctgactcagggctcacttggtcaattatcacctatccccagagcccaggggcaggcggggagaaaatctgtttccctgtaatcctccctcctttcttcggcttgctgccatcctgccctgggttgcctggccaagggctctgggcgattgcagaaggccggcgctggctggctgcttcgagccctgagacctgagtttgaggaccaggcgttacttctgcccttctgagaggctccagcaaatcccgtcccctcggcaggcctgacaagatggtgtccagctgtgacactcaccactcactaatttctgggaccagtagtatttggacacaagctgttctggatcacgaagatctgaggtcaaccccagctgtgccactgacttgctatgtgaccttagggcggtcacttcactctccctgagcctcagtttccttatctgtaaaatgggaatgataatggtacctagttgggtgggtgctttgtggaataagtgaaagaatccatgtaagacacagcactgggcctgccacctggaaagtacctaatggaattatttttgtcattccatgctggatgagtaataatagccatttacatggcacttaccttgtgttctaagtgctttgtgtatatcaatccattcaaatccacagcccctcccctcaagtcactcactgtccaaccagggagatagacctgccttcattcagcaaaactaaattggctgaacacctaccatgtgccaagtcctgggataggtgctggggatgcagaagtgaaagactcagcccctaccccaaccaaggttcaccaaccagtgggcagaacaaaatcacgtgccatgtaagtccagtggtggtctggagcttgacttgcaagagccgactgtgcacattctttcccaagtcagggtttaatgatctcaagttggtaccttggcatttgctctggtgggagtatttacaccacacaaattggcaaacacaaccaatcagggcttcttttcccctcaactgccagtttaatagcacaccactgcatatggagcatgtcttgggtgctacagcggagatgtgagctggcgctgtaggagaatggagggcaggccgcctaaaagtgggcacacacatcagactcaccaatccaaggggccagggagatgaaggagaagggcattcgggcaaagggaccagcatatgtggcccgatgtccagggagctgcaagcagatgagagaggtgacagatggggctggagagcttacagtaggatggtcaatcctcccagtttgcccaagactaagggagtttctgggatacaggacttgcagtttgaaaaccgagatgctttggtcagtaccctgttcaacaggtccctgggaagaccatggggagaacaaatgggaggcagagaggaatgtgagcctgatgatgggctggcaagatcgggatgactctggtggtacccagacaggcacagactcagctaaatattttctcacccaccttcttatctgattgtgatggtaccttgtaagaggcacattgattcaatcaacctgtacacatcaagtgcctacgaccggcccgcggctctgctaggggctggagaaacaatgaaagccagacagacccggctcctcctcccctttccaggtactttcagtgcatgaaaaaacacaacacacaagtttacaaaccgttttctaatataattacaaattgtgatgagggtcagtaaaggaaactgagactgagacagaacacagcaagagacaattgctttagccagggtggtcagggtgggcctctcggaggaggtggcatttaagctggggtctgaaggaggaaaaggagccagcgacgggaagagcagggaaagccttccgggcagagggaacagcttggccaaaggcctggaggtgagagcgcattcgatgaccacaggcaggagcgcagtgagtgagaggaggagggggaagcgtccaggagaccatcaggaccaacctcacaggccttgtagccaggctaggcatgtgggtctattctaagtgcagtggggataaatggtgcacgagggagtttagacaagatgccgcaggtctgattcattttaaacagatcactccagggactgtggaagattggcagagaggccacagtggagcagagacccattcgatggctctctctgtcattattccatgcagggatcatcagccccctttccagatgaggagactgagtttcaaaggggaggaggccttcccaagcccacacgcccgtcagaggtacaactgccttcctgtgtttcaggtctcattgtcttcttcccacttctgcacgtgacatgcaggtgccagcaggacaggttcccttcccacccagaagttgggagtggtgtggccccccgggcactgtgggcagtggccacccagacctctcagaggtagctgatgggagctgaggccccagtgcaccccacagtcacacagtagacttgggatcagaattggcctctgctactgaagagctatgtctgtctgttcctctctgggcctcagtttcctcaaatgtcaactaagggggtggggctcgatccccttccagcccctcattcatccacccatcacccactagaaacccagcattatactgggagtttacagtccagccaggtagacacattcataagcaagtaattaaaataggcactgtatacaaaaaaattagcccggcgtggtggtgcatgcctgtaatcccagctacttgggaggcggaggcaggagaatcacttgaacctgggaggcagaggttgcaatgagccaagatcatgccactgcactccagcctggtcaacacagcgagactccgtctcaataaataaataaaatagaccctgccagggggctcagggaagacttcctagaagagatgatgtcttaaaggggtctaggagtttgcctgatggtgaagggaaggcattctaagcaatgagggcagatggacaaaagccaggggtgtggggtgggcctggtgggggggggggtattgtacctaggtgagtgtgagagagcaccagacactgaggtaggagtggtgggcaagtaccagccccctggggcccaggggccctgcagagtttgggcttcccatgtctgcttggggagctgatgtggacattttaagatagtggcttcattgagataaaattcacataccagacaatttgcctatttaaattgtacaaataaggctgggctcagtggctcatgtctgtaatcccagcactttgggagccaaggcgggtggatcacttgaggtcaggagttcgtgaccagcctggccaacatggtgaaaccccgtgtctactaaaaatacaaattagccaggcatggtggcacgcgcctgtagtcccagctactcgggaggctgaggcaggagaatcgcttgaacccgggagatggaggctgcagtgagccgagattgtgccactgcactccagcctgggtgacagagcgagactccatctcaaaaaagaaaaacaaattatacaaatcagtggtttctagtgtattcacagaattgtgcaaccatcaccacaatcaattttagaacatactcatcaccccaaaaagaagccctgttccccattagcacctcctccccctgctcccctatccccagccattggcaaccacgcatcgactttctgtctctttcgatgtgcctgtgctgggcctgtttcatataaatggaatcctgctttcatggctggcttctttcactgagcacgatgtgtccagggttcacctgtaccgtagcatgtgtcaatgcttcgttcctttttatggccgaatagtattccaacgtatgtgccattgtggatttttaagacttggaaaggtctgcactccagagagctagtttggagagtgggtgggtgggaggaggccagatggcgtgagaggctgaggagtgggtggaaagagctttctagatgctggcagcggggggagcggccaagaccagaccagagactgctgaggagggaagacctagtaattgattggctgtggggggacagggtggagagtgatgccacttcccagggcagagaagagtgagtttcatgaagcagtgccatagatacagaaatgatacagtgcccggtggtgggggtcgaacctggccaggcaacagagcaaatgaagggcggcttagggcaggggcagcctggggagtctgagagggagccaggacactgcaagggggagagggcagccagaaaggcagtccagatggagaggctggcaccgcacagaggggagagagagcagccacccactggcggcccccccgggaatgccccgcagatggaggagggatgctgagctgggcaggctgtctccagagagggagcaggaggagcctgatcttggggccaaaaccctttggcatctctaaggatggttctagaccttcctggaagccttgtgcccccattctgcagaggaggaaacccgttcagagaggccgactgctcgaccagagctggggctgcagcctgcatgtcctgactgcccagaagctctgggcagtgccaagatggtgaggctgccccttcatccagccatcagggaaaggtcggtgcccaagaggaaggcgagagggagggcaggacgactcaggggacccagacccagtgcagtaatcctcatgattactttatgtggtagatgctcttaccaatgagaacaatgtagctcagagaggtcaaataacttgtctaaggtctctcagcaaattgcttttgaaccagatggcttagtactgccaggaactgttacaagtgtttttacataagttaagcaatataaactgacaacaactctaggaggtagatactgttgtcccattttacagataaggaaacagtttaagtgacttccccgaggccacactgctcacacaggtgggtctgggtttgccagcagcctgcacactaaccactatgttcactgccctcctgcttgcatggcctccaaagcccatgctcattccacttaaggaggcagctccaagatgtatttatgggccaggtgtggtggcttttgcttgtaatcccagcactctgggaggctgaggcaggaggactgcttgagcccaggagttcaagaccagcctgagcaacatagtgagaccccccatctctacaaaaataaaaataaaattaataacaacaacaaaagaagtatttacagagcacttgctgggtgcagattctaagctaggcacaggacaagcagctgtgagtcagacatggctctgatcctgggggagttgagagcatggccaggagacccccagaaaaataattttggtgggtaagtaaagcactctgaacccaagcaatgttctgggccccaagaaaggcagggtctctgaggccagagctggttgagggttgagggagggtggtttgctaagacttggactgggaagataagccttgaagactagagctggaaaaaatgaactagggaaatttatgttaattgtttacatacacagaaactaatgtccagagaagctgagtcacttgctgaagaacccacagcacccaggcataaaatgtactcccggtgagggcctgggggcctgtggatggtttagctgcatttcatcccaaggagatgaaatgtttgttgcaaagctgtttcctgtccacccacttacccattgcacaatctcttccaggtatcatagcagagctgggttcatgaacccagcaggctgaagctgggagaggggcagggcctagaccctcagcctcctgattctcagcccagggccagcaagaagaggaaggtggatttgaatatgtgtgcacacaaggcagttgcctcttataggccctaacctcatactcagagctacagtgggggtggactccatatcagggatgatggccacagcccatgggagaagccaaatgagggccgagtgcaagcagtgccctccttaggctggccctggtactgcaggcccgccttttattaatattttaataaattgatcacatattcattgggcacctatactgtgcaaggccttgtgccatgggccttacgcttaagcagaatactcacaatgaccctgcagagatgggccttagaatcctaattttacaaataagaaaactgagtctgagtagttaagcagcttgtctggggctgcacagctagtaaaaggcctagccagtactcaaagccaggtcggtcttattccaaaagtagtgtcctcctctattctaccacatcacctctctacactgccctaggacttttcttctgccgtataatcatcttaattgtctgtaacccaaggatctagttctaagaatcagggcccagccagacattattaagcaagaccaggacccatgcacactgccccagacatcttcagatgtgcctcctaactaggtcaggattgattctagagaccatgacacagccaagctgggataggtgagggaagattgctgggagccctagacagctcacggacaagaaactagggagccctgacagaattagaactcccacgttggggcctggagacttcaaacccttcaagagatgagattttccagcagtggtgctgcatggcccctccgcgaggctgtgtggcccctccgtgaggctgcgtggctcgtgacctctctgagtcttcatccagtttcctggtgactctccttgtcttctctctcaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaagtaagtcctagggcccctcaagggcgatggctggccgagtcccaggtctacctgcagaaaagctcagagtgaggattgggtgccgtccggttacagccagtctttccctggtgggaagagaaatggaaaagtgctcaagaaaggggcatcctggggtggccatgctcccaccttgcagacaccacagtgctggcatctggctccttacccccttctgctgagtcacatggaagataaagtcaaggtctggattcacaaagggacaggggatgggaggcttggcaggagatgaagcaacacaggtagtatatgtggcagaaaaggctgcccagtgttctaacctggcagcagctgcctgaatcacagcccaaggtcctctaggaaggcactgcctgagaacgcagcgtcacaacccctgtatctgtcagggatggcattcagctgtaagtaacagagctgagccctatggctgaaactgtacggatttattctctcacccaaaaggagcccaaggtagacagtcctgggacagtatgggcaatccacgatggcctttggggcctggctctttctgccattcagaatggcataatcctagctcactgcagcctcaacctcctgggctcaggtgccctcagccttctgccctcagcctcctgaatacctgggattacaggcgtgcaccaccacacccagctaatttttctaattttttgtagagacagggtctcgctatgttgccaaggctagatttgaactcccgggctcaaggaatcttcccgcatcctcccaaagtgctggattacaggcatgagccaccacgcccaacctagtttctgttcttttttttttttttttttttttttgagatggagtttcactctgtcgcccaggctctggaatgcaatggcatcatgatctcagctcatggcaacttccacctcccgggttcaagtggttctcccacctcagcctcccgagtaactgggattacaggcatccgccatcatgcccggctaattttttgtatttttagtagagacggggtttcctatgttggccaggctggtcttgaactcctgacctcaggtgatccgcctgcctcggcctcccaaagtgctgggattacaggtgttagccactgttgtttctgttcttaacgtcacttcatagtccagcatagctgctgaagtcccagccatcacccacattttaggcagcagaagcagggaaaggacaaagggacacgccatagctgtctgtctctttttaaagaaacagccctagtcaacaacttctgctctatatcagtggcaagcacttaaacacaggaggctgggaaatgccatcttttagctggacatattgccaccatgaataaagctgggctgttctaaggaagaaggagaaaatagatactgggcaggtataattccaaacgcaaaaatactatcctcagtaacaaacactgagcagtttgtaagctgggaggagagaaaggtttgggcagatgtacagcaggctaacttgtattctagaaacatttctctggtggggagacaggacaaagaatttaaggaagtcctttcagaggggctgagccagagcagcgggcacagagtggtcacatggggaatagtaccccctgagccccccactgaccaacacctctcccccgccccagccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcaggtaagtgcttccgacgtgggccaggggagtgccccatcgcgctgtgccagggagggtcctgcagtcctcacaaaagactccttcacatctatggagtgatttcttcttttcaaaggcttttcatgtgatcggtccacctgggagagtaagtgctacctcttcattgtagtggtattaataacaattgctcccatttgttgagtgcatattattgaaggtaaaagttaagctgctgtaacaaaaagatccaacattaggtgacttaaaggagtggaatgtatttctctctcatgggagaatccagaggtgagcagtccacgtcagcgtggtgactctgatccactcagagactcagggacccaggttatttccgtgtcatttccccacgtcccctgctccttgtctgtatgattcaagctgagtctcaggcatgtctgtgcgaagagagggaagacagggcagcaatgatgtttgaagcaaggtaggtagaggcagcatctttctcttttgcatgcattccacgggcagggcctcagtcacgtggcctcactgagacccaggagagcccagagatgtcatctcttgcagcctaacttgtacctccatcacaagtgctttctgtgaagttcagcccactccagtcttaactccagcaaaactctcctcaagctcacctttagtaaccttttctgtggcctcacgtcatcctccaccccccacccttctttccttcacggcaaaaaaggaagttgccggccaccacagtctcccctccaccctgttctctctctagtccccactccacttgggctcctagcctcccctctctaccaggaccactgtcctcagtgtcataggaggctaagtcctagagatgcttcccagcctcatccccccacctgagggccacatgagattatcgaggacattatgctatctgtgggtagaagatctcatggttggcactgtgagtgtgcccctcagttattcactcagcaacctttgccaaacccctacagtaagcatggtcagggccatgtccatggaagagctaagggaggccaggctgcaagagggaaagtgactgggctcccgagctgatctttctgatgtagggtggggcccacatggtaagcatgcagggatccagttgtggaagtccaggcccaggaagtcttcctggaggaggtggaatttgacttgcagtttgaaggaccagtcgaaattttttctttagagatggagtcttgtatgttgcccaggctcatcttgaactcctggcctcaagtgatcctcctgcctcagcctcccaaagtgctgggattacaaacaagagctgcttcacccagccagtagaatgttgaagggaacaatagaaaaaaatggaattcagaagggaggaagggcatgccaaggacattgaaagagagagggcaactggctgggcacagtggctcacatctgtaatcccagtactttgggaggccaaggcgggaggatcacctgaggtcaagagttcaagaccaacctggccaacatggtgaagccccatctctattaaaaatacaaaaattagccaggtatggtcgcgggcacctgtaatcccagctactcaggaggctgaggcagaagaatcgcttgaacccgggaggtgaatgttgcagtgagccgagatcatgccattgcactccagcctgggtgacaagagcaaaattctgtctaagtaaaaacaagagagaggagagagcaactgactccacctggttgaggggtgtttccatgcatgacctcactgcatccttgtggcctctctgagaaggaagcatccatgtccccatttcacagatgatgctcagacaagttgagtcacaaaaccaggaagagtgagaggcaagaattgactaggtctgacagactccagttcttgggcgaagtccttgatgtgtccacggcaccttgagcttgactatgggtctgattgcgcatgtaagtctgtgtatttgtgagtgtgctgtcatatgtgtttggtgaacatgtgtttacaacgcatatgactgtggccatgtgggttctgtatacatgcatttgtgagcatggatgtatcaacctgcagggccttggggacaggggtaggggatattgtgtatttgagcatgagtttgtacatccaaatgtggctctgcctgtctgtgtgtttgtgtctgaggagtgtggttttgtttgggaatgttggtggtgttgctgtggctgagagggtatgtttgtgactgactgcctatagttcttttggggccctgggtggatttaagccctgctcagattggggtccagagggagctgactcaaaggaggcaatctgagaaaaccctcaaaaaccagccggtcacagtggctcatgcctgtaatcccagcactttgggaggccaaggtgggtggatcacatgaggttaggagttcaagaccagcctggaaaacatggtgaaaccccatctctactaaaaatacaaaaattagccaggcgtggtggtgagcacctgcaatcccagctactcgagaggctgagacaggagaatcacttgaacctgggaggcagagcttgcaatgagctgagatcgtgccactgcactccagcctgaatgacaaagcgagattccatctcgaagaagaagaaaaaaaaagtcaacaagtgatagaaaagacccctaacagattagaaaacctcagctgtgcgtctctctggcttgacaaagctctgagctggagaaacccaggcccccaaagggggtggtggagagggaactctttctaactggtagaagccagaaggaagctcctggagccctttccctggttgcggggaactctcctacatccatttgggagctctgcaggtggaactgcctactcaagacgcctcagcttatttgtagctaggagtggttctgggctgctgggatggaccctgctgtctggagctggatgtacccaggagtagagatggggcggagtatggacgtgaggggtttccggggaataggcacacagggagagccctcaggatcgaaagacagagaagcaatgagaaacaagcactggattaggagcagagaccgaggcttggctttgccgttcatttgctgcatgacattagcaaatgaacggcattcatttagtcagtgtatgagtcagctactcctgcaataatgctgcataacaaaatcaccccacaactcagtagtttaaacaataaatatttattttctcactcactagtgtgtgggtcagctagggtttgactaatcttggccatgctctctgtgctgggcaggtctccagaatgtgatttgggttcagcctatttcatgtgtctcctcattctccttggactggcagccaccccaggcttgtttctctcaaggtgaagtgtaggagcatggagggagccaaccatatctcattggccaaaacaagtcccacggccaagcccagcatcagtgggatggagaagtatactctgcccacagtgagtgggccctgcagatttacttggtaaaggatgtgggtacctaatcctatcacagaaaaggaagaactggggtcattgttctaatctaccatgcacgtgaaaatcacttcctctgaggcctcagtttccccaccaaattgtacataagaactatatgtaagcatgacttccagaacacagatttctctctaccccagtcctgctgaatcagaaccccagccgcagaccctgggaatatgcattgttaacaagtgagtcaggtgtttcttaccatcggacaaatttgggaaactcaggtctgagtaagtctaaaccccctgaagccctcaaagccctgaggcttttgaaattataacaagtctttccccctcctctttattccaagccccttgtcttacagctgctcagagcccagctgggggctgtgcaacctcaccacacccccaccccattatccccctttgccaggtgaggaaactgaagcccagagaggtagagtcatttatgctaggtcctactacttaagtgacttctactaatatttaaacccaggaccatgtgactccaagtctacactgttctgcagtatagtgtagacacagtatctgcccttgaggatgtatgtcctagttggaaaaataaaacacagacacagagcctacatacaagatggcatggatgagggcccaagaggtgctgggggagatgagggagatcacaggcaggagaaatcatcctcctagggaatgagcaaagggtatgtcctggaaggcttcctggaagaggaggcatttgagcttgactttgaagaatggagaggcttctagcaagcagagatggaatcatacaggaaggaagatggcctgggggagggaagtacagcaggcaactggagggagggattcttctttctgttcctcctaagtatcaggttcccctgacgcagagtcttggcacatgctgttccctctgcctggaaaggctttcttatcccattcttccttcaggcctcagctcatttcactgaccttcctgacttggtgggacacctccctccccaaccccagcaccatggccttctagttcccgtggttgaaattttaccttgtgtcattgatcatttagttcttgttcgtctcccccatcatcggcactcgcagcacacaatgggtctgcttttcctcaccatggttttcccggcacctagagggggctgcaccacagtgaacattcagcgaacatttgcagaagggttcggagaagcgtggggtgaggtggggtgtggagaagtgcaatcgggctgggaaacaaggctggggactcaatttccagacaaatgcattcagtggtcggttttaaacagaccctaaaattcaatatataaatatctagctcattgccttaaaaggaaaaagtgtttcttctgggcaagtgactgggccttgctcgcaatcccttggcattcaccggggccagaactgtcttctgacttcatccagccatcatgccgcctttgaaccacgctctgcctttccagagcacctttctgcctcatattcatgagtcgtgctcatggccccgaggaaggaggctgggctgggcttgagggataaggaaacgggttgggagaggtcatgccacatactcaggtgtactccgctggacagtggcagacccaggagtcagtctggctgttcagagtgagccacgctaccctcctgcctctccacacccacagacaagaccatagcagagaggggcaggagggagggacagaggctgagccttagggtgggcagtcagaggagagcttctctgaggaggtggtgtttaagctgaggtccgaatgacaagcagacagccctgcagacctgggggctgggaggtgtagcatttcactgatcccgggcttctatccagcgcccttggccattctccagggctgccccggacacagcctaagccctttaaggatctcaccctgagcaagcccagaacacccccacctctgccagcttccggaagtagtgggaagggtctgtgctttggaatcaggcagccgaacctggctttgagtcaagcctggccgctcaccagcatgcaaccttggacaagtcactcagctcatgtctgattgcatcttcctcatggatagcttcgccctctccttacaggaggatttagctgtgaggatttcagctaagctatgcaaggtgcctcccaggttgctggcacaggtaggcgcctaaaacacagagatcattctctattcactctaatccccaaaacggctcacatttgtcaagtgctaactgtgtgccaggcaccgtgctaagcccttaacactgaatcctcacaacgatacgaggtaggtcctgttgtcatcctgttttatagatgaaaggaaagcgaggcattgagaggtaagtgacttactctgctctatcccaggccaggaagtaacagaacctgaataattgtatctctgcatcctcagggcccaatgttgaccagacccatgccttctacagagatggggcaggcagtccatatgctccatccataccacagcctggctgggtatccccagcctttgaggccccctgtaattaacagggtcagccacttaggaagctctaccatcagcatatcctaggagctcatgttgcagaaagggcatcagagcggggcctgacaaattcagcccccatcccacatggccccttccaagctgtgtagccaggatgtgagaagacctcatttctctgagcctcagttccatcacctacaaaatgggcatttatctatcattacagctttgctagatggttgtggacattaacaagaatgtgaacagcacctggaacatagatggacagtacatggcagcttggcttagttccctattgctgccagaacaaaatacctcaaacctagcaacttaacacaatacacatttattatcttattgttctgcaggttcagaagcctagcgtgggccgggtgcagtggctcatgcctgtaatcccagcactttaggaggctgaggcgggtggatcacgaggtcaggagttcgagaccagcctgaccaacatggtgaaaccccatctctactaaaattacaaaaattagctgggcatggtggcgcacacctgtcatcccagctactcagaaggctgaggcaggagaattgcttgaacccaggaggcggaggttgcagtgagcagagatcgtgccattgcactccagcctgggtaacagagcgagactccatctcaaagaaaaaaaaaaaaatctagcatggatctcatcaagctaaaagcagtgttggcaggatgtgtcctttctgatggtgctaagggacaatccgttttcttgcttagaggggttgttagcagaattcaattccacgtggctgtgggagtgaggcctctctccccttgctgaccatcagctgggggctgcctgagctcctcaaggcctctcttgggtccttccacagaaccctgacatctcagaagcagcagcagggcattgagtcttcccactctccaactcactggttctttgactctctgctgggaaaggttctcttcatgtaagcactcaagagatgaagttcaagctacctggataatctaggaaaatctctccatctcaagggtcataaccttcatcacacctgcaaagtcccttttgtcatgtaaggtaacatattcacagatcccgggaattaagacgtgaacatctttggggggtcattattctgcctatcacagaagttaaacctacatcaaattacaactcagcagtgttggtagaggccttggagttcacctagggcaaacacctccttttagaagaaaactgaggtccacagaggttccttagtggctacccaagatcccacagcaggtccccagcatcctgaccgggtgtctgtgacaccactccacatggctttctcgtggaaagactttcaactctccaaagccttttctgccacttgtgttctctgatcctcctgccctgctgtggggcgggcacacaatggctcagcctctggaactggcatgaacgtgtactcacctacttctctccctgggggaccaagaggatcagagagaaatgggccaagagagccccctgtgtgcttatgcctgagaccacgaggttcgagagggagatagagggagagggcacttccctccctgggccgagccctctccgcgcatcttcctctttgatcctcccaagcattctgcagggaaggcattgctgacctagagtatcatttaagattggttttggctgcatattctaggaagaaaaataacagatagccactgccacagtagtgctggttaacaatcaaccattaaccacaaagccgacagcatggaacaagaagcacttagctagctggggagtctcagggtcgactggacagcaacgctggtcttggcgaggtgcattcttaggtttgtagttcatctgctccgggtcactcggcagctctttgggttttgtcacgtttgggggttgactgctgtccactggtctggagtggccctggaggggacaactggagcaacaactctgctccaacatgtctcagcctccagcaagtccacctgtgcatgttttctcatggcaatcacagggaaccaaggcagcaggcagacactcgcaagggcttttgcaagcctctgcttatatcatgttggcttatatcctattggccaccacaagacacgtggccaagcgagagtcagagagagagagagaactacataagttacagggcaaagggtgtagatacaggggggtgattaatacaactggtctaacagcatggcttagactaaagggaggtttctttttctcatgtgtgaagcgtgtcagaagataggagtacagcaactccgtggagccatcagagatccacactcctcagcacacagcttcatgtcctcatggaccaaaatggctgcaaggtctctggctatcacatccatgtctcaggttgcagtggaaggagggtgagaagggtagggccctcccttttaaggaaacttcctagaagtcccacacatgcttcagtttatatttcacggccacttctagctgccagagaggttcagaaaatgttgtcttctatttgggcacaatgtacctagctaagaaccaggattttgttaagttgagaaaaagagagaatggatagttgtagcgtctgccacatcccattttacaggtaaggaacccaggctcagagagaggtaacttgcctgcagtcacacattggcctagtagaacagctggcatctgaaccctgaacaccaccttttctcaccttcaccgccaccactattccagagcactcagctactcatggtgctgtttgagaatctgagcagcccagacagctgcatttggctcacatcatcctctgaccccttaatctgggccaagtcctgtgctaatcactttacaaacaggtcttcatttaaccttccttgcccattcacagaggagaaactgacgcacaggaggtggaggtaggctgcccagaccacctgctttgaggcccaggcttttagcatcttgctagtccaggtgctggggtaggactgtcccaccaggaggccaaaggtgaggtcaagacgattccacaacccactaggagatgggtgattggatgtttccccagcacaaagcccagggcctcgcctcagcccactcataggctacttatgggtagggccaggtaaccaggggtagaagaaaccaacctgggccttacagtcagacagacctgggtccccatctcagccctgctgcctggggtgtgggggcatcctgtcggtctcttcctttcctcattggtaaaaagggagggattaacccctactccatctgattgtgacgaaggggcctggcactgggcaggctctgctaaacatatgctggatcaaggggagagcaaatgagcacatgaacagccaattgccaccctagagaggggctcttctcaagttcaaggaaaaaataataataatgtctcctggacccagttttttgttttatttttttcatatgttccacagattggtagttcccaaaaacgttaagaactatcatgtgagaaaaggtttctgaggccaaatgagcctgcgaccactgggttaaaccgagttaactggatgtctcccctgcgggacttctcagagccttgaattaaacacatgtgcagtgtgagtctccacaagcagacgggctacaactctgcgttcctcaaactttcttagccacagaatacgcagtgccaccctagcaccagttgtcagcttttccttttttctgtcccataccactctctaagaggcccatcagaaagaatcaaaggcccactttctggaagttttatttgcagaaattcggttgtgagaattatcgtcaggtcatccagaattgcagccagatcatcgggggttaactgcgttgctacgggtttaagggacaaacactcaaaaagcagctgtcccatgatgagctgggaattctaagagtcccgtcccaagtaaactgtccctgctacagaccctggagaggactagcgcagtgacaagcaattgtcatggaactgttagctagctggtggcaagaggccccacgtcactgcagcagttcccaactgtgggtgggcacagggcctgggggagagggaaactgccttccgctggctgcttgggaagtactgcctggggcctttgttttagtggccagcccacaaggtcggtagactcgggttcctgagggcgccagaaaaggggagaatctgtctggtccccgcttttccctttctcccttccttcctccttccttcctcactttctcccttccttcctccttcctgtcttcgtttcttcctccagtaaatattggtcatgcacctactccaagccacacactgtttcaggctctggggataaaggattgaatgagagacaaggtccctgacctcagatagtgttggtgctatgacaaaaataaaatgagtatgagaaggggctactggaggggagaggtagttcaggagggcatctcggaggagttgacatttgagctgagacttcaatgaagaggaggatttggccatggaagatgtgggggaagaggtttccaagcagaaacaccatagggccaaggccctgaggcagaacagaaaggctgccagtgtggacagcttgggagagagggggcaggcagagggaggtggcagacgccaggcagctgggccttgtgggccacagtagtgtgtctgtgtcttattctgggtgcagtgggaagccgctgagggtcatcaacagggagtgaagacatcagggagacattgggatctgcaagtctggggcttgggatggggtctccagctgtcctgtgcccagcgacctctcccccactcccttggagctcagggatcttcggaccagtgaaagggtcgtagctccgggttgtgaggggaagctgagccaatccccaagcccacccacctcttgcagcaaccaggggcacaggctgctggcttcctgtcctgtcctgggatcctagtcccagaagaccctgagagaccaccccgtacaacccctgcatgccctgagaaggaaacggaggcacacagagggaaggctccttccccaagtctcagccaaggaaggggctgaactcccctctggggttcactgagggcagcagggcccctgaccacctgctccagacaagcaggccccgcctggccggcctccccctgcccctctcggccacaagcctcttttgtgcttactccctggggctccatctccttgcaggggtcacagggcaccactgaccccatccccctgtcagcgtgcccggctagtaattgaaaataccagaattccctgatgaccaacttacagggaaacctgacaccccagggtgggcggtgggcagcaggaggggtgggagagcatccagctgttcccttttctccgccgttaatccccctggattccaggagaaaggctagccctgctggcccccactggcccgccttgatcatcttcctggcaaatgctgcctccttgccacgcctggggttacagggcttatgggatcagagcccaggttagctgcctgtaacccaagcctgccagctacgcctgccaggcccagacccccaaggccgcgtgggacctgcctccaccagcagctgagttcccagagctggggcgggccgggtgggtggtaggtgagtcagcgggaaccaggcggggttagctctgcagcagcaggaagggagctggaccaggatgtcctcaggggccctcggaggtccgctggtttccagaactccctggtcagccggcatcagccacagccagtggaggggaaaggatgtgttggacctgggtgagcctggtttgaatcccagctccactgcttgctgtgtggccttgggcaagttacttcacacttccgtgcgtccatgtcctcatctgtaaaatgggtataacagtaataccagccttgtagggttgataggagcatgaagtgagttaacggatgtgaagcatgtggtttgctgttagctgcgcggcctttccctttttctgggcaccatggggcatacgggggttatcagaatggcaagctgaatgacaagcttgttttagttgaggagcaggttgccacccctactagtccttctgtggctccccagtgcctcaggactggaagtttggcccccaccttcctcggcagccttgtctcttcacctctcatggaactctttgtatggctgctccaagaccctctgagctccagggccgtatataaagagtgtagcccaggcaggtgaggggggcaggctcagcagaagccaggctgcaagcagccgcgtggcaggtggatcatatactagaccaggactcagctgctcctggctctagtccagctttaccactaccagctgtgtagccttggacaagtcactttctttctctggccctgaatccactagtcctcaaaatgtggtccacagaccagcagtatcaacatcacctgggagtttgctagaaatgcacattctcaggccccactccagacctgctgaagtagaatctcagtggggggtgttgtggggaggccagcaatgtgaattttaataaactctcctggttatccttatgcccattcaagttttaaaagtgctgcaatctagagagatacattctacaattgtcctttgttgggaggtgaaactccagagagaggtgtgaacagaacagcctctgctgaaatcccagagggtgatgtgaacagagcagctctgctgaactccctgaaggtggtgtgaatggagcagatcctgatgaattcccagggagaggtgtgaacagagcagcccctgctgaaatccctgaaggtggtgtgaacggagcagcctctgctgaactcccagggagaagtgtgaatggagcagcccctgctcttgttcaaggctgaatcactttgaccaagtcctaaaatgggagcttggaccccagagctccatgccacttctgagtcttacagcttccccagtgcctagcatggtgcccatcctgggacaggcactcatttagttgaaaaacagtatgcttcctcccattaagctgcaagtccctggaaggctgggatgctgtgaggttcctctccggagccccagcaccccgtatcatgtggttggcatcatagcaactccacaaactgaagaattcttcacaatgtctccctcctgaggggcgcccagcaccccactcagaccttcacatgcatttccactgccttctcacagcgtcctggccaggtgagggttcctacttgataggtgtgaaaactgaggctcagcaaggctaaaagtacctgcttaaggccacacgtgagtgagtggaggagcagggagctgcatacgggtctgttggactccaccctcagggctccccaccgctaggctagacggccttgccagggactggatgggagcgtcttgacctgggcactgtgcgggtctaggcatgaagcagtaggtgagcgagcacacctggcagcagcgcaatccaaatactcctcacccgtccttgcccttgcgggctctgtgtgtctgatgctccattaatgtaacacatatcaacgtgctgtaagacagcagcacgcctctgactccacccttcacacatccctccccacctgcttggccggccctctgggagacagacccagtatttcaaggagccctggaggctgccttacccagcctctcaccccagaactgtcctcaggcccctggaggcaggggtgggaggcatctctcccagaatctctggcagctgagtttcaagcatcctccttagcttctcagagcaccctgtcgcacccccacctccaccacacacacagacccagtggtcagcccctgtgggttggatgagaggggcagagaagctgtggggaggcatggggattggggtgcttcccgggccagcacaagggatgagcccccagattggccctggtcagtgacactccagaagggccttattttgttgtttcactgggacaccgaccactgacaagcccgtgatgggcagacagcctggacttcataaagaagctggatcctcggcagtccaggagagcagaacactcaactcctcacaaaggcagttccacggggagggatggcgctggggctgaaggcaggtgggaagtaggaactgctttgagacccagagggggtcatagctagggcaggatgactcagctccaagcccacctcagctcctcgccagctgtgtgaccttggggaagtcactgtgcctctctgagcctcttctgcaaagtgcagatattgaccctcatcctacatgattgttgagggggttaaatgagatgctgcaagtccatgctcagtgcactgtggcaggtgacacctgcaaacacccacagcactgacaacatgccaggtgctacactgagcacacaaccagacccctgatcccaagaggccaatgcccctggcagggcaaggagccgagctgagggtcaggcagcctcccctgggtgtaaaaggaacagaggctcatcagggccgcatggaccagggtctaagtccttcttgcaggtgctgccacctcatctggagtgtctcgggacaattttccatagctccttggggtgcgggaggggagtctggacctgcccaggcccacgctggtccccaggctcattctcggtgtcaagggctgcagaggaaggactggcagggaacattggagcctcgaggcctcagagatcttctagcctggccaggggtgcccaggaggaagccaggtccagaggggaggcagatcgcctaggtcacacagccagttagcagcaaggcagagaggcagtctagggacagacacagagcaggaaatgggtgagtcagctccagccttcaaaccccacagctgatgttcaggttcccctgaactcctaccaggcctgctccacactcacatcccatatggtcagagcccctgcagagcaggacttggggctaggagaagtgtcagcctccactttccagtgtccttgtattggctgagacaggacgtctgcttgtcacagacccgcccaggaatgaggaaagaatgcaggaggtgctcccttcaccctggtgagtcctcagcccctcctgggaccacaaaaatctcgggcccagagaagcaaggaggcttgccagcgtcacaccacgggtgtggggaccacattgagagtccctctctggccagtcccactctggagcaaacaactgctctggcaagatgcagacctgggtccaaatcccggctcccccactgactgtgtgatctcaggaagccgtgtgcacctcggaacttcaatgtcttcacctgtcagcaggggtgatacaccctctcatcaacagtcaactcaggaagcgtgtgtaaagggcccagggccatgtctacacagaggtgatgctttctggaggtttgctccatgtgagaaggaggcaaaagacagcaggccggatgcattatgaaataaggactcaagaacaggctgtgtgccatggacctacctcggcacctcaggcagctcacaccccctctcttgacctcagtttccacgactgcaaaataagggaactgggccaggcatggcaggcatggtggctcacgcctgtaatcccagcactttgagaggctgatgcaggaggggatcacttaagcccaggagttcgagaccaacctgggcaacatggcgaaaccccgcctctacaaaaattacaccaggcacagtgtctcatgcctataaccccagcactctgggagactgaggcaggcagatcacctgaggtcaggagtttgagaccagcctggccaacatggtgaaactctgtctactaaaaatacaaaattaaccaggtgtggtggtgcacacctgtaatcccagctactcaggagactgaggtaggagaatcgcttgaacccaggaggcagaggttgcagtgagccaagatcatgccactgcactctagctagggtggcagagcgagactccatctcaaaaaaaaaattagccaggcatggtggcgcacacctgtggtcccagctacctgggaggctgaggtgggagggtcacttgagcccaggaagttgaggctacagtgagctgtgttcatgccactgcactccagcctgggcaacagagtctcaaaaaataacaatcataaaatcaaatgagggaattgtactaaggtatttcttctccccactctttgcgacagagtttcactcttgttgcccaggctggagtgcaatggcatgatctcggctcacagaaacttctgcctcccgcactgaagcgattctcctgcctcagcctcctgagtgctgggattacaagcatgcaccaccatgcctggctaattttgtatttttagtagacacggggtttcaccatgttggcaaggctggtcttgaactcctgacctcaggtgatctgcccacctcagcctcccaaagtgctgggattacagatgtgagccgctgcacccagccatgtactaaggtatttctaagcatccttctagcactgcacacagccccctgactgcttgtctcttcatctaaccacctctgtgagagcactcacagcactggtgggaggaatgggaggcggaaataactgattgattttattgagatgaaattcacatgacatacaattaaccatttctatctctactgtctctcaacttgatgtggcctgagcttccccagggctggtgaagtcgtcagtgtctgacctgaaggtgccccatgagagctcagcagcagcacccatagccctgcatgagcccctctgccccctgtcggctccccgagactggctctgtggcctcagccagatgcccttccctctctgatcccacagtgccccacctgtccgagtacctctgagggtgggccagaagctgcaccttctcatgcctccctgatccctgacctctggcctctcttccagctccatcggcagtgtccatcatgcatcaggtgagccgcaccgtggacagcattaccctgtcgtggtcccagccggaccagcccaatggcgtgatcctggactatgagctgcagtactatgagaaggtacctattggctgggtgctgtccccatcacccacctccctgagggcccctctcccaggctgaggcctgggagttctgccccaccgcaagatgagacgcactggtgcagcagaaagagcactggccttggagtcaggctgcctggctcccaatccagctccgctccttcccactgtgagacctcaggcaggtgccttgacctctctggatctcacttttctggtctggaggatacacccagcaatctcagtgaaatgcaacagtcacatccctttccctaccacgaccctttcatcttgacctcagtggcttgatgttgggaaaaactgggtttccaaaaagctgcacttatgaagtgataattagtcactcacctcttcttcgacagagatttgaaacagctcaagagagcttccgcctgccctgctctgagtcctgctaaaacacccactttcactcgcctgcatgccctttgcatggggagaggtgatttcactttgagcttttaaatcagaccttaattactccctttgggtggaagcccctgggatggtagaaggatcactggactaagagtgagaagccgtaggttcaaatcccagctccgtccttcaccagctatgtgaccttgggcaggcgtctttctccctctgaacctcagtttccacctgtgtcgagtgtgggtgagacccctcgcggggagctatgcaggttacggagaaaaggcagcacagcacccagaatgggacctggccctcagcagaggccatgtgtgtccctggccttcctcctctgccctgcctgctgcacagtgggcaatggtgacaggatgggaggccaagtggatgtggggtctgcacagtacaggggccaggaggtagacagcacaattgcccacccacatggctggacatcagaggccccaggaagcctctcctttgaatgatcacttctcttacctgctccaggaggcaacaaacagccacagaggctgcaagggcacctgggaaaggcatcgcggggcttccattcagactaggtgtcaatgactgacagggaggcctttggttgagggcaagcccacggggaactgcagatggatggaagggctctccctgaaggctgagaggaagagtgcagtcaattgcagccagtcctgctggagcccaactttctagagcccagcccggccttcccactctgttaactgctggatcggctaaccaggccggtctccagggcctttcaaacacttacccagcctttgccggccgtcttaccattgcttgcgtgcgtgttcatcccgtcccctaggcagtgcattccaagaggtcaggggctacgtctccattcaccaccttctccccggcatccaggcctggcaccaaggagacacttgatcaatatcagttgaatgaacaagtgaatgaatcctttcccttgtgccctggcccccaaacacctcctgggacttcatgcctgccgtccccccacccacccacctcactgcccacccttttccctcatcctcccctcatctctgcctgttggaatcttcagggtccctcccaaatgtcacctccgccacaagtgaacatggactctgcccctctcttagagcaccgcatgcgggcggagggtgcctgtgtctcccgcaggggaccatggacactgaaggaatgaattgtgtgaatgaatgagagacatgagtgatggagcctgtgaatgaaaaagggaactggctgggcgcggtggctcacgcctgtaatcccagcactttgggaggctgagacaggcggatcacctgaggtcaggagttcgagaccagcctggccaacatagcaaaaccccatctctactaaaaatacaaaaattatctgggcatggtggcgcacacctgtaatcccagcactttgggaggccaaggtgggtggatcacgggcctgaccaacatggtgaaaccccatctctactgaaaatacaaaaattagcccggcgtggtggtgcacacctgtaatcccagctactcaggaagctgaagcaggagaatcacttgaacccaggagacggaggttgcagtgagccaagatcgcaccactgcactccagcctgggtgacagagtgagatgctgtctcaaaaaaaaaaaaaaaaaaaaaaagagggaaccaatgggtggctggatatggatgggtagataaatggatgaattccttctgtctaaactgctcctatccctacattctccacctggccaggtctgactcaaccttccagatctcagcctaacatcacctcctcagagaagccctccatcactgcccagatgccatccagcgccccatttcatcttctccttgtgtcttgcccttctgcatagcatttatcacaattatcattttttaagtgttatggagtaattgggtatttactacctctacattgagctagaaagtaagttccttgagggtgaagatcttgccatgatctctgctgtgtccccagcgcctggcacacagtaggtactcaagagctgtttgttggatgactcaggaagtggacacacgagggcctgagctgtgggtggtgtgagggaagcagccccacccctcagtgggccctggagggcctcgaaggagcaggagtcctgggtcaccaaaccagccgctcccaggctctgcaggagccagcatctctgctccccgcagcaggaatagcttagcaactcagaaccccaaaaggcaaaaaaaaaactaattaagaagctttgtgattaaatgaaactgaaagtgttagtccccaaagacgggcaacggaaatgaggaatcccagggcaggtcctgcctgcgacccatttcctaccacagcgggcaggcctggggaggctgctggaggtgtgaaccgggaggcagctctgccctactttccgccgctgcccgagcatccccaggccgctgctggggttggcaggacctgcaggatctgcagcagccaaggttaccatctgctcacatttcatgagcacttgctatgtgctaagcacgtcacctctagcatctcatttatcctcaccacatggttcttcaccccattggatggaaggggaaactgaggcacggagaagttccataacttgcccaagaggatccagcaaggatttgtacctatggtctcactctttacttggctctcctgcctcccagatttttttccccagggatgcttctgggatgacctttaagaggtagacaggaccagtccctgccatggagaacgtttaggcataaatggtgaggggggtcaggtggtaagaggctgaaggtgtgacagcctgaggtacacctgtgatgagacgtggccctacttctttcagtccctcccccagggcctggggtacagagagggacagcttggcatctgccagtggggagatggacactggttcagtcaactttcactctcaccagctttgggtcaggcactaagctgggtaccaggaatcctgagggtgccaggtggctcggaggcctcagggacttcacagtccagggagaaagagtcagacactgagagccatgagacaaggtttgacactagccacagaagggtcagcaaaggtcccaggagggcaccaataggggcccacagtcctggcatgagtgagggaaagccttcattcagtgacacttaagctgagtcttgaaagatgctaggagttcaccaaacgcgcaggtgggaacacagttgttctaggcatcaggaatcgcaggtgcaaaggccctagggcagggatgtgtgggctgcattcaggaaacagacaaggcaagtgtggcagaagcagaagcgggagcatcaggggaggaggttgggagggaggctgggctaattgtcaagggccttccagccttgggagtctggattcgatttaaagtatgatcggatggctctggaattatgcaatctgactcagattcctttaaagatccctgtagcttgctgtgtggagaatgcattccagggagacatggagacacagggagcgcctgtacagggctcccaggggacgctaagtgagaaatgatggtaggtagcatgggctgggggagttggcagtggagatggcaaatgccagcagagtctttttttttttttttttttttttgagacagagtttcgcacttgttgcccaggctggagtgcagtggcacaatctcggctcaccacaacctctgcctcccggattcaagcgattctcctgcctcagccttgcaagtagctggaattacaggcatgcaccaccatgcccggctaattttgtattttaagtagagacggggtttctccatgttgatcaggctggtctcaaacttctgacctcaggtgatccgcccacctcagccacccaaagtgctgggattacaggggtgagccaccgcgcccggccagcaaagtctatattttaaagcccggaggacccaggaaatgtgaagggtgactcctaggagatggaggtgccttttcctggggcagatgcaggtttgtgatttgtaggtgtggtgcttactggggcaaaggggttggggttcagggaggatagagaacagcagccaggagagtgtgcagaggaagaaccagaagataggatcctggagaatgccagggtttaaggaggggaagaaagcggagttgatgaaaatattagaggaggtgctggcagaggggtaggagcagaaccaagagtcatgtctctccctgacctctcagacaagtctgtgatatgccagccaccaccaccaggaagggacagctaggctgcaggtggtaggatttattccagcaagtccacagccggctgttacctaacacaggaatcctccttgtgtctgctattagattctttcctgaatgctccagtcttcctaggaagggaagtcagatactgagccctgcaggcctgtgtggcccccacctccacctctttcccactcctttccttcttcagaaagggctctctaggagcgggccctccgtttggccttccccaagccccactgggatttcccagcctgcctggagtccagagctgacaactgcgttgctagatggcttctggaggccactgatgaatggcggtggccttgtgcagacccaggcctggctgcttccgtcagttccaacgccccaggggaggtggcctcctttggcagctaccccaaagcacacaggttcaggatcccactggtcccccaagaactcaaggagaagagccattcatgaggccacctgtggtcgatggcccctggtagcccacatcaattttagaatttatttaacagaaaatgaagaggaaggacattccaggcagaaggagcaaaggttggaggatggggggtgaaactatgaaagttcaggccatattcagcttgttgcccagtacctggagtaggatctacctggagaggtttgtccactcattcattcacttttgcattcatccatccatttaatgaacatgggaaagggcttactctataatggtttttttgtttgtttgttttttgggggttttttttgtgtgtgtgacaacagagttttgctcttgttgcccaggctggagtgtcatgacgcaagctcactgcaacctccgtctcccgggttcaagtgattctccagcctcagtctcccaagtagctgggattacaggcatgtgccaccacgctcggctaattttttgtatttttagtagagatggggtttcaccatgttggtcaggctgttctcgaactcctgacctcaggtgatccagccctcggcctcacaaagtgctgggattacaggcatgagccactgcgcctggcctctataatggttttgatgataacagtgatggtgggagccaacatttattaagtctttttatgtgctagagactgtgctaaaaagctttacctgtattttccttttaaatctccaaaaccaccttttatggtacctacttgcattaacccactttagagatgagaaaactgaggcctggaaggcttaagacatgcacccaatgcctcactggccctaagctaccaggtaagtgctcagactaaggactagtggatttcatactgaatctcttcccatcgtcccttggtgcttaatcactgttcagataaaggtaccccagggagaggagagaccgaagggaattggcgtctctcgggcatctccaatgtgccaggcactacctgatcaaattttatcttcacaacagccctgagagcttggcatttattgttccatttatttggaatagaaaacaggggctcagggaagtgaagggtctttcccaaggtcacagtgcaatcaagtgaaaaaacaaggatatgaagcagcttccagctgggtacagtgactcatgtctgtaatcccagcactttgggaagctgagacgggtggatcatttgagtccaggagctccagaccagcctgggtaacatgatgaaaccctgtctctaccaaaaatacaaaaattagccgggtgtgatggtatgtgcctgtagtcctagctactagggaggctgaggtgggaggatcgcttgtgtctgggaggtcgaggctgcaatgggccataatcgcgccactgcactccagcctgggtcacagagcaacaccctgtctcaaaaatatagtcagacagagagagacaaaaatgaaaaatgaaacagcttccaatcccttgcccagctttaatgaagggagctgctcaggttggttcctcactctcatgaggcacctatggaaccagcagccgcctctcatctccctcacataatcaggggcttaaaacctccaacatctctaagtgggcacccacccagtttacagaatctaacctgttttcaagtctgagcagagcccatgttgtacagtggcacttagtgtccatgtctggtactgcatcccaggttttgtagatttttgaataccagtttaatgttcattcattatgtcaataattagtgaacacttactgtgtggcaaacctggggggatccagagatgagcaagacatggtccctggcctcaggaaatccacatccttaaagaagatggacaggtatattaggacaataggtgggaggggagacaatttggacccacaacccctggctgggacatctgggaagtctccccagcagaggtggcacttgcgctgagtcttgaacgatgagtaggacactgcaagacaagtgaggaaagggtatttcagacaggggcaacagtgcttgcaaaaactcaagagtgtccatggaaggtagagttgctagataaaatagaagacacatgattacatttgaattttttaaaaataaatgttttagtacaaatatgtcccaaatattgcacggggcgtacttataccaaaatgtatttgttgttcatctgaaatttaaatttgactgagcagcatcctatatttgtgtttgctaaatctggcagctctaccaaggaagggggaaagagttagggatggcaggaacctaggaaacattagggatgttgcaggagagactgcaaaatggtgggtcatgaagggtctggaatgccaggctaaggagtcggccttcaccctgtgggcactggagaaggactttgtgtgagggaccccaaacttggtacaggggaacaaacacaagccctccctcatgggcttagagttaagggggcgagaggagcctcagctggaagttgagggggcatagcagaaaccccctcctgtggcacccacagcaagtgctctgggactgagaaggaagaggtgcatctggctgggatgtcaaggaggcttcctggaggaggaggcagatgatctggcttggcaaaagagacttcctctctgctgctgccccacccagctatccctgcctccccctgttatgggggtggtagagacacatcttcaagtcagcccccttcatatcccctacatcccaagctttttctcctctcctttcctctgaacctgctgccccttctgccaggcatgcacatctttgtctgggtggttcctgtttgttctttgagatcccattccagtgacccccactcacgagggagctttcctgacttcacctggtagcccctgatatggtttggctgtgtccccgcccaaatctcatcttgaattgaagttcccataatccccacctgttgtgagagggacctagtaggaggtaattgaatcacgggggtggttacccccatgcttttctcatgatagtgagtgagtttgcacaagatctgatggttttataaggggcttttccccctttgctcggcacttctctctcctgccaccatgtgaagaagtatgtgtttgcttcttcttctgccatggttgtaagtttcctgaggcctccccaggcatgaggaactgtgggtcaatttcacttctttcctttataaattacctagtcttgggtatgtgtgtatagcagcatgagaagggactaatgcagcccccgtcccagaccaggtcacatgtccctcggtatgtgcttaccctatcagtgtgagcctgttatacctattgattcattttattatctgaacaaactctgaggtagctactgttactatcccccttttacagatgaagacacagagaagttaaggaacttgcccaaggtcacagaggtcatatatactagagccaggatttgaacccaagaagtctggctccagcttgtgatcttaacctccatgctataaagcctgtaataacattgcacgcactgaatcttcattgttttgggaaggttttcaagggctccgtgcactctgtgatgtgtgtgtgactggcatgtacaactaggtgtgtgtttttctggataagcattcacagattttcgtcagaaaaaaattgtctcaggagcttcatgatcttcaaagggttgggatcctcacatgcttacttttctggactgagctctccaaggccagggcctgtgccttagctccctgtagaaccccagtcccagcctagtgcaaagaggatatttggggaagttttgccgggcggctgacagatgcctaaacgagcatcatctgtatctgatccaaccacatctccactcccactgcagcagctggatctttgtcctgtcctagattccttggatcgccctgggtaacattcaggaagccaaaattggtgttcttcatctctcaaaggagaagacactaggtttggggtacccaaaggcatggacattagatagaggtggctccatgcaagagtctggtttcttttttttttgttgttgttgtatttttttagatagggttttgctctgttgcccaggctacagtgcagtggcataatcatggcttactgtggccttgacctcccaagctcaagtgatcctttaacctcagcctcccaagtagctgggaccacaagcatgtatctccatgcccagctaattttttttttttttttttagagaaagggtcttggtatgttgcccagactggtctcaaactactgggctcaagtgatcctcccaccctggtctcccagagttctgggattacaggtgtgagccaccgtatccagcctggttttgaatctcaaagcaaccctgaactgatagtgaccctgagcatcattttcccatctggaccttagttcttgactcacccaagtgtgctgaggctgaacaagggctcttacgcttaactcatcaaggcatagggcagggaaggggatacagaagtgaatgaggtgggccttctcccttcggtctccaagaactcacagtatagtcctcaggatctgcacataggaaccactcaatacatgcatattagtcagcttttcctgagataacactgcaaaacaaacaattccaaaaatccaacaccttccaacaagtggctatttttcttgaccatgggtttatgtctgtgggtcaataggggtggccctgtttcatcctaagagttgggtcatggtctcctcctgtttctcatgctggagccagtggttacccagtgcaagttcctctcatggcagaagcacaagaggccaagacaaattggcagggatctgtaaagcctctgcttgcatcatgtccactagaatgttccagtggccaacacaagtcatgtggacaaattcaacatccataagacagagacatatactctgcctacctttgtgggcagtgttgaaaagtaacatggcaaaaggcataattctattaaagggaggggatgaagaattgggaaccatagatgtttatccaatggccagacctgcccccaatgtggcaggagcaggcagtgggctctggacccactatgagccacaacctcactaattttcttctctgttcctcggcaggagctcagtgagtacaacgccacagccataaaaagccccaccaacacggtcaccgtgcagggcctcaaagccggcgccatctatgtcttccaggtgcgggcacgcaccgtggcaggttacgggcgctacagcggcaagatgtacttccagaccatgacagaaggtgagcagagtccagcgggcaagaggagggcacagactccacaaacagaacaaactcaagggtcaccattctcatgaagcacctttgtgcagattagaaaaggcactcccttctagatgtcagccctccctccctcctaatttcgaacctttgtgcacaaccatatataaaagccctgtttctgttcccgttgtgtcagccaggccacttcctttcccaggactctggggagctcagccctaacttccagagccactctgagcaagtcatgcattccttggtccaattttttctcatctataaaatgaaagcatcacattcaatctgagaaagtaagcatattttatccatacacaactccagtgacttacaactggactgagaaggattctgaagctgcatccgagttcagcaggaagaagttctgggatagattagtactgtctgctccaggcaagggaatgggagatcgtaacctgtgtgctacgtttcccactctggaactacatggtctctaagcaccattcctgctctaataatctttagaagcagcacagtttaaagaatgtgggctctgaagccaaagaaatgaggattccatttctgatttagccctaactgtatgtgcctgaacaagtcaccttacctctccaaccctcagctttctcatttataaatgggggtgataacaatgatctcattatcactatcattatcaaactagtgtaagaataagagacctagcacagggttggcactaagtcccaagcatttcagcactcaccagattgtagataagtcatagtttgtcattgctgtgtgtctggaatcccttttaccagccagtcaaactccagggtgactctgtctgaccagattccagcatcctctcttagtatctgttctaaccactaggcgtgccttggcctttgcctggttgaacatttcagaggctcctggactcctaaattcttgccttatcacaaaaatcctccctatggctctaccatctcttccagcactcacctcctctgtaatctttctgttcctcgtggcagcttttttcacctctctaagcctttttccatgttgggtgagtgtcattgactgggaactaggagactgtcccaagatccttttattaattcaacaaatgtggctgaggccttgccacttaccaggccaagtgtgggcactaaggtcccagagcgcgtccctgatctcagcaagttcctgttctggtcagtgagacagttgagaagtaaaaatagctaggcgcggtggctcacacctgtaatcccagcactatgggaagccaaggcgggtggatcacctgaggtcaggagttcgagaccagcctggccaacatggtgaaacctcatctctactaaaactacaaaatcagctgggcgtgatggcaggcacctgtagtcacagctgctggagagactgagacaggagaatcgcttgaacccgggaagcagaggttgcagtgagccgagatcgtgccatttcactccagcctagtgacaagagtgaaactcccactccaaaaaaaaaaaaaagaagtaaaaataataaaatgtaaatcaatgatagtgttaatggcattgagtggtggtttccaagagccaggctaatgccaagtgtatcttctgcattcttccaattcaactcccacccttggatcaagcagacctgggttcaaatgcctggctggggtgctactttctttgtgacctcaggcacatcatgacctcactaagcccagtttcttcatctgtaaaatggggtaatcataggactgttccgagatacgtaacatacttagcacagtgagtgacacataaaacactcagggacaagaatagttaatattgattgaatgcttgcttaggtgccaggtgttgttctaagtgctttacccaacaatcctgagataggaaatattattctccccattttacagataaggcaactgaggcacaaagaggtaagtcactttgccttatcacacagtcactttgccttactaagtcactttgccttactatcacacagatagtaagtggcaccatcgggagtcaaacccggagagtctgtctccagagtctgcgcttttaactgcctgtgtgtgtgtcagctgttattattgttggttttcacatcaacattgagatgcaggaattatgcccattttatggatgagaagttgaggattggagcagttcatggacttgtccagggttacttgtgagacagtgacagccccttttctgcatgggcatgtaacaggtgctctgtcaggggcaggaacagagtctagggatcccaggagacccagcagcatggcagggggtaggggacaagggtattacgactcccacagccaggctgagaatgccctaccatgctttctccccagccgagtaccagacaagcatccaggagaagttgccactcatcatcggctcctcggccgctggcctggtcttcctcattgctgtggttgtcatcgccatcgtgtgtaacaggtgggtggggtctccaggcttggccaggcctggctgtcccagatggcttctctctctctattcagtcatccctctacagtgctggtgaaccgaggaggcattctcacaattgcagggagagatgtgggtaggaagtggaaggcttcaagtggcttcccactacctaagcggccaccatgtgcaatccatccctttgggataggcatcgcccctgacaagcccactattgaaagaggtggcacattgagacactaatgcagtgggcaagaaagattgcaggatgctaggagtttagtgggtggtggaaggggtatacagattgtcctgctttctgcatgagttcaggccccctggctgaggtgctggaaagacagggaggacttaggaggaggaggggggagggacctcccaagtggctaggacggtacaagcaaaggcaagagggtggggccagttccttgacttctgctgggtataatgcaaagaaagattctcttcttctttaaagagttccccatttcagaatagactgaaccataagttcaggtggacagaagcccctggggtttctggggccagaagccgtggctggaagatgactttactttttgaagggggcttggctggagggggaggaactggggaagatgagaacctggacttgaggtgggaggagtgggaagggacaagtggggccaaaaggggcaggcagggagccctctggcaggggtgtggcttctagggcctgcccaccctctccctatcacctactgtggctcccagctccctgggcgccttcaggtggctccagccctttgctcttgttccagaagacgggggtttgagcgtgctgactcggagtacacggacaagctgcaacactacaccagtggccacagtatgtacacacccaagcgggctggaacccttgggcccttcactgtcggttccccagtgacctcttaagccatctttgacctccttctgccatgctgcaggcagacaatgtcaagtggttgcctggttgcactaagctcactctcacctctaggcctttgcaagtgcggttccctctgcctcaagcgctctccccctttccctttacccatgtagctcttactcatccctcaggcctcaccatacacacactcctccaagcagccttccccgaccccaccccatcctgggtttaggggctgcatctgtgctcgcaggctgcattgaggtggctgtttcttgtctcaccaccgtgatagtggtggccgctggagacctggaattgtgtctgatatttaccgtgtctccccagcaccagcgtggtgcccagcacatagtaggcactagacatatttgcagaataaataaatgaatcaaactgaataaataagatgatgaggactctgggctctggcccaggaggtgagaaaagcagcaggagtccctccttccttctcttcctctcactctgtggctccagacccctgttcttccccagtgactcctctggtggcctcttccccttacccagtgccctcatttctcccaccgtcccatcctatatcaggccagggctggggatgtatgtgccacacacacagagatgtcccctcctgaagggccagagagaaaagtagatcatagattcctctctccacttgacctgggcagaaccagtaatcagggagtcgggggagagcaagaaccttagtccttacttcagctcactcagcaaaaaggagttctaaatgggtccaacattcattctcaaactgtactcagtgtgacgccctgaggttcctcaggtgcctgcctctgggtacagaggcccatcatcatatccctgcccttgtcacacaactgtcgtgggcctaccacatatgccaggcactgttctaggtgctggggatcccagcacctggtcataaggccaggcacagtagctcacacctgtaatcccagcactttgggaggctgaggcaggcagatcacttgaggccaggagttgagaccagccttgccaacatggagaaatgctgtctctactaaaaatacaaaatttagccaggcatggtggtgtgtgcctgtaatcccagctactcaggaggctgaggcaggtaaattgcttgaacccgggaagcagaggttgcagtgagcagagatcgtgccactgcactccagcctgggtgacagagcaagactctgtctcaaaataaaaaaataaataaataaacatataaggccaggcacagtggctcacgcctgtaatcccaccactttgggatgccaaggcaggtggatcacttgaacacagaagttcaagaccagcctgggaaacatgatgaaaccctgtctctaccaaaaaaagttcaaaaattagctgggtgtggtcatgtacgtctgtagttccagctacttgggaggttgaggtgggagaatagcttaagcccaggaggcggaggttgcagtgagccgaggttgcagtgagcccagatcgcaccactgcagtccagcctgggtgacagagcaagacccagtctcaaaaaaaaaaaaaaaacaaaagaaaaaagaagaaaagaaagaaagaaaagagaaatacatgtcataaatgcagaagcgtgtggtatatttgaagatgaaagtgctataggaaaaagacaaagtggaacagtaacggaccgagagttgtggggatcagggtggcgtttttaaataggacagcttgggttggcctcactgacagggtttgacttgcacaaagatacagaggagctgagagagtgagctgctcagaggtatctgagggaaaagcattccaggaagagggaacagccaatacaaaggtcttgaggctggagcttcctggcaggtttcgggaacagcagaggccagtgtgactggagcagagcaaagagagaaatggaagctttgagggagtccaacgtgcagatgctcatcaggctcagcaaagccttggcttttccctgagtgaaatggggagctgctggaaggttctgagcagagggatgacatgctccaagttacggccttggcgggacttctctggctgctgtctggagaatggaccaacggggctgatgcaaggagaccagtggggtggctgttggaagaatccagggaagacatgatggtggccagaccgagtggcagggagaaggtagtgggaagtggttggattctgacatatttcaaaagcagagccactagatttgctgcaggactggatgtggatacgtaagaatgagcagagtctaggagctccaggtacgaagcctctgggtaagacatggtttgaagtaaaagttcctgggcttaaaaatagtttggggctggccaggcacggtggctcacgcctgtaatcccaacactttaggaggccaaggtcgggagttcaagaccagcctgaccaacacagagaaaccccgtctctactgaaaatacaaaattagccgggtgtggtggtgcatgcctgtaatcccagccactcgggaggctgaggcaggagaattgcttgaacccgggaggcagagattgtggtgagccgagattgtgccattgcactccagcctgggcagcaagtacaaaacgccatctcaaaaaaaaaaaaaaaaaatagtttggggccaggcgcagtggctcacccctataatcctagaactttgggaggccaagatgagcggatcacctgaggtcgggagttcaagaccagccctaccaacatggtgaaaccccatctctactaaaaatagaaaattagcctggcgtggtggtgtgtgcctgtaatcccagctacttcagaggctgaggcaggagaatcccttgaacccgggaggtgaaggttgcagtgagccgagatcatgccattgcactccagcctaggcaacaagagtgaaactccatctcaaaaaaaaagaaaaatagtttggggcatatatgtaaaactagttaagccattaaaatttccagaagataatttaggcaactattaaccaatacagaaatagaaaaggaccttctaaacatgaaagcaattgataactcctaagaaaaagatggacacatttaactacacagaaataaaagtcacctgtacattaaaaataaaggtcataggccaggtgccatggttcatgcctgtattcccagcactttgggaggctgaggtgggaggatcacttgagtccaggagttcgagaccagcctgggcaacatagcaaaaccccatatctacaaaaaatgtaaaaattagccaggcatggtggcacacacctgtagtcccaagctactcaggaggctgaggtgagaggatcattcaagcccaggaggtcaaggctgcagtgaaccatggtctcaccactgcactccagcctgggtgacagagtgagaccctgtcccaagaaaaatgaaaaataaggccgggtgcggtagctcacgcctgtaatcccagcactttaggaggccaaggcgggtggattacctgaggtcaggaattcaagaccagcctggccaacatggtaaaaccccgtctctactaaaaatacaaaaattagctgggtgtggtggtgcacgcctgtaatcccagctactcaggaggctgaggcaggagaattgcttgaacctgggaggcgaaggttgcagtgagctgagatcacgtcactgcactccagcctggggaacagagcaagactcctcaaacaaaaaaaagaaaaagaaagattataaattatgtcatcccctcttattgccccaagtaatgaaatcgtgatcatagatgtggctagacgtactgcgtgcattctgtgtgccaagaattgtttcaatgctttacatgtatttattcatttgatccttataatttctcactttgaatagggggaaactgaggcacagaggttgcacagctgctcagggatggagcaggggtatgaactccagctgtctggctgaagagctggcatcctgtgctggctccattctgctgagctggaatgggataggctcccatgctccgtctcctggagccactggggagcattgctatgtggtttgtgagtcagtaataaggaaacaggtggggtctatttttaagagagaccccagggtttgttcctagatcagcacattttaaggcctaagatccccctccctgcatcctaagctctaacgttagatccaagcagaactttgttctgttcaaagcactgccagccctgtgatcccatatccacccagccaccctgcgtggtcaggacagaggaggaagctgaggcccagagatccatgtgactggcctgtaatcacccacacggccccatggtttccatcattcagcaggtgctgagtgagtaccaaggtctgtgatgcctggatatggagccagagggactgacctggttttcatccctattctgccactggccagctgggtgacctcggggaagccatcaaacctctctgagccttgacatctttatatgggaagtagcaagaatgatacttttgtcacagaattgtgaggattaaatgaattaagggacattaaagtgctttggaataatatttaataatagccagctcttctttgcaacagtttacaattattcagcactttccttttgccaactactgtactgagccctttaaaaagatactctcgtttaatcttgcaacccccttaggaggtaggtattgtttattatacccatcgggtaggtgaaaaaagtgagacacagaggttaagtaacttgcccaagggcacactgctggatcaacacagtggttgatcctggcttcaaactcacaaagcagctgatttgtgaccagaattagcagcggtgccagaattcagacccagaactctgtacactggttcctcttccctccttgtgaatttcgcatttgagggcagagcaacagccagtggccgacacccgtaaatcatccaaacaacagcccaggattttctgtagcctttgcctgcagaggtcctcacccgacctcggttcagcaagtgccccttctgagagccaggcttgttggaggctctggccaccaggcactcactcaccttctattccaagagacagactggggaagcacctgggagaaattggcagcctgagggttacaagtggagactctgtagccggcctgggttcaaaccccacttctgccatttattagctgttttgatgtcatttaacttcgtgtgtgtgtgtgtgagtgtgtgtgtgtgtgtgtgtgtgtgtaacagggtctcactttgtcaccacactggagtgcagtggcacaaacacggcttactgcagcctctacctcctggactcaagcaatcctcctgcctcagcctcccaggtagctgggatcacaagcctgcactgccatgcctggctaacttatttattttttgtagagatgggtttctgccatgttacccaggctggtcttgaacttctgggttcaggcaatcctcctgcctcagcctcccaaagggctgggattatgggcttgagccacagtgtccaactcatttaacctttcttatgccaatttcctcgtctgaaaaacaggcatcacatgtgattgtaccaaatgaaattgctatttttgtaggtcagaaacagttaaatattgacagtttcataaggtatcagcctaataatggcacttacctggtagggttgttaggaggattaattggattaaaaactataaagtgcctagaacaaggcctggcacccagtaaatctacgctgaatgtatattcaataagtgtttactaagcatctactgtataccaccttcacataagtactccagagccaacattctaaagcaagggcttatagctttgggtctaaagacccctagagcttccaataccccaaaattatatgtgaaatatgggagcatacacacacaggaatacttttccaaggagcagattcataattttcatcaaattctcaaagacattcaagacacgtagtaatgctattatgtgttcaataagcactttttacttattgggcacccactgtgtgccaggccctgggattcagcatgaacaagacagacacagcctcggtcttcctggggaaaagggtaaactaagccctcacgggcagcagagtcttccagaaaggagtgtcagggggctgtgggcatgagtatctgggaaccccggtacaaggtagaaaagccacacagacatcaagatcataagagtgggtgtggactcaggactgtgggagcctgaggagagggtacaggtctccactggagcaatccaggcagtcttcacagaggggatggcatttgatctggtcacaaaaagaaagagagagtgttccaggtagagagcacaacatgaacaaaagcatggaggcaggaaataatgaagtgtgtctgaaacccctgggtcaataagtcctgtgagcaggcatctagggagcagggagctggaagtgaggccaatccacggagagctgggaatgccaggcaggggcatgcagctttgtcctgcaagcaacagaggccctcttgaccagtgctgctggccacagcatgacgatggcatccagttgcttggcagtggaggtgaccaaggagggtttgagctgctgtacttcctcttacctccctgagtcaacccattcctgtcctctatccccatcagaaagggcctccctgagtcatgttgggagggaggctgaaagccagttgtcaagaaccacagggcatgcattgagtctgagcaagcaagagagcatccccaggaagccgatgccctggctctgagaaggctgatggggaaagaggtgatcatggcggaatactccagcaggcagcatggaccagattctggttgtatttcatccaggaggcagtgaacatggtgattaggagtactggccccaggctcaagtctaacagacctggcttcaaatcctggctgtgccatttgctagctgtgtggccttggccagatgacttagcttctcagagccacaatttccttatgtgtgaaatgggaataatggtcctttcctccaagagtttttgagtggagaagctaaggcatataaagagcctggcatggtgttgggcacaaagggctcagtaagtgacagctgctattatgattctgtctgtgtcatttggattctgctcagccctatagacattgagtgtctgctgtgtgcagagctttatgcgtgtgccaggggagggagaaatcagaaaaaaaacatgtgtccatttcctcctcccaggcactcacagtcttggatggtggttcttaacctctttgggggcctcagactcctgggagactctgctgaaagttttggagcctatggccagaaaaacatatacatgtataaaattattaaaagtccagaggtcaggccaggcgcggtggctcatgcctgtaatcccagcacttcgggaggccgaggcaagtggatcatttgaggtcaggagttagagaccagcctggccaacatggcaaaacctattaaaactctatgaaaaatacaaaaaataagctgagtgttgtggcacatggctgtaatcccaactacttggaaggctaaggtgggagaatcacttgaaccctggaggcggaggttgcagtgagctgagattgtgccactgcactccagcctgggtgacagagcaagaacctgtctcaaaaaaaaaaaaaaattaattaaaaaaaatccagaggtctatactcaaggttggattttttgagaacttttatttttgacaatatttatttccataacttttggactttagaagcagcatgaattactttttgaatagaaaaggacaatcataataaatgcatcccatctcaggaggttaccagatctcctactgctcatacttaggactgctaagtagctcacagacccaaattaagaaaccctgacctcaagggttaaacaaatacccacacaaataatcccaaataaagctaacgtgttagagcagcggttgacaaatttttctgtaagggaacagatagtaaatattttaggccttatgggtctctcttgtaactacccaactctgctgtcatagcttaataacagccacaggcaaaggaatgagcatggttgtgttccaataatactttatttacaaaataggctataagccaattcgccaacccctatattacatgctctaatgcctagattcctggaatgtctaaaatagaggccaagagtggtcaactcatatgtccaaggtcacacagctgagcagggttgatggcctcacgcaccaaccagccaagccttatggtgacccaaggatttcaactgccaactcctagaacttctgcctccaaatttgcagctcccggagtggcaggagaatgtgagcaggatgctggaagagccagaggaaagcctgggctcagggaggactgggaggtctggatgttggaagaccagctgcctatctgggaggcggaagatggatgggtcatctttcccttctttcaaagcattttgccgactcagtgctggctgttcagaattgggtctttgacatccaggttaccttcttctcttagtgcataaaaaaataagtgttggacagaagagagggagaacaaaaaataataataataataaaactaaaatatgcatcagatcaggaatcaaatgccccatgtctagcttcatgctgattaccagaaaatcagggatccagaaggggttaagacttggctagagggggacctgggaggtggcccagcagctgtggacactcagtccctggtgagtggggcggcccctcaaggctctgggggcccatttgggaaggctgggcagctagaaagggaccctgggggaagaggaggcttgaattaggcctggagagacaaggaggagctctccttagcagaaccccaaagacaacacggtctattgcctgctgtttctgtattttagttccaattcgctcccttcctttttgcccccttcttcgtttacgttgcaccccttgattctgtatcacctatcgatccgtttatccatctgtgcccatgcccataccagacattgcttatcagtcctgacagtctcagctgctccagaaaaccactgttgatcagtgagagttggaacaagagctaagacctatctgccacccctgctggtctctgttcccctcacctcctactcagttcacgcccatctgctcagtaagccccagagaggtcaagtgacctgcagggagttgcccagttcttatgggggccacatgggagtggatttccctccacggagggactggctcccgcttttcctttttgtgtgcatcttgagtcagtccatatgacagagcctggtcttgtcccccagtgaccccaggcatgaagatctacatcgatcctttcacctacgaggaccccaacgaggcagtgcgggagtttgccaaggaaattgacatctcctgtgtcaaaattgagcaggtgatcggagcaggtaggtggctggtactctcacatgtactatgaccttagccatggctggtgagaccaccccaatgtatacccttggggcagaaggtaggatgtgggacaggcgcctcaaaggaccccccaaggcctgaaggttcagaatgaccatgaaagaagggccctcaaaggtcatccagtaaaaccacctcactgacaaaagaggaaactgaggcacagggctgggaggggacatgcacagtgagtcagagattgagctgggtctggagcccagttctctggactcttggtccagtgcttttccttcctccccccatgtatcccagtgccttttcccatctcccaggttcccctgcaccctcacccccatgcccagccagggataaccagagaacaaccatgaggaatttactgtcctctcccagaggtgactggaacttttctggacccctgacattcttgaaggggttctgtgtctgcaaggatgagtgggccattgagaagaaaatgtacctgcaggccccgtgagtggacatgacagggaacaggaaggtggcccttccacctggcaagtgacatcctgtctgtcttggtgtttctctctcaggggagtttggcgaggtctgcagtggccacctgaagctgccaggcaagagagagatctttgtggccatcaagacgctcaagtcgggctacacggagaagcagcgccgggacttcctgagcgaagcctccatcatgggccagttcgaccatcccaacgtcatccacctggagggtgtcgtgaccaagagcacacctgtgatgatcatcaccgagttcatggagaatggctccctggactcctttctccgggtaggggaagccaagagggccaggggcccatgaatggggcaggaaaaggaacgatggacatagcttcatactgtcagagcctgaaggggtcttggaaaagctctaggtcaggaatggcttgcaggctgtcactttccattcccttatccatggcaggcactgctaatcaatcccagcactctcatccactaagcccagaggcagtcccagaattcttctcagtatggttccccaggaagccacaatcagttgatcagagttggcacacatctgaaatctgtttccattcctgctcttagccagccttctcattatgcacaggagaaaacgggctcaaagagaggtaggatttgcccagagtcacccagagggtcaagatgaggcctggactggaaccaagtgtcttgacctctcatccaggttttcaccagattttggagttctccaaagctctataggctggtgggaggagttcagagcacaaggccaacagaggaaagtgtataggcctcccaggagaccaagtcaaccaaccagacaaagcaccagactggacatcagaagcaggccagtggaccagctgccattcagtaaatatttgtgaagcacctaacatgtgccaggcaccttccatacaccttcttgtataacccagaatagccctgggggatgggtgtgatttaggcccatttaacacacagatgaggaaactgagactcagaggtattaggtcacatgtccaaggttgcacagccgagaaggaacaaagccagagtcaaaccaagcgtgtctgcttcaaagcctgtgttctcaccaccactctgaagttggcctctgacgggcctctctggggtcccaaagcatctgagtccttccccaggggagcccagagccaggctggcagggccctgctctggtttcccattatgaggatgatgcagagctctgatgcctgctcttctgtttactctgtgttttccccacttctcccaaagcaaaacgatgggcagttcacagtcatccagctggtgggcatgcttcggggcatcgcagctggcatgaagtacctggcagacatgaactatgttcaccgtgacctggctgcccgcaacatcctcgtcaacagcaacctggtctgcaaggtgtcggactttgggctctcacgctttctagaggacgatacctcagaccccacctacaccagtgccctggtaagatggaggcagggaacaccggagtcacagagccagagaagagggcatgagtgtccatctctccctgcaagacactttcactaacgcccaattgggccaagcactgtcctgggccctggagacaggaagacaggaaccacagctcctgccctcttgcaattcccacactggtggggaacaaatgtgcagagccatgtggagtgacagggctgtaagccaggacagccagccttggaggcagaggaaggcttgctagagaggttgatatctgagctgagagcagaagggcccggaaacgtttgtcagatgccatgttctcatggcaaagtcctgtgacaggaatacaggctgtaggggcagtggtagtgagcagtcacgctggagaggtagacagggctggaccttggagctcctggaatgcccaggttcaggactctctcctgaaagcagcaagggttgttgaaggtttaaactgaaaggacaaagagcccagagatgggtgcaagtaggcaagtcacttgagtactgtgccatgtgagacatgcctccttgatggggagacataaggcacagctgtgggattgagggcagctgacaattctttgggagctcagaaaggcttttggagggacttgaggatgagaaggaggtttccagatggcagagtgggaaaaggcacttcatgcagagggcgcaaatgcccagtggtctgaagctgcatggtaagtttggggcacaatgaggtgcctcatgagattggggcatcacagggcacagggtgggaggattaagagaagaggtcagacaggccagcctcccacccacaaaccctcctctttctgtctcccagggcggaaagatccccatccgctggacagccccggaagccatccagtaccggaagttcacctcggccagtgatgtgtggagctacggcattgtcatgtgggaggtgatgtcctatggggagcggccctactgggacatgaccaaccaggatgtaagtctccaaggggataggcaaggcctctctggcccaccagatgggagagggaagatcggggctcctggccttgtgccagtctcccagagtgtgggacataggcttctgagatcatgggcctggctcccagggcagctgccagcccaatggtggctgattcgaatgtctgcacaggactctggactctccagggggtaggaagtaggaaaggccacccatccacacatcagcacgtcttcaggacgcatgcacctgtggccagccccaaatgagaccacatctgcccttcaggtgttcaccacctaactgggggacaagacgattattcagggaaccagatgttatgatcaggagcttttacgatcaggtgctaaatcagagtagcctggaggcactgaggcaccggcagcatgggcaagatcagccaggaagtgatcgcaggacaagtggggttcgaaaggtcgcaggacatggagacttgagggcttccagtgggaaagaacagtgtgtgcaaaggctggggttggctaatgcggggttgaagccaaaccaagggatctccattagcaaaaatgaagacaggaaggactcgaagaaacttcttacacagggagggtgacccacagttgagctgtggaaggtgaatctggccatggtggcaggacaggctgagaggggtgtttggatgcatttccttgacagagaagcaggtggagatggtgggagggagccccagccaggcttgaggccatggtgtgggcctgatagagggaggtatctcacacctggagctgtaaatggcactaaaatcaagcatgtggccatgtggggtcaagcaaggaggcagactggggaggccttggggtcatccaagccaagagggggctcacaggatgggaggagctggtggaaccaggcacaggaggatcatcttggtggaccctggggagaagctatctcagggcactggatttcccaagattggcaaagggtggggcaggaacccagctgccatgtcagattgagggtctagatggtggaaacccaggtcatcccatccctggggctgcctccaggaggtgaaagtggttgccacagcaactaaataggtcagacgtgcaatgtactgggggtaagatgggcctggcagagggtagacgccctcagcccatccacccaaccccactgcactcctgcattgtcccaggtaatcaatgccattgagcaggactatcggctgccaccgcccatggactgcccgagcgccctgcaccaactcatgctggactgttggcagaaggaccgcaaccaccggcccaagttcggccaaattgtcaacacgctagacaagatgatccgcaatcccaacagcctcaaagccatggcgcccctctcctctgggtaaggccccaccctggccctgccccagccaggccctgcccctcttcccgtctcccatcccttctgcccccacttcaggcaaatgctcttccttactgcagcttgggatggggaaggacaggactagtgtttattgggtacctgccctgccttaggggtgcaggagagcagaggacgcagactgcccagaggaagaaaaggacatataccctgtgggtgcagaggaggcatcttttaaagcatggtcagagaggacaatgaagaaaaattaccaaaggaaggccgggagagatggctcacgcctgtaatcccagcactttgggaggctgaagtgggtggatcgcctgaggacaggagttcaagactagcctggccaacatggtgaaaccccttctctactaaaatttataaaaattagccagcccctggtggtgtgcacctgtaatcccagctactcaggaggctgaggcaggagaatcgcttgaacccaggaggcagaggttgcagtgagctgagatcgtgccactgcactccaacctgagtggcaagagtgaaactccatctaaaaaaataaataaataaataaataaataaataaataaataattaccaaaggatccagaatcttagttcgtgaatagatatgcctgtcactaagtttccttcctagctaccctcacgctcaaacctggaccctctaacttccatttataacttcatcacacacatgctaacacaaatccagtcctacatgcacagatgaacacacaattaggcacaaacactcatgcctcttcacacacacagtctcaggctctcacacctacacacatccataggcacctgcacacacacacccattcagaagtttgtactcaccatacacccatctgtgcccccacactgagtcagcatccccatgcctgagagacgggctcagcctgaggggtgttcacttggggacctggtgcctcccttctcctcaaggctcaagcctcccagggcaggctccatgaggcagcagctctcctctgccttccttgggtggctgtcacaggtcacactgctgcccctgcacacacttactcctcaggacccacaaccccacagggtttcagaggggcatctggccaggtatacttaggatctagggctggctgtagccaagtccttaggaaggacttgggccaaagtccttcttccagcatgttcttatgagtgggagatcatcatgcttccctctgcctgtctctcctcaccatgaccctgtgtcagccacccctaactctccagatcaaatccctctgagctttaaacctcatgagagccatttcactccttgccagccaagaagtcattcccattagcgccaccagccttagctgggctttggagatacagtctctggacagtccagaaggtgagcttcctatagcacaaaccagggtggagaaggatggagaatggcactgggagaggaaactgtgaataaccagaatagttagtctagctgaaatccctcctcctgaaaataagcatggagctgcgtcttcccctcctcacttccgaggtccagcctcttggccatccctgcagtgccttccctagacttcccagttggccccagctttgagttctgcacacacactcactctcgcatgctcacatatatatgcgtgcatgtttccacaggttcaaacccatgcccgcaatcatgcagaaatactcacgtacataccccttcacctgtgttcacataaatggatgcacacgtgcacattcacgcatacgcagcctacaggcatgtccctgcacgctccctgcaaacaggtgccctgaccatctctgtcgcccacccccaaccccagcatcaacctgccgctgctggaccgcacgatccccgactacaccagctttaacacggtggacgagtggctggaggccatcaagatggggcagtacaaggagagcttcgccaatgccggcttcacctcctttgacgtcgtgtctcagatgatgatggagtaagtgcccagccacttctgcttgtcaccttagcaccccctctccaccggccccaccagccaagtggggtgatctggagggtgaggaatagatcatgtcccaatagggaagcagggaccaaggggcaagatggccaactttggagtcacctgtggactgatacccaggtctgcctgccacctacaagctctgtgaccttggtcaaatcatagcacctccctcagcctccgttttctcacctacaaactgggggttggtaggaaggttgagggagatataaaggaagcgggtgcttagaaaatgcaagctggcagccgggcacagtggctcatgcctgtaatcttagtacattgggaggccgaggcgggcagatcacaaggtcaggagttcaagaccagcctgaccaacatggtgaaaccccgtctctactaaaatgcaaaaaattagccacgcaaggtggcatgcacctgtaatgccagctactcgggaggctgaggcaggggaattgcttgaaccaaggaggtagaggttgcagtgagctgagatcacgccactgcacaccagcctgggtgacagagcgagactctgtctcgaaaaagaaagaaaatgtaagctggcttccccctcccaatagcaggggagagaaggccccctagggaccctgattccgactcaagtgctcttccacctcacaccatagtcgctccctccagctgtggctgcctgcccactccccactccccactccccagtactccttgctttgccatcttcctcccggggaagcccaggcagctctctaccaggcacaggaccccttcacccgcatatttccctaacacacgtgcttctctcccaaagggacattctccgggttggggtcactttggctggccaccagaaaaaaatcctgaacagtatccaggtgatgcgggcgcagatgaaccagattcagtctgtggaggtttgacattcacctgcctcggctcacctcttcctccaagccccgccccctctgccccacgtgccggccctcctggtgctctatccactgcagggccagccactcgccaggaggccacgggccacgggaagaaccaagcggtgccagccacgagacgtcaccaagaaaacatgcaactcaaacgacggaaaaaaaaagggaatgggaaaaaagaaaacagatcctgggagggggcgggaaatacaaggaatattttttaaagaggattctcataaggaaagcaatgactgttcttgcgggggataaaaaagggcttgggagattcatgcgatgtgtccaatcggagacaaaagcagtttctctccaactccctctgggaaggtgacctggccagagccaagaaacactttcagaaaaacaaatgtgaaggggagagacaggggccgcccttggctcctgtccctgctgctcctctaggcctcactcaacaaccaagcgcctggaggacgggacagatggacagacagccaccctgagaacccctctgggaaaatctattcctgccaccactgggcaaacagaagaatttttctgtctttggagagtattttagaaactccaatgaaagacactgtttctcctgttggctcacagggctgaaaggggcttttgtcctcctgggtcagggagaacgcggggaccccagaaaggtcagccttcctgaggatgggcaacccccaggtctgcagctccaggtacatatcacgcgcacagcctggcagcctggccctcctggtgcccactcccgccagcccctgcctcgaggactgatactgcagtgactgccgtcagctccgactgccgctgagaagggttgatcctgcatctgggtttgtttacagcaattcctggactcgggggtattttggtcacagggtggttttggtttagggggtttgtttgttgggttgttttttgttttttggttttttttaatgacaatgaagtgacactttgacatttcctaccttttgaggacttgatccttctccaggaagaaggtgctttctgcttactgacttaggcaatacaccaagggcgagattttatatgcacatttctggatttttttatacggttttcattgacactcttccctcctcccacctgccaccaggcctcaccaaagcccactgccatggggccatctgggccattcagagactggagtgagatttgggtgtggagggggaggcgccaaggtggaggagcttcccactccaggactgttgatgaaagggacagattgaggaggaagtgggctctgaggctgcagggctggaagtccttgcccacttcccactctcctgccccaatctatctagtacttcccaggcaaataggcccctttgaggctcctgagtgccctcagatggtcaaaacccagttttccctctgggagcctaaaccaggctgcatcggaggccaggacccggatcattcactgtgataccctgccctccagagggtgcgctcagagacacgggcaagcatgcctcttcccttccctggagagaaagtgtgtgatttctctcccacctccttccccccaccagacctttgctgggcctaaaggtcttggccatggggacgccctcagtctagggatctggccacagactccctcctgtgaaccaacacagacacccaagcagagcaatcagttagtgaattgaatggaaataaacgctttagttataatatga

SEQ ID NO: 9 - DNA, 47556 bp, Homo sapiens
aacgccagcgcctgcgcactgagggcggcctggtcgtcgtctgcggcggcggcggcggctgaggagcccggctgaggcgccagtacccggcccggtccgcatttcgccttccggcttcggtttccctcggcccagcacgccccggccccgccccagccctcctgatccctcgcagcccggctccggccgcccgcctctgccgccgcaatgatgatgatggcgctgagcaagaccttcgggcagaagcccgtgaagttccagctggaggacgacggcgagttctacatgatcggctccgaggtagcccggggcgcgttctcgccctccccgggctcggccccgcgggagccccggggcgggcccatgcgccgagagcgcgcgtctccattcatcggggcgggcgggcgcgcgcgcgcgcgctcggggctgtggggcgtggcctagtgggcgtgtcgggtgtggcccccgccccctcatcgacctgggatttccttacttatttcgccgaggtccgccgccttcagtgctgccaagattttggcgccgcgaggggccccagtggttccgcgctgggttggtttccagtcagacgcaaagaaacgggatattgagttagcccctgcgacgcttgggggactgcactgctgcctttgaccctttttagatgtcgtaaatttcacgtgcacccctccccgtattgctacttgtgggaacctcaaatggcaggctggaaaccctggacttagtgagggctcatccccattgtgtttgttgcctcttaggtgagcagtggaggtcttttgacctttgtttaccggtgaagaaacagattggaggaagatgtttgcttttgggtgaataagggccccatgcctaagctagatctttcagcagttctgaagcgattgacactttccatatctgtgaactgattctgaattattacaggggaaagagcctaaggatgtttaacccttaactagagtggctgcattttgttgcatcaactggatgactgacttcaggaaaactctactggcctttgaatgggtgtttgttccaagtctattaggttcttgttttttgttttttatagagacagggtctggctatgttgcgcaggcaggtctccaactcctgggctcaagcagtctgcccgtctgggtctcccaaagtgctaggattacaggcatgagccaccacacccggccatatattaggtttttacagattgtctcaaactagccttttttgctccaaaggcagtccccagctagtatatgttacctttttaaaaaaattatggatatacagttcagatgtacaaatgtcaagcagtagaatctcatgtaaggaagtaagtgccaatcctggagaattaaagctatcatgaaatgccaagagtttcttctccttatagcagtttttagtatcatattccagcattttattcgtactttattttcttttatttttgaaaaaagatctcactttgtgcagtggtgtgatctcggctcactgcagccttgacctcctgggctcaagcgatcctcctgcctcagcctcccaagtacctgggactacaggtgtgcaccaccgtgcccgactaatttttgtattttttgtagagacagggttttgccatgttgcccaggctggtcttgaactcctgggctcaagtgatccttgcacctcagcctctcaaagtgctggaatgacaggtgtgagctactgcactcacactcagcgcattcatactttttaaacttgtgggttttatccttcacaattgagcatagcatgaatgaatgaagcctcaagatggtcacactgagtcccatggatgagactaaggtcaatagcatcagaactttagtgttagcattttccaccattttttttttctggacgaggtttgactctatcacccaggctggagtgtagtggtgtaatctcggctcactgcaacctccgcctcccaggctcaagccgtcctcccacctcagtctcccaagtagctgggactacacgcacacaccaccacacccggctaatttttatatttttagtaaagatggggttttaccatattgtccaggctggtcttaaacttgtgagctcaagtgatctgcccgcctcggcctcccaaagtgctcgattataggcgtgagccactgtgcctggcctccactaatttttataaaacaaaaaatataggattcaataaaattttcacgttgtcacttaaattacaactgttcaaagatgccagtgctggggaggtagagccagtgcctgtccatctgccacagttcagaatggtcctcattggccagtaggcacctgcctaactgcagaatgcaaaaggtgtcaaatttcagcctgtgatactaggcgagttgtttacctgatctaatgggtgtaaaagtaatcagtttggctctaagtaggtgacacttcaaaagaaagctttcatttattagttggagcaaattgagaagctgtgcgtggccaagtgggaagaaccttgggaggcctggttccagccctgctctgccttgctgtcgtgtttctcatgtgtataatgtgatgcttagactagatggtctccaagatcttccccaaaacacattttagtttctagaaagctaattacagtcttgtctttcagccccttgactcctgggcctcccagtaagaataatcttcctgagacccaggctgtaagagactcagttggagaggcagtttgttcttttgggcctgacttaatcatcagaccttcggagtttagggaagagttcaaggtcagagctctattgaaattcagtagctccagtgatagtagtggatggacggtctcagcccactgccctgtggaaaacaggcactgtattcagagaggtgggccagccatagcaacatacccagtgcctccatgcgccatctgtggagctgtcttgggaaggcatctgcatttactaagagtgtgtgtcactgttctgccattaacagacagctgtatttaccaagccggagtcatggagctttgaggaccctaacagatccccaagtccagcaccttgattttatattcaggaaacctgggtcccaagagggtgaaggctggttcagaggaaagccaggaaggcaagcccagtttcctaagttctgaaggggctttggggggcatctaggagactcagagccctgcagggcctgcaaggtagtcataggggggagtattgtcaatttcttttaaaaaacctaatggaaactctacatttaccatgatactggatgatactgacacacaagccaaataacatagaggggtctgtgccctctatgtggaaagcgagtgacttgctgtgtctgctcttctctcagcgttcagtagccctggttgttgattacagtcactgctgaaaatggagaaacattttatttaatactatgcctgggtctcacacctataatcctagcactttgggaggcccaggcaggagaatcacttgaacccaggagtttaagaccagcctgggcaacatagtgagactcttgtctctacagatttttatttttattttttttaattaggccgggtatgtggctcacacccgtaatcccagcactttgggaggccgaggtgggcagatcgcttgagcccaggagtttgagaccagcctgggcaacatggtgaaactccgtctctacaaaaaatacaaaaattagccggttgtggtggcaagcaactatagtcccagctactcaggaggctgaggcaggaggatcgcttgagccgaggagttcgaggctgcagtgagctatgatcgatcgcaccactgcaatcgagcctgggtgacagagcgagaccctgtctcaaaaataataataaaaattaaaaataaatttaaaaatgcaaaatatatactatgttgcgtagataaaatgggaaacataatagaagtggtccttcatgggggtgaagttcagagttgctgagcatttggcagatgagtaaagggtacccagaaaatgggaagtgatcccaggttacagatggagccagcacctggcacccagtctattggccatcccctgcaatgtgactccgaagtgatcatacttgaaaagtcaacgagacaatagggtaccctcataaaaactttaggtctagatttattttccttaaggaagtcacactttcagtatttgctacaagcaaactgaagccattgtttgagtcagtgatgatttatatagcagtctggtgattgccttgtaaaccttttggaaaattcctttggtatccctggtttgggttttgttactaaacaaagcaacacaggccatgggggaaattatctggcatctgtctaaaattaaaagacctttttggtgtttattacattgtaaagatatcaaagtcttgtccttaagataaaagaaggtcaaggaggccttgcatttctggaaagtgccagagatccttagtccaaaatcaaaatcaccacgaacttcttgctaagctctgggggcctcccactcaggcatctgcccaggcctttcggaacttggttctgttgtcaggatgcacatatgcaggccagatgtgcactgctggtgaacccttcatatcagcagaatgtgttttaatgctgccgaaagcgtggcgcctgggggccacctcaaggcctgtttgtctgttgcttgatgcagtctgcgccaggaccctccccttccctgtggtgctgcgacccttataatgagccttcttgctttactcataggtgggaaactacctccgtatgttccgaggttctctgtacaagagatacccctcactctggaggcgactagccactgtggaagagaggaagaaaatagttgcatcgtcacatggtaaaaaaacaaaacctaacactaagggtgcgtcttcacgagggtttgtaaacctgtttcaaaaccactcgcttatgtcatgaagataaaacgttttcactccagagtgtcttcactgcagccttggccttagtcgggcagggagcatcccggggtgggccgccctgtgagcactccaggcaaggaagtggctccagggagccattggtggtccactgtcagttatttccagcagggccattgggtatgtgagcgggccggggccaggacactagcaggtgctgtgaagacatgttggtctcaaaacgttttaggaatgctgcgatgctctgccatctgtcgtgggtgtgtcgccataatcatcttccatgcagcccaagtggcgggtggtggtcccagctcccactcccctctggggctttcactgcttgcttcctggagcacatccatcccatagcacttcatcctggcagccagtgtgctagagcccatgtgcatgtccctgctcctggtggcctgcgtgtgcctggggcttgctaggtacactagtgaaactagtgggctttgggtcacggcagctctgtgcagggtgaaagggtgctcttcagacactctgggggctctgtgggagacactcccatggagacatttgggtgtggacacagcatgtccttgggcaggtggcaaaactgcttcccacgtggcaatggcgccttgtagagagctgccctgggcctgggtgtgtctgtgagcatgtgcgcgatgcttcgtagtctgccctgtttgtttgtgtctgtaggtgctgctgtggttttgtccactgcgggaaagtagtggttcttttaatgcaggagccggagcttctttttgatctgctgctatgacatttccactcacttgcttaaaacagtttcctttttgttccccctcctcccctagcagagcatcagtcgctaacacagtgagtccccagctttgcttccccctccgcaagtccctgggctaagtcttgggagataccttccccataagcgattgatttctccaggagaagccagactgggcccacagacaggtagctcttgacggagattccccggaagagctaggggtcgagctgcctagaatctgtcctgcttcccaggcagcacgtgtggaccggctcggggatagaaattcgtgtttggtgtgaagcagctctttccaactctctgggctcttgttttaaaagaaaagtattcttcatcttccattccatctccccaccttgcatcgtgttgtggattgtggtggtgtcagacctcttcccactggggtgttactctgggagctttcttttcccctgagtgaggaccaagagaatatgttctggagtcgagtgtccccgctggtcgtgctgtattgtagttgctggtgctgccctgagcacttccctctgccccgagccagtgctcctggggcagattagtccaaatcagtcccattggaggctctacccagcaggacttgtaagtaaagcactcagtccagattgcccttttggaagaggccagcattcagcagtagtaagtttgacaccttgcttttcccacctcccgcatgcgaggaccttgatgtgctgcatccacttggctggctgctgtgtgccaccgccaccagcagagtgacccagtgatgtttgtctgttacagatcacggatacacgactctagccaccagtgtgaccctgttaaaagcctcggaagtggaagagattctggatggcaacgatgagaagtacaaggctgtgtccatcagcacagagccccccacctacctcaggtaatgcgttcctggccagggcatctctggggacacctgtggggtcttttctgagactcaagaactggttgggttgaagttaaattgaaacactttttttttttttttttgagatggaatcttgttcttgtcgcccaggctggagtgcagtggcacgatcttggctcactgcaacctctgcctcccaggttcaagcgattctcctgcctcaacctcccaagtagctgggattacaggtgcctgccactatacctggctagtttttttttctttgagacagagtttcactcttgttgcccaggatggagtgcaatggcgtgatctcagctcactgcaacttctgcctactgggttcaagtgattctcctgcctcagcctcccagatagctgggattacaggcatgcgccaccacgcccagctaattttgtatttttggtagagacgagtctctccatgttggtcaggctggtctcgaaaccccacctcaggtgatccgcccgccttggcatcccagagtgctgggattacaggcgtgagccaccgcgcccggtcctgatttttgtattgaaacactttttaacagttccctctgtttttatacattttcttagccaggtttctaagtttcttctatatcattggaatttctaagaaacgtaagccaagtcctggattccggagaacagttacaaatgcttggaaagtgggactcgtggggcacagtggcttatgtttgtaatcccagcgctttgggaggccgaggcattgcttgaggccaggagtttaagaccagcctggggcaacacagcaagacctcatttcttaaaaaaacatgtaagtgggaccaatttgtcagaaaaatcagtggctcacataaactcacaaaagaaacaacaatagatttgaatgtataaaaacttagaacctggctgggcacggtggctcacacctgtaatcccagcagtttgggaggccgaggtgggcagatcacctgaggtcaggagttagagagcagcctcatccacatggagaaaccccatctctactaaaaatacaaaattagccaggtgtggtggcacatgcctgtaatcccagctactcgggagcctgaggcaggagaattgcttgaacccgggaggtggagattgcagtgagctgaggttgcacctttgcactccagactgggcaacaagagtgaaactccacctcaaaaaaaacaaaaacaaaacaaaacttagaacctttagaagagtatttatagtaacaattaaaaaaccaagtaattgggaagttacgatgttgtatctagaatctatacatctagatttatacaacaaacttggataccccaacaaataggtaaaagatggtccataccttgaagtacaagggagtaaacaaacatggaaagaatttgccctcatgtgtaatttcaaaaattccaagcataagactgggcatggtagcttatgcctgtaatctcagcactttgggaagtcaaggcaggaggatcgcttgagcccacgatttgactgtgttgcccaggagaccagcctgagcaacatagtgagacgttatctctactgaaagttaaaaaaattagctgagtgtggtgatcacaccactgtcctctagcctaggtaacagaacgacactctttgtctcttaaaaaaaataaaaaacaggccgggcacggtggctcacgcctgtaatcccagcactttgggaggccgaggcgggcggatcacctgaggtcaggagttcgagaccagcctgaccaacatggtgaagcctcatctctgctaaacgtacaaagttagcctcgcatggtggtgcatgcctgtaatcccagctactcaggaaggctgaggcaggagaatcacttggacccgggaggcggaggttgcggtgagccgaggttgcgccattgctctccagcctgggcaacgagagtgaaactccatctcaaaataataaaataaaataaaaaataaataaataaaaaataaaaataaaaattccaagcataaaacaaaaaactggcaacataaggaattggggaaggtgtgatagaactgcactcatgtgtgctggaggtgctttttttttttttttttgagatggagttttcactcttgttgcccaggctggagtacggtggcatgatgtcggctcactgcaacctccgcctcctgggttcaagcgattctcttgcctcagcctctggagtagctgggattactggaatgcaccactatgcctggctaatttttttgtatttttattagagacggggtttcaccattgtgcccaggctggtctcgaactcctgacctcaggtaatcctcccgcctcggcctcccaaagtggtgggattacaggtgtgagccactgtgcccagccgggagtgccctttctgtaaagcatcctgacatcaaacttttttgttctctggcccattaataccgcccctgggaatttgtcccaaagaaacattttcaaagaacaaaatgaatcagtaaacccactatatgtacagagattctctgtagcattgtgaataatactggagaatatggagtcgcttaagtatccagcctttaaggaaaggctaggttagtgacgggtcagccacttgaatggacaaaggtgtgacccatacatggtataattaagtagattctgcagtgacccgagacgggtcctgtgggtgagacgtgcagaatacaagattgtacccatctaccttgtgcattcagctctcaacaaagtatgcatttctctgcacaaagcccaaggagcattaagaaaaaggattattgttcagagtgatgtggttatggaaaatcttttttatgattcccctgaaaggtggcacgcctccaggctggccagtgttacagacgtgtgctttgcagattctttttcccccaagggatgtggtaagaacataaggatggcttggccttcccagggaagttgcagaaggaaattgtgtacatatggagggcactttaattctgcacatgtcagctgggaatcttttatggggcgataaaacagtttcttggtgatcatgtcgtgaggaacagctgcaggagtggaatcccgttgccctggaggtcaagtctttaggggtgggggctggcagaggtttgagggaagtggctttggctggctccacactactcagtcagcccaataaggggacttatggcaccctccccatcctgtcatcggacaatttgagcagaggctgggtgccctctctcagggatgctgggattgcaatggaaggaaggttgtttttctttttttttttttttttgagacggagtctcgctgtcgcccaggctggagtgcagtggcgcaatctcggctcactgcaggctccgccccctggggttcacgccattctcctgcctcagcctcccgagtagctgggactacaggcgcccgccacctcgcccggctaattttttgtgtttttagtagagacggggtttcaccgtgttagccaggatggtcttgatctcctgacctcgtgatccgcccgcctcggcctcccaaagtgctgggattacaggcgtgagccaccgggcctggcctgtttttttttattattattattttttttgagacggagtttcgctctgtcgcccaggctggagtgcagtggcgccatcttggctcactgcaagctccgcctcccaggttcacaccattctcctgcctcagcctcccgagtagctggaactacaggtgtctgtcaccacgcccgtctaattttttttgtatttttagtagagatggagttttattgtgttagccaggatggtctcgatttcctgaccttgtgatccgcccacctcggcctcccaaagtgctgggattacagacatgagccactgcgcctggccttttttttttttttttttttttttttgagatcgagtttcgctctgtcacccaggctggagtgaagtggcgggatctcagctcactgcaacctccccttcccgggttcaagtcattctccttcctcagcctcccaagtagctgggattataggcaccaggcaccacacctagctaatttttcgtagttttagtagagacggggtttcaccatgttggccaggctggtctcgaactcctgacctcaggtgatccgtccgcctcggcctcccaaagtgtcggggttacaggtgtgaaccaccacacctggccagaaggttgaattttatggcttagatttgcagattctgtgtatggctgagcatgttactcacattcactgtgtctagtgacacttgcattgtccacttgagttgatagctagacctggaaatgagaacttgctactgagatagggcaggatgagggggcaggggctcagcccaggctctaacgtatccagtcagaaaagaggaggtggtcaagatctgtggtttgcaaatacaggctcagctacctggaaatcacccgtggaagctgcaaagaacacatcttcttgggcccttcctcagaggtgggaagtcactccacctgggtggggctcaggaatgtgcttcttaaaattttgcattctgggtttgggtgttgtagctcacacctgtactctcagcactttgggaggccaaggtgggaggattgcttgagcccaggagtttgagaccagcctgggcaacatagtgagaccccaccatctctataaaaataaaaaaatttaaaaattgcactctgagcggccaggattaggaactatgacccagataggttgtagaggggacccctgtcttgctgtcccctctcatagtctctgcccaagctgattccatgttccccaaattgggtactacaaaatcctccctacccctaccagcgatcaaggggtagtcccagcctcagcatcagacgtgtaagtgattcccactttagaagggaaaagagttaaagggcccagagtccaggcaggtcttggccattgcttctgccctcccccaccctctggaaaggagaaggacctttgtgctgtcttcccgggtccctccttagagggaactgtcaaacgtttgtcggccgggcgcggtgactgacgcttgtaatcccagcactttgggaggccgaggcgggcggatcacaaggtcaggagatcgagaccatcctggctaacagggtgaaaccccgtctctactaaaaatcaaaaaacttagccgggcgtggtggtgggcgcctgtagtcccagctactcgggaggctgaggcaggagaatggcgtgaacccgggaggcagaccttgcattgagcccagatggcgccactgtactccagcccaggcgacagagcgagactccatctcaaaaaaaaaaaaaaaaaaagtttgtcatgacttgctctgaatggttgaatagttattgtggaagtggttgcgcaggtgttggggttacacagggaagtgacacacagtcgctgcctgctcctgctcacagccttgccagggaaaatggaaaagcacagagcacaacgggcacccaaatgctctcatctgtttcacccagccctggagccttagtttaaaacagcttttggtatttttttttttttttcgagataggatgttgctctctcgcccaggctggagtgcagtggttgatcccggctcactgcaacctccgcctcctgggttcaagtgattctcatgcttcagcctcctgagtagctggattatagacgtgtgccaccacgcctggctaacttttgtatttttggtagggttgaggtttcaccatgttggccaggctggtttcgaactcaccttttggtttttttttttttttttgagatggagtttcgctcttgttgcccaggctggactgcaatggtgtaatctcggctcactgcaacttctgcctcctgggttcaagtgattctcctgcctctgcctcctgagtagctgagattacaggttcctgccatcacacctggctaatttttttttttttttttttttttgagacggagtcttgctctgtctcccactctggagtgcagtggcgcaatgttggctcactgcaagctctgcctcccgggttcacgccattctcctgcctcagcctcctgagtagctgggactgcaggcgcctgccaccacgcccggctaattttttgtatttttagtagagacgggctttcaccatgttggccaggctggtcttgatctcctgacctcgtgatctgcccgcgtcggcctcccaaagtgctgggattacaggcgtgagccaccgcgcccggctacacctggctaattttagtatttttagtagagacagggtttcaccatgttggccaggctggtcttgatctcctgacctcaggtgatccatccgccttggcctcccaaagtgctgggattacaggcgtgagccaccgcacctggcctggtttcgaactcttgacctcaggtggtctgcccatcttgaccttccaaagtgctggagctacaggcatgagccactgcacctggtgcttttggtaaaagcaacctggaatttgggagaaaagatcaaacgcttcatgggacatgggttatttaaattaccttggatgtcacctctggaaggtatttatcaacccatcttctcaacttctactgctgtggaagctgagaggccagaggccttgcctagtccatctcaggatggctggtatgtctaaaatgacagcctgatcatgtctcttccttcaaaaccctggggactcccagccacctgctgagtaaagtcatctcacggagcatgtgagacctgtgatcggtcccctccctggggacctcctccctggactgcccctcagtctctcctccttgctgctgcccgtgcccctccccgcagtgaaccctgactcagtgtctaaggctgtgctctattatccactcctctgggaagtctcccccttgtaccacttccccgcatccaggaagtgcttccgtggagccatgcctggctcatagtgcagtacaccatggccgtgctgtgtctggtgcccctacgtacccttgcccttgcccaggtgcctctagcatctgatgacagcctggggagcaggctcctgcaaagtcaggtgcacagacaactcccatgggagcctcgagcctgacagaggtacagtgggcatccctggagcattagttgattcctggtgggcaggatcaggctcctatactgactgggaggacttttcttgtatctcctcagggaacagaaggccaagaggaacagccagtgggtacccaccctgcccaacagctcccaccacttagatgccgtgccatgctccacaaccatcaacaggaaccgcatgggccgagacaagaagagaaccttccccctttggtgtggatgcatcgctgcactcaccctccgtgctgattccgccttagttctccagcacgtttcagttccttcctccccagaaaaacactctgctttgaccttgtgctccccacaacgccacagtacctcctcgcctttgaactgttgtgtttccctgacttccaggacattgtccatagcctccttggctctgtctgctgtcaccttgccatgtcctcctcacctctctggcccctcaagtggagttactcagggcgcggtccttgggccctttctctgccctcagtttcacatgagtgggccacagccagtctgatggtgcagatgccatccacgtgactcccactgtgccaccatttcccagagcctgctggagtaaaccaccacaaactggtggcttcgagcagagcacatttcttccctcacagttctggggcccaggagcctggatttagtttcactagaccagactcatgtgtggacagggccatgctccctccagaggccatcgaggcgattcggtccttgcttcttccagctttgggggctgccacgttccagtctcagcctctgtggtcacgtggccttctctgcatgaaacttccctgtctctctcttagaaggacacttggcgatgtaatttagggcccttctggttaatctctcaggatctttcacttaatcgtatcttcaaagtctccttttttggccatatgagctgacagtcacaggttttggggattaagttgtagatgtcttcggggtctgttttttacctctgtggcccagacttcctcagctgccctcaccccctcagcctcatgctgcctgaagacctctccatctcggcgcgtggagatccagccctctccttgctcaggctgtaggtttctttcccaaggcctgccttttcctcacacagcaagtccagtctctccaggttctcccctgggactgcctcagacagccccccactgctctccctggggtctctagcagcccctacctcccctccctgctgccttctcagctctgcagctggtgtggcctctgctccaggcagatcatgtcacctctccacgcagaatcctccaggctccccatcaccctcggagcagaagcaggagttctcactggggtgccaggcccaacctggcctggtgctgccaccgctgcactctgccccactcaccctgcctcaggcctgagaacgtcctcattgctgtcagacctcccagagctcctgccctgcagttgcctctgctgaggtttagccccgttctccctcctcccctctttcctttcctccttccttccttccatcattcctccttccctccctcccatcctaccccctcctccttttccttctgtcttccttccctctatctcctcttcccatccctagttgactgtccccttctcccttagagtggccaccccttttctgcagcatccctgcccctttccctgtctgtttcccagcgcattcatgcctggcactcagctcacttttctctgtcttccatctacctcccaaggtcactgggggcctttcgcagccctctccatgctcccagacgcccttaggtgtcctgtgtcctccagctccatttcaccaacctgcctgccggactcttccctctttatcttcccaaagtactccattgcttggaatcctcctgggactccctcagggcagtggccagtttgcatagcctgagggaagaactgtgggtgcttcgacacccgctagctttgcagcatccctgaccactgctcctcacggaatctgtgctctgtggtctgtttgtacgtcctcagcagttcctccattcacctgccttggccttgctagaatatttcctcttctggaaatgcccttctcctttcccatagccttccatgaaagtcctgccaaatttcaggcttaaatatcccttcacaggatgtctgggtgttgttccaacactgcccaggtcgattctattgcagacagactggtgcttgttatttatggccccaactgtccccattagaccgtggccccgggacccctgctagcctcgtctgctgcctcagctgttagctgacaagcggccatcttccccagatgggtttgcagaagcctgctgtgcagagagagaggctgaaaatttgcatacctagggctccggccccctcgctgactgttgcttccatttcactttcagctttgatgaccatgacccagctgtgatccatgagaacgcatctcagcccgaggtgctggtccccatccggctggacatggagatcgatgggcagaagctgcgagacgccttcacctggaacatgaatggtacaaggcagtcgggcttggctgggcctggccccaacccctgtgtgttacgtgggaacagtcccgtttcctgccagctgcctgtcaggcagattctggacctgacacgcaggacatcggggcatagttttggagggtgtgggctctgggttcagtcctggttctgttgctgttcactgtggattgggcctgtgaactttggactctttccccatactgaggttgggtggcccaagaggcctggcatgggaggcggctgatctgcatagcatggatgatgatgacaatgccagtcagacctagttcagcccccgagccctgcacacacctgccttgggtcctgtccaccactctgcttctgctgtgtgaggctgcatgtgtgccccgtgcctctctcctcctctaactggtcatctctagacatcctcactctgtaagtcctgggtcagatgccatctcttctggctcttcctgggcttccaaagcctggacagaactcggtctttgtgcaaatgtagacagaaaggttagaaggatatgcatcccaggtgtctagactgcttatcccatctgggagggtggatcatgcatgcatttattgttttctctatttttaagtctgttagaatgtatttttattattttattttatgattactgtttttttagatcttgttgcataccagttttttttttacttagtgtctgtatcctgctgaatttttataatgaacatactatttatattcagacaaaatgcagtgaatatcatctttattttacttatttttttttttaagagacagagtcccactctgttgcccaggctggagtacagtgatactctcatagctcactgtaatcttgaactgcctgggctcaagcagtcctcctgccacagcctcccaaatagctaggaatacaggtgtgcaccactgtgccaagcgttaccatttttaaatgagtaaatgtttaaaatcatcagaatctcaccacctgaataatgttttcagttttaccttttctgtcaattccacatgcaaacatatttaacatagttgtcactatagagcaagtatcgttttatttttcttcacttatcataagtatctttctggtttctcttttttttgggaggggagatggagtctcactctgtcgcccaggctggagtgcggtggcacgatctcggctcactgcaacctccgcctcctaagttcaagcgattctcgtgcctcagcctcctgagtagctggaactacaggcgcgtgccaccatgcctggctaatttttgtatttttagtagagatagggtttcaccatgttagccaggctggtcttgaactgacctcaggtgatccgcctgccgtggcctctcacactgctgggattacaggcgtgagccactgcacccagcctctttctgatttctttaatcttcaaacaatgcagcattttctcctgggtcaaggcgcctttgtttgctaaaactccccctgctgtagacggctccacagcagataacgtagttgcagcatttttctctcagaagggatttcctaagggaggagagtatgagtggttgttgatatgtggctgccttgagctttctgaaggattaggctgcttcctttggtcatccccaggcgctcagcatggtaggcctgagtgctaggcctaccacttgctcacaccagtgccaggcctgagtccgaaggcctctgctcagccctgagaagaaggcctgagagccatgtgccgggtgcttgtcccgtaggtcccacaggtcagctggtgaggggggacgccagtgggaggagacatgggtgagggaggacactggcaagagactccgggaggttgtattgagtgtagatggggacaggtacagttcactggtcatgccccagaacagggacaggacagcccatggggaccaggccaccagtgctgcacaatgcctgttatctctgccaagctccccgtttatctctgctggcccacatcatagttatttgttaattcttttctctccctctccatttcaaccctttaaggtcaggggccttgtttttcattgccgtttttcttcttttttttgagatggagtttcactcttgttgcccaggctggtgtgcaatggcgtgatctcagctcaccacaacttccgcctcccaggttcaagtgattctcctgcctcagcctcccgagtagctgggattacaggcatgcgccaccatgcctggctaattttgtatttttagtggagacgggatttcaccatattggtcaagctggtctcaaactcctgacctcaggtgatccgcccgccttggcctcccaaagtgctgggattacaggcgtgagccaccgcgcccggctgctgtttctcttaacatagaatctagcccagcataggaacttagtgttccaattggatcagtccatgctctgtctcgttacctttctttgggcaacacatagaaagttctggtttgtttatacccccgccctgttccagaaaggatgcaaggaagcttaccataagtacactgggcccaaatgactaaagcaaatgaaaacggagtggttaggaaaaactggataaagaggaaatgttcaagttgaagagggagctcgtactcagcttttatttggtgaacattgctgggagttgggcgtggctctgggcctttttagaaccaggcagaatgagacgtgaaaatcatttgcatactcagtgtggtcaaggttagcagcagcctgtggctctgaagaagtagaatcacacgtggtcctggaatctgagatttcctacagccctcaggaagagggcacagtatagtaaggaagaccaggatcgtccatgaactccacagtgagtttcactgggctgttcctcctaggagttctaatgtaaaatatgatgcccactgaaagtaatttagaacaaagtcttaaccagtggagaaccaaaatagtgttgttctgcgaactcttcctcagctctgggtggtatttggcatttgtaagagctgtgattcttaattggtggttagatgccatgccaaaattgttactgatttgctttgaaatttcagatcatcttaaaggtgggcatgagagtctttatcacagagggattaaatatgtgaagtagcagtacttgagtagcacgaatgaagtgtatgttcagcccaccttcagaatcaggattggccaggcgtggtggctcacgcctgtaatcccagcactttgggagggtgaggtgggaagatcacttgaggccaggagtttgagaccagcctggccatcatggtgaaaccccctctctactaaaaatataaaaattagtcggatgtggtggcacacctgtggtcccagcaacctgggaggccgaggcacaagaatcgcttgaacctgggaggcagaggttgcagttagctgagattgtggcattgcacttcaacctgggcgacagagtgagactctatctcaaaaaaaaaaaaaaaaaaaaaggaatcaggatttttctcaggtttctggtaggtgttgtgatgagtttgaggttattttctctgaaaaggacttgaagtagtgcttctctgaatcactggtgatgtatggtgtcacctggcttaacagcctgctgagggagggaagtattaaaatcctccagaaaagatgagttgcctaaccagaacacatgtggacatagatgccatcttcacccagaaggggaacaaggggatcccctcaggaagagttttggaatctgtcttggcacacaggcaaaggagtgattagggccctgagtgtctacacttggctacagaaggcaagtttttagagatttatatccacatgcttgttttgggctctaaaaaagttaaatgaggctgagcacagttgctcacgcctgaggctgaggtgggcagatcactttaccccgggagttcaagaccagcctgggtgtcacggtgaaaccccatttctacaaaaattcaccagatgtggtagcacgtgcctgtgatctcagctacttgggaggctgaggtgggaggatagcttgagcccgggaggttgaggcttcagtgagccgtgattgagccactgcactccagcctgggcaacagagtgagaccctgtctcaaaaactttttttttaaagttaaaaaaaaaaatcaaatgatagattcaggaagccaagtgaagcccaacatgattaacccaaagcaatccatgccaagacacatcataattaaacttctggaaactcaacacaaagaaaaaaatcttgagagcaatcagagaaaaaggacaacttacctgtagggaaaagacaataagaatggtggtagatttctttttttttcttttttttttttttgagatggagtcttgctctgtcgcccaggctggagtgcagtggcatgatctcggctcactgcaagctccgcctcctgggttcacgccattctcctgcctcagtctcccgagtagctgggactacaggtgcccaccaccacacccggctaattttttttttttttttttgagacggagtctgtcgctcaggctggagtacagtggtgcgatctcagttcactgcaagctccgcctcccgggttcatgccattctcctgcctcagcctcccgagtagctgggactacaggcgcctaccaccaggcccggctaattttttgtatttttttttttgaaacggagtctctgtcgcccactctggagtgcagtggcgcaatttcggctcactgcaagctccgcctcccaggttcacgccattctcctgcctcagcctcccgagcagctgggactacaggtgcccgccgccatgcccggctaattttttgtattttttagtagagacagggtttcaccgtgttagccaggatggtctcgatctcccgacctcgtgatccgcccacctcggcctcccaaagtgttgggattacaggcgtgagccacggcgcctggccaattttttgtattttttagtagagacggggtttcaccgtgttagccaggatggtctcgatctcctgacctcgtgatctgcccgcctcggcctcccaaagtgctgggattacaggcgtgagccactgcgcccggccaaatgatggtagatttctcatgagaaactggacgctagagcaagtggcaggatatttttcaagtactgaaagaaaagaactgttaatctagaatcctgtacccagtgacagtattgttcaggaatgaacgatattggacattcttttttttttttttttgagacggagtttccgctcttgttgcccaggctggagtgcagttgcacagtctcagctcatcacaacctctacctcccgggttcaagtgattctcctgcctcagcctcctgagtagctgggattacaggcatgtgccaccatacccggttaatttttgtatttttagtagagaggggtttctccatgttggtcaggctggccttgaactcccacctcaggtgatccacccaccctcggcctcctaaagtgctgggattacaggcgtgagccactgtgctcggccaattttttgtattttttagtagagatggggtttcaccgtgttagccaggatggtctcgatctcctgacctcatgatctgcccgccttggcctcccaaagtgctgggattacagacgtgagccaccgcgcccagccaaatgatggtagatttctcgtgagaaactggacgctagagcaagtggcaggatatttttcaagtactgaaagaaaagaactgttaatctagaatcctgtacccagtgacaatattgttcaggaatgaacgatattggacattctttttttttttttttttgagacggagtttctgctcttgttgcccaggctggagtgcaatggcacagtctcagctcaccacaacctctacctcccgggttcaagtgattctcctgcctcagtctcctgagtagctgggattacaggcatgtgccaccatacccggttaatttttgtatttttagtagagaggggtttctccatgttggtcaggctggccttgaactccccacctcaggtgatccgcccacctcggcctcccaaagtgctgggattacaggcgtgagccactgtgctcggccaattttttgtattttttagtagagacggggtttcactgtgttagccaggatggtctcgatctcctgacctcgtgttccgcccgccttggcctcccaaagtgctgggattataggcatgagccaccgcgcccagccgaatgatggtagatttctcatgagaaactggaggctagaagaagtggcatgatatttttcaagtactgaaagaaaagaactattaatctagaatcctgtacccagtgacaatattgttcaggaatgaacgatattggacattcttagtcaagacattcttagatgaaagaaaactaagtgctgggcggggtggctcatgcctgtaatccctgcactttgggaggccgaggcgggcggatcacgaggtcaggaattggaggccagcctgaccaacatggtgaaaccccatctctactaaaaatacaaaaacaattagccgggcgtggtggcgcatgcctataatcccagctacttgggaggctgaggcaggagtatcacttgaacccgggaggcagaggttgcagtgagcagagattgcgccattgcactccagcctgggtgacagagcgagactccaactcaaaaaaaaaaaagaaaaagtaaactatcccctgcagaccttccctaaaagagtggctaaaagaaaggaaatgattgccggcatggtggctcccacctgtaatcccagcactttgggaggccaaggcaggcggatcacaaggtcaggagtttgagaccagcctgaccaatatggtgaaaccccatctctactaaaaatacaaaaacaattagccaggcatggtggcgcacgcctgtagtcccagctactcaggaggctgaggcagaagagtcacttgaacctgggaggcggaggttgcagtgagccgagatcacgccactgcactccagcctgggcaacagagcaagactctgtctcaaaaaaaaaaaaaaaaaaaagaaagaaaggaaaagattaaagaagaaacattgagacatcaggaaggaacaaaagaaagcatgataagaaaaaatgtagataaataaaatagactttcctctcctcttgggtttaacaaattatgtttgacagttgaagcaaaaattgtaacagtatctgatacggttctaaaggtatgtagaaagatttaaggctttaaggctgggcatggtggcttatgcctgtaatcgcggcattttgggaggccgaggcaggcggatcacctgaggtcaggagttcaagaccagcctggctaacatggcaaaaccctgtctctactaaaaatacaaaaattagctgggtgtggtggcgggcgcctgtaatcccagctactcgggaacgggaagctgtggcagggataattgcttgaacccgggaggtggaggttgtgttgagctgagatgacaccattgcactccagcctgggcgacagagcaagactgtgtctcaaaaaaaaaaaaaaaaaagatggataaagataaaacgttaatcaaaggaaagcaggagtgacaatgttagtatcagtaaggcagacttcaaagaaaatgaccagagacagagaaggacattaaataatggtaaaaagataagttcatcaagacatagcaatcctaaatatgtatgcagcaaacgacagagctggaaaatatgtgaaacagtatcagatagaaatcagatagaaccaaaaggagaaataaacaaattcacaatcattggagacctcagcattcctctctcaacaaccgatggaactggatggaaaatcagcaaaacgatgtaagatcaaaaacactatcgaccaacagaatctgattagcatttatagaacactccagcacagccgaatgcacattcttttcaagtgcctgagcaacatataccatataatccgtataatggatcataaaacaagttttaacaaatttaaagaattgaaaccatacagagtgtgttctccaaccacaattgactcaaatacttgtaagctaaataacagacttctaaataatctgtggttcaaagaggaagtctgtagggaaatttaaaaacatacacagacctaaatgaaaatgcagcatatcagaatttgtgggataaagctaaacagtgcaatacagattatctgtagcaccagtgcgtacattggaaaacaggaaaagctttcctcaagtcgataatctaagctctaatctcaagaaccaagagaaacaaaaccaaaggaagcagaaggaaggacatttgaagagcagaaatcaatgacattgaaaacagaaatcaaacaatagagaaaattaatgaaaactagctggttttttgaaaaattaataaaactggcaatctctagcaaggctgacaaaaagaatgtaaattatcaatatcaggaatgaaatgggatgtcaccacagaccctgcagatatcaaaaggaatactgcaaacaattctataagtttgacagcttacacaaaatggattaatttcttgcaaaacacaaagtaccacaactcatccaatgtcaaatagataatttgagttgccctataactattaaggaaacagaatttgtaatttaaaaaccccaaaaaatggccaggcacggtggctcttacctgtaatcccagctctttgggaggctgaggtgggaggattacttgaggccaggagttcaagaccagcctgggctacatagcaggatccaatctctaattaaattttaatataaaacattattttaaaaaaggaaaacaattctcccccccaaaaaaatctctgggcccatatgatttcactggagaattctgtctatcaaatgttgacgaatgagttaacaccaattctacacaatctcttccagaaaatggaagaggagaacgcacttcctgatcaattttataaagctcgtattacctagataccaaacctaaagacagtaccaaaaaaagaaaaatacagaccaatatcctttatgactaaagatgcaaaatccttagcaaaatattgcgaaatagaattcagcaatatatagaaataattatatactgtgaccaagtgggatttattgcagggatggaaggctgggtcaatatttgaagctcaatcaatgtaatccaccatattaacacactaatgaagaaaaatcacaggatcagatcagttgatacagaaaaagcattttgtagaactcaacacctgatgataaaaatgctcagaaaaataatagcaggaaacttcctccatttagtaaagagcatctatttagtacaaaaagtcctgttgctattttttttttttttttttagacggagtattgctctgttgtctaggctggagtgcagtggcatgatctcagctcactgcaaactctgcctcctggattcacaccattctcctgcctcagcctccctgatagctgggactacaggtgccctgccaccacacccagctaactttttgtatttttagtagagacggggtttcacagtgttagccaggaatgtctcgaactcctgaccatgtgatccacccgcctcggcctcccaaagtgctgggattacaggcgtgagccacagagcctggccttctgttgctagcatttaatagtgaaaggttgcatgctttctgccagagaccaggaacaagccaaatatgtctgctgtcactattcttattcaacatagtgttggaagttctagctaatccagtaagctgagaaaaggaaataaaagacgtgtagattggaaaggaagaaataaaatcctatttgcagatgacatgattgtccgtgtagaaaatcccaagggatctacagaaaacttggagaactaataactgaattccccagggtcacaagatacaagggatacaaggtaaacatgcagaaatccattttatttctatatgccattaatgagtacctagacacaaattaaaaatacattaccatttatcatcactcaataaaaaaaggaatacttaggtataaatccaacaaaacatttacaggacttatataccaaaaactataaaacactgacgaaagtaatgaaggaagacctaaataagtagacatatcatattcatggattaaaagactcaagatgatgtcagttttccccaaattgatatacagatttaatgcaatttctgtgaaaatcccagcaagattttttttgtagataagatggttctaagatttatatggaaaggcaaagaaactaaaatagctaaagcaatttatttattattattattatttttttttgagatggagttttgctcttttgcccaggctggagtgcagtggcatgatctctgctcactgtaacctccaccttccggtttcaagcgtttctcctgccttagtctcccgagtaggtgggattacaggtgcccgccaccatgcctggctaatttttgtatttttagtagagacagggtattaccatgttggccaggttggtctcaaactcctgagctcaggcagtccgcctgtctcagcctcccaaagtgctgggattacaggcatgagccaccacacccggccagcaattttgaaaaacagtaaagtgggagtaatcattctacccaatctcaaggcttactatatagctacgataatcaaggctgtgtggtattggtggagtgacataccgtgatggaacagaattgagaatccagaaacagacccacacaaacgtgccctcctgatttttacaaagatgcaaatgtgattcaatggaggaaagacagctcattcaacaaaatggcactggagcaattagacaatcataggcaagtaggctggcacagtggcttacgtctgtaatcctagcacttcgggaggctgaggtgggcagatcacctgagatcacgagttcgagaccagcctgaccaagatggagaaacctcgtctctactaaaaatacacaattagctgggcgtggtggcgcatgcctgtaaccccagctactcgggcgggtgaggcaggagaatcgcttgaacctggaaggcagaggttgctgtgagccgagatcacgctgttgcaatccatcctgggcaacaagagtgaaactctgtcccaaaaaagcaacaacaacaaaaaaggctgggcacagtggctcacgcctgtaatcccagcactttgggaggctgaggtgggcggatcacctgaggtcaggagtttgagaccagcttgaccaacgtggagaaacctcgtctctactaaaaatacaaaattagccgggcatggtggcgcatgcctgtaattccagctacttgggaggctgagtcaggagaattgcttgaacccaggaggccgaggttgctgtgagccaagatcacgccgttgcgctccagcctgggcaacaagagcaaaactccgtctcaaaaaaaaaaaaaaaaggcaaaagacaggaagagaaatttcactaaagaagttatataggtggcaaataaacattgaaaagcttttccacattgttagccttagggaaatgcagattaaaattacactgttattccacatctttaaaaagtggtgacagcatcagatgctggcgaggatgtggaggaactgggtcactcacaagctgctgatgggaatgtaaagtggctggaaaactgccctagaaaacagtgtggcaatttctgttaaaaactaaacatgcggccaggcgtggtggctcacacctgtaatcccagcactttgggaggccgaggcgggcggatcacgaggtcaggagatcgagaccatcctggttaacatggtgaaaccctgtctcttctaaaaatacaaaaaattagctgggcgtggtggtggctgcttgtagtcccagctactcgggaggctgaagcaggagaatggcgtgaacccgggaggcggagcttgcagtgagccgatatagcgccactgcactccatcctgggcgacagagcgagactccgtctcaaaacaaacaaaaaactaaacatgcaaccagtgtaccttgagcatttatcctggagaaatgaagacatgtttatacaatagcctacacgtggatgttcatagcagctttatttataatagcgggaaactggaaatgatctagatagccttcagtgagtgaatagttaaagtgaggccccttcgtaccacagaatgtcacttggcagtaaaaggaagtgacaatctggatgaatcactggatacagatacagtcctctatcttgtcttttttggaggaaactgggcgcagtgtgcatggaatttctctgtgttgtttcttgcatctgtacatgaatctacaattacttaaaaattttaaaatgctctgggcagtgtattcactgggtgtttaccccgtgcacctgaggttcctgctgttgctgccccgcaggctgttaggatgctggtctccagcgtgtctttagggcagggaggagatagtggggctgtggtctgttaggccgacctgcttcttgatgatggaatcctactgtctgctctgaggcaatttttcttggctttttcagcttattcctgcaaggcgtcttgtcagtacggtctgggtggagcagggagagaatgttgactgagaggaccttgctgaggtctggctggccacagatggtccctgtgagctcccatctggtacaattccttttccaggatccgggatctgtagggacctccacgcttgtgaccttgttgaggccctgctgctgctactgcagtcacaggcctggaaatcgctgtggcttggcacagtgtgttttgctcacatgaggcctggtattgggccagcctctgtgccatcacgtctgccaccagttcagcacagaggggagtagagagatggcacgcaagctttgatgtgcctttgctggcctcgcctggatcatctcattagttgggataatctcatgcgcccacccagctatgagtggaatgagggaagtgtttatggccatgaccacccccagggcatggagcaggaggtctgtgcaggatgagggctgggggcctgctagtcatgtgcttcctccttccactcccagtttccaggaaggccacccccagtgccctggttgtcctctcctgcatccggagatgtttggcttcaaagaagaaggggtgagggaggccggtccatgcccaagcatggtgcaatctcttggcatcccttccctctcctgatttcagagaagttgatgacgcctgagatgttttcagaaatcctctgtgacgatctggatttgaacccgctgacgtttgtgccagccatcgcctctgccatcagacagcagatcgagtcctaccccacggacagcatcctggaggaccagtcagaccagcgcgtcatcatcaaggtaggtgacttctcacccagcactggagccttcctggccctcagggtgggtgtcatcatggagcactgagggtacaccaaggcctcagcagaagcccgtctttgggttccatatcatctggaaagtcataacacctggctttgctccctgcaatcccccaggaagggcataggctgagttctcatagtaaagtgttatattccggacacattcagggggtgtctctgaggcactgccaggctctgagcaaagcccggaggtctagaggaggtgaaggcagctgattggctgggccaggctgagtgctccaggggggcctagtaacccaataagatgctgccttagtggccatattacaggtgaagaggtgggcacgtggagagctgagatcacctgcggaagttgcaaactggccagttgagaaatggtgaggctggcgattgggcgcaggcctgcaccctgcagagcctatagcataatccttgctgtgctgagccgccactgccagactatgccttgagggtgaggggagctttgaaaataggaagatatgagaagtaggtgaaattggcacatgtgatgaccctaaaaaggtcagtggtttggttagatctgatgctgtgcctttggcttccattttaggaaaacattgatgtataaaaataagagccatgttacaaagggttcctgaaaatagtctttggggtcgaggagcctcgggagggatgcctcctgtgactgagggatgcctctgccccgtgcaccagatggagcctgggccgacttcttcccactgtggttctccgtggcactttactaagattttggaaaataacgtgggggaatcaccagcaacttcctctgtggtcccccaagtaacaaacaactaaatatcttatttagttagtcaagacagtctcactgtgtcgcccaggctggagtgcagtggctcgatcttgactcattgcaacctccacctcccgggttcaagcaattctcctgtctcagcctcctgagtagctaggattacagttgcccgccactaagccaggctaatttttgtatttttagtagagacagggtttcaccatatttgtcagtctggtctcaaactccttacctcaggtgatccacccacctcagcctcccaaagtgctgggattacaggcatgagccaccgcacctggccgaaatactttgggtgtgtgtgtgtgtgtgtgtgtgtgtgtgtgtgtgtgtcgcagtctcactctgtcgcccaggctggcttgcagtgtgcgatctcagctcactgcaagctccgcctcctgggttcacaccattctcctacctcagcctcccaagtagctgggactacaggcgcttgccaccacgcctggctaattttttgtattttttatagcagagactgggtttcaccgcgttagccaggatggtctcgatctctggacctcgtgatctgcccacctcgacctcccagagtgctgggattacaggcatgagccaccacacctggccaatactttgttttcttgattaatattttaaaattgtggtaacattcataacataaaatttaccattttaaccacttaagtgtaaattcagtggcagtatattcacatccatggctgtgtaattatcaccaccatccatctccagaattctatcatcatgtaaaactgaaactgtccatcaaacactaactccccattccccctccccccacccctggcaagcaccattctgctttctgtctctatgaatttgactactcgaggtgtctcatttacattcctaagggaatcatgcagtatttgtccttttgtgactggcttatttcacttagcagaatgtcttcaaggttcatttatgttgcaccatgtcagaatttccttccctttttaaaatgtatttatttttagacagggtcttactctgttgcccaggctggagtgcagtggcgcagttatggctcactgcaacctctgcttcctgggctcaagtgatccacccggtgcagcctcctgagtagctgggaagctaggactaccggcacactccaccacacccgactgattttttgtattttttttgtagagatggggtttcgccatgttgcccaggctggtctcaaactcctgggctcaagccatctgcccacctgagcctcccaaagtgctgggattacaggcgtgagccactgcgcccagcctcctttcttattaaggctaaataatattctgttgtatggatctatcacatttttatttattcatccctaaatggacagacacttgggttgcttccacattttggctattgtgaataatgctgctatgaacctgggtgtgcaggtatctgttggtgtccctgttttcatttattcattcattcattcattcattcatttagatggagtctcactctgttgctcaggctggagtgcagtggcgcgatcttggctcatggcactcctgcctcccaggttcaagcaatctcctgcttcagcttcctgagtagctgggattactggcacccaccaccatgcccagctaatttttttggatttttaatagagaccgggtttcaccatgttggccagcctggtctcaaactccgcctcagcctcccaaactcaaatgatctgcccacctcggcctcctaaagtgctgggattataggtgtgagcccctgtgtctggcccctgctttcatttcttttgggtgtatacctagaaatggaattcctggatcgtacagtaattccatgtttagttttttgaggatccactatactgcctttctcggtggctgcaccttttatattcctaccagcaaggcgcaggggttccagtttctccacatcctcactcacacttgttagtttttcttttcttttctttttctagacagagtctcgctctgttacccaggctggagtgcagtggcatgatcttggctcactgcaacttccacctcctggattcaagcgattttcctgcttcagcctctcgaggaggagctgggactacaggcgcatgccaccacgcccggctaaattttgtacttttagtagagacggggtctcatcatattgaccaggctggtctcgaactcccgaccacaggtgatccacctgccttggcctcccaaaggattatagacgtgagccactgtgcccggccagtttgccagcatttttttgaggatttttgcatcaacattcataaggggtgtaggtctgtagttttcctttcttgtagtattttttgtctgacttaggtatcagggcaatgagttaaagaatagtttgagaaggattggtgttagctcctatttaaatgtttggtagatggccgggtgcagtggctcacgcctgtaatcccagcactttgggagaccgaggcgggcggatcacctgaggtcgggagttagagactacctgaccaacatggtgaaaccccgtctctactaaaaatacaaaaattagccgggtatggtggcacacacctgtaatcccagctactcaggaggctgaggcaagagaattgcttgagcccgggaggcggaggttgcagtgagccgagatggtgccactgcagtccagcctggctgacagcgagactctgactcagtcagtcaatcagtgtttggtagaattcaccaatgaagccatcaggtctaaggcttttctttgtcaggaagattttattattgattcagtctctttacttgttaatacctttttgagaggaatacaaatttgtttcagtttcacattatggccagctaggaggaaaagaagggacaatggtaggagagaagtggggtggggatgggagtggcagcaagcacctggcctgtgtcctgcatacggtctgctggctctggagggcagccctgagggctccactctgtgcttctctttgtcttgtaaacatgtggaggatgaggctgtgtgggctaacccacccagccacgtggttccaaatgactgggattggccacacaaggggcctcatgaagcctgactggtagcttcccttaacgtttttctcagaattgagcccattttcattgttgttgtcttgacggggcctgcagaggagccatacaggaagttgcccagcagctgtaatcctcctggggctgttccctgccccaccagaagaggcttccccagtgaccctctgacttacctgtgattcccacctgggggatggtggcagctggcaggttgagagactgtccccagccaggtgtcctgctctgccctttgggtcagaccagatgtcacagggtggacacagctggcccagggaagcctgtgttatgtgggacagactgcatttttcaggccagaggcctcctgggcaccgtgaccctgggaacagtgtcctgtcttgcccatgaggaatagaaggtcacacccagggtttcccatctataattgggactcagaagagctgggtatttctttcttccttccttttttttcatggctcactgcagccttgacctcctgggttcaagttatcctgccatcttggcctcctgagtagttggaactataagcacgtaccaccatgcctggctaatttttaaattttctgtaggaaatggagtctcggctgggcaccgtggctcatgcctgtaatcctaagactttggagagctgaggtgggcagattgcctgagctcaggagttcgagacaagcctgggcaacatggtgaaaccctgtctctactaaaaatataaaaaattagctgggcgtggtggcacgttcctgtaatcccagctactctggaggctgaggcatgagaattgcttgaacctgggaggcggaggttgcagtgagccaagattgcgccactacactccagcctgggcaacaggctcttcccatctcactgactctgtctcaaaaaaaaaaaaaagaaaaaagagaaaatggagtctcactttgttgtccaggctggtctcgaactcctgggctcaagcaactcttccaccttggcctcccaaactgctgggattacagacatgaaccactgtgcctggccagagctgggtgtttctgtaaggacgtcctttgtcttgatcctggaacatgactgaaggaaaacaagaatctttggagccatggcacatgaggaccatctctctcctcagaaagagtgccttaggttagagcagcatcttccagatattcttggcaatgctgggaccaaagcccaggcctggctgcccttgccagggcacctggcccaagtcggctttgcccagttccagcaggggttggggggcaggggaggaagctggggacatggtgctgctgcagtttgagccatcagaccctgtggcactgtccaggccccgtccagagagtgcatggggtgagatgtgagtcagggctggggaggtgggcaggggcctggccctgctgtgcacctgcttgggagtcctggccccgtcttagctctgtgagtccacctggagtccagcactcctcactaccccaccaaggccactgccagatggctcccttcctccctccccgccttccagtagaggtctcagcatggcagctcagcccatgtctcttgtctgcccaaaataccgcagaagcttcccacatccctctgtggaagccaagcctgtccaaaggcctcagggccctaactgctctctgctacagtccctcgccaccctcatctcctcccttttcccctcactgggcagatccgggtaccagaccttggctcctcagtcttttacatctctgtgtcccccacctgggactgttctcccccagggagccacattcctgctccctgggcacattcacttcttcctaaaggccaccttcctagaagccttcctggcctcctgacttctgaggccagcctggactttctccccctccctccctttcctccctggcactcccgtgctttctggtacaccacatgctcacttaacctacttagtgtctgtcagtgcccccaccagcatagctttttttttttttttttttttttttttttttttttttttttgacacagagtctcgctgtgttgcccaggctggactcaaacacctgagctccagtgatcttcccacctcagcctcccaagtaactgagactacagacatgtaccacctcacctttctcagaacagccttttgaatgtttgtctctcttgtgcctctccttggtagacacacagtctagactttggaataaatgaatgtgttagtgactgaatggcaggggacaggcaactccatccatgagcccagggcagggagggcttgctgggtgggagccatgtgcctatggtcctatggggtcctgttgggtggttccatgggctgtctgctgctgcacgttctttttggacccagcacccacgtggtttgcttggcattagattccagttgggaagggccagtgcctccgattccattcatcatcaggcgtgggcgtatgtggagatagcaaaggacatgggggcccgactgcagtccccattgcctggctgcatgccgtgtacaggacactgcagctctgccctcggcttcctccctctgcgtgaggattccttcattcccagaacaaatacaccctgcctgtgctagaattcctggaggcaaatgattcagattgtttcagacagtcctaagtgctgtgaagaaaataggagaggtgccagcatggtggcccgcacgtatagtcgcagctactcaggagactctcgggggaggatcttttgaggccagcctgggccaacacagagaggcagcagggaagcctgcggggaacagaaggctcaaccacagggtctcttctctgcccaaaacacttgatacattgcctgggccttgtagaaaccttgtctctacaaaatattagccagacatggtagtgcatgtccgtagttccagctactcaggaggctgaggcagaagggtctcttgagcccaggagttcaaggctgtagtgagtcatgatcatgccattgcactccagcctgagtgacagagtgacatcctgtctccaaagggggagaaaatggagagaagggtgtggaaaggggctgatgggaaggggagctctcaggagctggcactttagcttagaccaggatgctgagaagaggctggtcctgccaggtgaggggaagagcattctagcaagtgggtggtgatgtgcagggctcagaggcacagggctttatgaacatgatcggggattggggtaccctaatctctaaaaggaggcagaagtccccggaagggctggactccgaggcagtggtgagttttccctgcagctgcccaccctgatccttgacttaaaagctaagggccaacaatgaatgggcaggtgcactgtgacctggttgccctgtggagcactggatagcagtgagggatgaccccagccccacactctaatgggaggagtcttgcaagcatgatgcagagtgaatgaacctggaccccgaagtgtccatcctattcagaacagccacacctactcaaggggtgagaagtcaaaatggtgcctccccaggggggcaggtgtaggtgggagcccctggggtacagtctgtgttctctcagctgggtgctggcttcccaggtgtccactagtggaaaacccctgacagcacacccggggcctgggccctctggctgtgagtcacgtgctgcagggagtcctctggggaatgtggaggagctggcccagcactgtgatccctgcaggcttccctgtcccctcaccgtgttgacccagagtggggtgcatctgtgaacacgctaggcagggttttccgagaggggcaagctctgtaaagggcatagacattggctcaagacagggcttagggatgccttagctgagccctgcctttctggtgtagtcacgtaagaccgatggcagcaggagcgaagggcagaaaggaaggtccccaccagcacagggcacaggggagatgggatgaaggtaaggtgggactcaggtgcccccggggtcacttcagggcctcccgagggtgactgtgctgggccctgagccagagcccctcatggcagacagggttgtggggtcagccttgttttggggatggggaactggaaggacaaggaccacctgcagttctcagctggtggaccctggtgggcagggcccaccccaggcctggcagggccccgctcctcgcggcctccctgggctgcaaaagctctaacttgtgtcctttggttgttgcctcagctgaacatccatgtgggaaacatttccctggtggaccagtttgagtgggacatgtcagagaaggagaactcaccagagaagtttgccctgaagctgtgctcggagctggggttgggcggggagtttgtcaccaccatcgcatacagcatccggggacagctgagctggcatcagaagacctacgccttcaggtaggatcatgcatgagtctctccctccctcatctccctgcaaaactgttttgagaaagacttctctgtgtgagcggtgatacctttgaggctttctcacgcttcgcagcacaatctggctggggtctgtgtgtttgctccgtcctcctcctgccctatgtatctctccagggctccgctgtgccaggtagggttagaagcacctaacacaatagctggcaaagacttggagttctgtcagggtgaacctcaagtccttgcctccacggagccctggcctgcccccaccatccaccattcagttgtcctgccccacaccctctctctctgctcttgcccagactgttattttggtcagggtgacccctgcccagggttcttcatctgttgaacttgaattatgtcttaaacacaaaggcccgcccagcttttgagagtcaggggtccctagcagctccttcttactctagtatctctgcctttggtcagtcagagagcatttgatgagtaccatgctgggctggaccccatcctggctgccctggaagatagagacaggtcaccttgatccctgcctgtagcatttgggctggctgagatggtggaagtgtgaacagaatattccagtccagtgtcctctgtggtagggatggggatggacccgggagaggccctcctgttcctggcaggaggtgggactcagagttaaaagtgaggtcaaggcccagtgcgatggctcacacctgcagtcctagcacttcgcggagctgaggtggatcaccagaacccagtagttcaagaccagcctgggaaaaacatggtgagaccccacctctacaaaaaaaaaaaaatagaaaaaatgagccgggcatgttggtacatgcctgtagtttcagctactcaggaagctgaggtgggaggatcgcctgagctcaagaggtggaggctgcagtgagccaagatcacaccactgcactccagcctgggtgacagagcgagaccctgtctccaaaaaaaaaaaaaaaaatagcgaggttgaactctcccggctcagcaggactctaggactgggaagccccgtggttcctcaccctgtcctctgtgttgggatggggtgggggtgcagcaagcatccctacatcaaaacaggatgttcagatttagtctgctcatcagactatcatcatccacatctgcagtcatcactcagggatgacagcttaaaatgctacatgaggagcaaataggaaggtctgttttgcaaagccatgacaattaatggagctcgttaggtttgtgtctaacttgttttcccagacatcccaagagacagctttctatgacttcccataaatctgagcaaggaagaaggaatgagagccacccacggggctcaagggcccgggcctgggaaacagctgagtccctgcctgagcgccatggtgctgagatcctgtgacctgccccccagcagccctgccagtcacatggttctgcttcacagacagggcagcccagagaggaggctggggggctggtgtctgatgcctccctgttccctcggggtgttgcctgggagtgcagctgtagcgtgcattcaccctgcacagagccaagccctatggccggagagccagtcaagggtggcctccctccaccagagttgactctgaggccccgggaggcagtcatgttgcgcgcatcaacactgagcacctcctcccgcagaggctgatccagtcagaaccctcgtcttgggctcacaggtgcaggtggtaggctggctgcccccagcatccagcccctacggtgttgaccttcacctagtcctgcagccgctgccagtgcccacagtccagggtcaggaactgaagtccccggggcctcttgacaggtccttgcaacatcccttctttcagccaccatggcaccatccctcctgctctgacccgaaggtgacctgagcctaaattcctttccaagttccgggccctctgcagtttgcagagtggctccagagcagaccccctggggagtccctggtggtggcaggtcaggatttagaggcagaggcgggccccttctttatctcatcgaccacttagtgcattccagttgcagggcctgggggcatcacagaccccctgccccctgctctctcttatgctgagaatgcaggtttcaaatctttggggttaaaggcaaaggccatcccgctgggaccaaggtgagcacacgtccctatcacagcagccagatggagaggcggcctgcctggggaactgggaagtgtcctgagtgggcttttagcatcaggagggctgcgtgtgtcttcccagtccccacactggaagacagctgcaaggataggacagggccttagggttgggctgtcatccctgactccaactcgcgttccccccactgtaccaccccaccccatgggatcttaggagggacttcgtttaactctgtccccagggagaccagtgtcagtcctgcctggccctgcctggggaaaggaggctgggccactgagtccccaggtccaggggccagtcagcccacagagagctagaccaggagtcctggcctggtctctgccacacagaaagcttggcaactgctgtgtcacatgactttttgttttgttttgagatggggtctcgctctgtcgcccaggctggagtgcagtggcgtgatctcggctcactgcaagctctgcctcctgggttcacgccattctcctgcctcaggctcctgagtagatgggactacaggtgcccgccaccacgcccagctaatttttgtgtttttagtagagacggggtttcaccgtattagctaggatggtctggatctcctgaccttgtgatccacccatctcggcctcccaaagtgctgggattacaggcgtgagccaccgcgctcggccacatgacttcttaagaagggttttcaggctaggcatggtggctcacgcctgtaatcccagcactttgggaggccgaggtgggcggatcacctgaggtcaggagttagagacaggccaacatggcaaaaccccgtctctactagaagtagaaaaattagccaggtgtggtggtgggcacccgtaatcccagctactcgggaggctgaggcaggagaattgcttgaacccgtgaggcggagattgcagtgagctgagattgcaccattgtgctccagcccgacagagctagactccatctcaaaaaaaagggttttcagctctggacctaggtcactccataatggaagcactcgctgattccccaagagccagtccctccatctctcccagccagagctcagtgcctgacttccataccctcctcggcagtggggacattgattggatccatggtacagtggggcaagctgctggccacaggacatgtgtgtgcaaggccactatgcccacacctcaggggaaccagggcagagaacagcctgttccctttggcagtgggacagacaggagacaagcatgaaggggaaacaggggcatgtgacaaactggtcagaagccctaggctcctagaggacagactgggaccagagtgacacaggcgtcccagagccagtggagtgggatgaagggccagcgaaaggagggagacagggctcaaggggaaggaggctgggctaggcagagcctctgaggagagctgatcctgcaaagttactggcacctcccctgggccagccctgtgttcctggccagggacgggaggagacagtgccctgtctggcagaggaaacagattcatgtgcatgactatcagtgtgccatggccacagaaagcaccggaggctgtgggcatgaggaagggcagttgggggcatagaacctggggtgaggatggccagggcaggtgctgatgggggactgcagcaggaaggaccgagaggagaccagggacaggcaggtgcttgagaaggaaggtgggccctgtggatcaggcagggtatctgccccagggggctctgcacaccagcagtcctacacgtacagggtggggatgaaaagagactaagggtcagggagcttggtagctgggcctgcatgagggacagagaggcagtgtccctctgatggcacagcatcaggaattaggctggggtatgtcaggtacacgttgggctggttgagcgtaagcctcaggttccttccgaagctctgcccgccagccctggcctgatgtcaggttttgtttgtttttttaacagctttattgtgatataattcataaaccatacaattcacacatttagagtatatagtgcagcggtttttgatatatgcagagagctgtgtaactatcaccactgtcaattttaggactttttcatcaccccactgcaggcagtcccgttcctccccgctgtctctcagccctaggtgtccactcatccactttctatctgtagatttgcctattccgggtacttcatagaaatggaaccatctaatatgtggtcttttatgactggcttgttagcataatgttttcaaggattatccatgttgtagcatcttttatcaggacttcattcttttttatgattgaatattatctcattgcatggatataccacattttattcattcatcagcagattgacttttgggttgtttccatttttcagctattgtgagtactgctgctgagaacatttgtgtatgagtttttgtgtgaacatctgttttcaattttcttggatatatacccaggagtagaattgctgggtcacgtgacaactcagtggttagcattttgaagaatttctagactgttttccaaagtggctgcaccattttgcattcccaccagaagcgtgcgattcccgtttctctggatcctgctggcatttgctgttctctttttgatcgtagccgtctgaggaggtgtgaagtaattgtggttttgatttgcatttttctaatgactgatgatattgagcatctttgcatgtatttctggctgtttgtgtatcttctttggagaaagtgctttgctagtttcttaattgggttttattttattgttgagttgtaattgttctttatatattctacatagaagtccctcatcagatagatacatgatttgaagatattttctctcatttggaggattgccttttcactttcttgatagtgttctttgaagcacaaaagttttcattttgatgtagtccaatttatctttttttttttttttttttttttttttttttttgagacagtctcgctgtgtcaccaggctggagtgtagtgctgtgatcttggctcactgcatcctccgcctcctgagttcaagtgattctcctacctcagcctcccaagtagctgggactacaggcacctgccaccacacccagctaattttttgtttttagtagagacggggtttcaccatgttggccaggatggtctccatctcttgacctcataatccgcccgcctcggcctcccaaagtgctgggattacaggtgtgagccactgcaccaggcctgtaatttatatattgttttagtttgttgctagtgcttttggtttcatatctaagaatccattgtcaatccagagtcatgttgccccagcaccatgttgaaaactgctcttcctccattgagtggacttggcacccttctaaaaatcatttgaggctcctggcggcctcggaggtgtgaattgcaaacataagggtgacaccaagttttggcatctccccttcctggtcgagtggctgtggacaggtcattttcccttgaagtctgtattttgtcatttgtaacttggggataatacttgtgtgttgcatcacatgaggtcatgaaagtgagatcacattgaaagtaaacctcaagatactcgaccggcatcagtcctggctccctctgtccctcagacgtgagcatcccctgcctgggtatctttgtccccacctggacactttgggtggtaggaaggtctggggtccctggcggcttcgaagcccgtgaaccagaattccctggaaggaatggggagcagggtggctcccagggtccccagcactctttggaactcaggacagcatctccatgcccacatgcccccaaaacccaaggcaggctagtgctggctctaggcccgttcttacatggttggtgcgagcatttcttactttagaacaaacccactggagtggaatattcccagcatcaaggggaggtaaacaaaggaccctctgggacccactcgccagctcttgtttaagaggaaaacatgttttgctcccctcgttgtgggcttggtacctttcacgtctgccctccaaggaaggctgctgggagccctcacggtgaggaatgatgtttggggtctgaggctagggtggtccctagactgctaaaccacccggtgctggccagggaccagctgtcaggagctgctgaggatgggtcagccccagagggtgggggtgccgacattgcctctggccctgcctctgcgtcaccagtacgagcttgagcttctgcgactcatgagcatggacctggtgggctgagcttcagctgtgaggggtcaggcctgctgcagggagagccagctgcagccagtgccctgcgctgtgcccacagtccctgagaccccaggctgaggagagcagcactgagcccaacctggaacgggctcacggctactggagctgggtgtgtgctcactggtgtggatgtgcagagccgggactcgctctgcaagcaggctggtcccacaaccttgagccacccactacagggaggctgtgagaaggtccctggcccctaggaagctccctcagtggagatgttttggctgctttaataacagtcatccttccaaagcccttcacagcaataaatgtttccatattccagatgaggtttgcagggacctgtcctctctatcagtgtccacctggcgcctcccccgagtccggcctgcccttgcttctcccagagctcatggtgtttttcagggccgcaggctggcagggtgtccttctcccaggggactgagcctagggagagccaagtggaggtgcccaagtggaggagaaaggaaaggaccacagagaggggaggggaagtgggagagtcatggttaggacctcaggctgaggccttctgccaagccaggggtctggtgtcactcaactgggaaacactgtcagcacccaaagctgctctcagaggtgggggtgacgggaccactgcatgtgggaggcacacgggccctgtggcatccacagctgtggtctccttagtgtcctgtcacagacttgcaaatcaaagcccagagaggcggcagccagccaccctcccacctccccagcactcctgtgcccaccccatgcctgtttagcctctgcccttgctgcccccttcctctgctgtgtccttttggcaagaggaaggtacctcggggcagatttgggtggtccttgtgagacccagggcagagtgtggtccggggatacggcttctgtccagctccctgccagacagctgtctgatcctaagcacagaccagcctctcgggggttttgttcggccaggaggtgggctgaggggcaagtgtgtggaacatgcaggaacaggctgtgcagtggccctcagtagtggggggctggggacttctgggagactcctttgctcccattcgccatccatcccctttccctgatcagtgggccctggctctggacactgagtggagcagacagtcctcctgcccctataggttccacctcctgactggcactgtggcatcagcatggtccagcccgtgctgtcctgtcaaggaccacctccacagccagtggccccttcctccatctcagagacagagagacgctgggcacaaaagccctgttgaaagttcactttgaagggaagcccatggggtcatggcgacaacacttgttatggaaaggccctggcgcctccagcagctcccttgaggttcaggtgactggagcatccactgggtgccagcagtgctgctgggaggagcagggcacagacaggggccaaagctttctgaggattctccatctatagctggaaaagtcattcctctcactgcctcccctcctcgtagcgagaaccctctgcccacagtggagattgccatccggaacacgggcgatgcggaccagtggtgcccactgctggagactctgacagacgctgagatggagaagaagatccgcgaccaggacaggaacacgaggtacccctggccctgtggtcctgggctctgcccacaggcacctggctttccaggcagaggcagggccattgcctttcccagtctcccatggtctctgagacagagtacctctagtgctgctagaggcaggcaggcttctgggtgataaggccccatccaaacgccagggtatgtttccctgcatggaacaaacataattcctcaggctgagggtctgaccacagcccagatccaggttttggggtccctggagtgatgagcagggcctgagtggcagacaggcgaggctgagagaaggctgggtctgaccctgctgggggcccacatcctgcctctgttcccacccctacacttggctgccctgtagagccttgggaagggcagcgcccaggctgggagctggccccgactcattgccctccccactcctcttccaggcggatgaggcgtcttgccaacacggccccggcctggtaaccagcccatcagcacacggctcccacggagcatctcagaagattgggccgcctctcctccatcttctggcaaggacagaggcgaggggacagcccagcgccatcctgaggatcgggtgggggtggagtgggggcttccaggtggcccttcccggcacacattccatttgttgagccccagtcctgccccccaccccaccctccctacccctccccagtctctggggtcaggaagaaaccttattttaggttgtgttttgtttttgtataggagccccaggcagggctagtaacagtttttaaataaaaggcaacaggtcatgttcaatttcttcaaca

SEQ ID NO: 10 - DNA, 65025 bp, Homo sapiens
ggtcccgcccgccgcgctgccgctgagcgcatgggcccggaccgcgccgcgccgctccgggagccgggcccggggtcccgccaccaccgcgcgcgggtgagtagggccgggctccggggcgggctaggccgcggtaggccgggcgggcgggacccggaagcggcggggggcgcgggtggctgacgcgcgtgggaccgagggggtgggcgcgcggggagctggggccggggtgtccctgggcagcgggactggcggcgcggtggccgcttggaggtccgaggcctcgggcgcgtctcggggcacggagcagctgcaggggccgcgcatcgcgtgcgggggcccgggagagccgggcctggagccctccccgccgcccagaagtcggcgggagtccggctgtcccggaggaggacactcccgcccgccctcgccgaggccgcgtgccgggtccgggtcggggttcggcctgagtagccgcgtgctccggcgtccgtaccctccaggttgatgccttgctgcccaaacactggtctttctcttgggtgtggttcttagattctacccccgccccgcactttggaatttagcccccgtgaaaccagagctgcactgcccgagcagtgaaactttcagcttggcattgaagaaagtagagaaaaacatgtcagttctctggggatttttctcagcccatctataagatatatatatatatattttttgtagagatggggtgtcactatattgcccagcaggtgttgaattcttggcctcaagcgatccacctgcctcagccttccaaggtgttgggactacaggggtgaccaccgtcctctaagataattttttttttttgagacggagtctcgcactgtagcccaggctggagtgcagtggcgctatcttggctcactgcaacctccgcctcccgggttcaagcagttttcctgcctcagccgcctgagtagctgggataacaggcatgcgccaccacatccggctaatttttgtatttttagtagagacagggtttcaccatgttgaccaggctggcctggaactcctgacctcaggtgatctgcccactttggcctaccaaagtgttgggattacaggcgtgagccaccgcgcctggccccttctaagataatttataaagggttcttatgtgcatgtcagccccttgtttttgctcacacttctgttctctgcttcttcaggaagaatctcgagcttacttggatccacaggccctattttggagaaaacacagtctaaaccggctacccgagatactcagcaatagctcggtttcagtttttttttttttttgagacagagttttgctcttgttgcccaggctggagtccaatggcgtgatctccgctcaccgcatcctccgcctcccaggttcaagcgattctcctgcctcagccttcccaagtagctgggattataggcatgcgccaccaagcctgactaattttgtatttttagtagagatggggtttctgtatgtgggtcaggatggtcttgaactcccgacctcaggtgatccgcccacctcggcctcccaaagtgctgggattacaggcgtgagccacctcacctggctttggtttcagttttaagatctccattcagggacaaggatgggaaagcatgaaaaacagactgtttttgtttgattttcagctggtgttgacttgtcttgggtttctagtttcagaaaagctaagcagactttttcggattacattggtcattgagaatttcagtgatgggggaataaattacatgtgaaatagtagccctgaaccttcaagagttaaatcaatggacagctgggaagatgtcagagtcgtgttgtgttacttgcctcctccatgtaaatcaaaatgtcaaaagttacgtttgggtaaaataaatacctacacacgtaggtagcattgagtttgctgccatgatgcctggagcatatgcctaagcggtgacgaaagggaattttaaatacagtatcatacttgtaggcatcccgcccgttttatggactcactttattgatggtagctacaggctgtgggccagattcagtgcttgcaggcatttgatactgaactgagtaaacgtgactgctttatgtgtggtgtgtacttgtgtgtacactaaatgcttggtgtgcttccctgtgggaacccagagatttcaggaattgggacatgtttcaacaacatcagtagcttgtagaggggttcatgtgcttccagggacaccaaaaagtcttctgtcagttgacagccaaaaatacacatgattgtaagaaaattttcttctgggctctgaaaatttggttcacacatgaattaaaacattagttttggggccaggcaaagtggcctgtaatcccaacactttgggaggccgaggcgggtggattgctttgagctcaggagtttgagaccagcctggccaacgtggtgaaacccaaaatacagtaattagccgggcgttgatgactcgtgcctgtagtccccgccacttgagaggctgaggctggagaattgcttgagcctgggaagctgaggctgcagtgagctgagatcgccccactgcagtccagcctaggcgacagagcgagaccctgtctcaaaataacaaaaaacaaaacaacaaaacccattagttttggaagaatttgctgctgttttctgtggtacagtagttcagcccctgtagagagccagtgtttggcgtctgtgacaaatgtcttttcttttttacatcagtgaatgacttactggtgcccgttagttgcaggaccttgtgctgggtgctgtgggtcccgctactaccaataattaacacagaagacttaagtcccttatgagagcatgatggtgacttgtggttagcctcccttctgagcactgtctgattaatcactttccactctccggtgacttggttcttcaagctagtgaatggtagtacatctatagtggtaaggctcaggtggtcagggtgcaggccttctttcctgtgatggcgtcccagacagatgaccgtgagctagtgtggaggtgcccacgcccagggtgctccctccatgctgatgtggctcacggagtgactgccgctgaagtggtctgtgagcagcaggatgtcacagctcactgggccttgacctttagaagctgtgtgttcctgctgaggccaagatgacatactacccagcagcgttcacaaaaagtccttagctgctgaaatgtcattgggggcacatagttgcaaaccatcctccatctatgggtgcttcttatttatttactaattttattttattttattttattttatttttttgagacagagtctcactctgtcgcccaagctggagtgcagtggccggcgcggtgtcggctcactgcaagctctgcctcccgggttcatgccattctcccacgtcagtctcccgagtagctgggactgcaggtgcccaccaccatgcctggctaattttttgtatttttagtagagatggggtttcaccgtgttagccaggatggtctcgatctcttgacctcgtgatccgcccgccttggcttcccaaagtgctgggattacaggtgtgagccactgtgcccggcctattttttttttagagacaggatcttgctctgttgcccaggctggagtgcagtggggtgcgattatagctcactgcagccttgaactcctgggtcaagtgatcctcttgcctcagtcttccaagtagctgagactacaggcatacgctaccatacccggctaattaagaactgttttttggtagagattgggtctcactatgttgcccaggttagtcttgaactcttgggctcaagggatcctccagcctcagcctcctgagtagctgggactacaggtgcgtgacaccacgcctggctctgtggatccttcgtgcttccagccgtgagcagctgttggctggtaaagtgtgtgcaatgtgaggaagttggtgtgggggacagattccacatagacaagggacagcagtgtggagtggtggctgggggatagatcccccttcagttggtcctgggttttagggttttatttgtttgctgtgacttgttcagcactctaggcttttgaacccaacatgcttctctaaagccctctctccagccccttttagccaggaccacttacatcatggcaggctgttgtttcagtcacctgcatggccgggttgacaggcatagccagagctcctgggctcctgtaggacgtggcaggaaggaccatagaccatggcaggggttctgttggagcccttatctactctcttttgcacaccccttgcaggcttgtagcagcagcagcagtagtagcagcaaattctatagttccctgatgtctaagagggtgggtggtttggttttcagcttaaggagtgaagtcacatgaactatagcttccttagctaaaaattgtatttgcatttccttttattctgtaccttctctgttccttgaagtacccatttactatttgctatctgaatcctcatcagagaggcttttcagagtcaagtgcagcattctgacagagcattttaagattgtctccagtgacggtgtccgagcgcctctgtgggcctgggtggtgtccttgatccctcggtcgatggggctgaaggtgacccatgattatctctctttgaggcgtgtgttgagagtcggaggaacaccctgcagtgtgttctcatgtgtcggaaggtgtaccacgcgtgacgtgatgcagcaggtagaaaacagtggccgtgggcctggaggacgtggggttcagaagacgcccaccaccttcggggctgtagcgcaccttcctttctctctgagtgttgctggggctggtggagcgattgtctccatcttacttgtgagggtccagccctcactcaggtttgtacacatagtcaggactagaggcagctttccttcctccggtcttcctgccttccctgtccctcagctctgcagctgaggtgggaggtgctcaagctgccagcctccgtgatgtttgtgcagtgagacttgtggggagtggcattcccatgtcctgggcatcccttcttagcatgagaggcattcctgtagttgtaaaagtttccagaaattgctttaaagtagaactatgcttgtggccaaaatatatcttgattgaacatttaaactgagtttcttgctttgagtttgagcgggagggcgtcatcgtgagtcttgtcttgagaaaacctctggtcgtgtttcatggacccacctttcctaatccttgtcctcttaatggtttcaacaggacagattgattcactttggagctgtaagtactgatgtattagggtgcagcgctcattgttccttgacgcagagtcccaaaatgaatatccaagagcagggtttccccttggacctcggagcaagtttcaccgaagatgctccccgacccccagtgcctggtgaggagggagaactggtgtccacagacccgaggcccgccagctacagtttctgctccgggaaaggtgttggcattaaaggtgagacttcgacggccactccgaggcgctcggatctggacctggggtatgagcctgagggcagtgcctcccccaccccaccatacttgaagtgggctgagtcactgcattccctgctggatgaccaagatgggataagcctgttcaggactttcctgaagcaggagggctgtgccgacttgctggacttctggtttgcctgcactggcttcaggaagctggagccctgtgactcgaacgaggagaagaggctgaagctggcgagagccatctaccgaaagtacattcttgataacaatggcatcgtgtcccggcagaccaagccagccaccaagagcttcataaagggctgcatcatgaagcagctgatcgatcctgccatgtttgaccaggcccagaccgaaatccaggccactatggaggaaaacacctatccctccttccttaagtctgatatttatttggaatatacgaggacaggctcggagagccccaaagtctgtagtgaccagagctctgggtcagggacagggaagggcatatctggatacctgccgaccttaaatgaagatgaggaatggaagtgtgaccaggacatggatgaggacgatggcagagacgctgctccccccggaagactccctcagaagctgctcctggagacagctgccccgagggtctcctccagtagacggtacagcgaaggcagagagttcaggtgagtccgacgccaggcgtccactttctgtactcacctccgagagctggagaacaagccagggaaaggtgctgatgaggcgggcgttaacccacaccggatgtcctgctgccgctggggttgaattttggttctgttcttatttgtgatacttttgcatttgtcattacttttttatatttgtaatgttgagaacacttttactgagaacagactaaaatatatgactttatgagtcattaggaacatcggaattcttagaagtcacaatgacatgtaaactttacccttcagcagtaaagtctgtcacctcttaaataggagctggatctacccagtagacatggtcctttccgcttaataaagggaggagtggacgtttcagggcatcgataagaattggagaattggattcttgcttttttttttttttgagacggagtttcacttttgttgctcaggctggagtgcaatggtacaatctcagctcactgcaaccttcgcctcccgggtttgagcgattctcctgcctcagcctcctgagtagctgggattacaggcatgtgccaccacgcccggctaattttgcattattagtagaggtggggtttctccatgttggccaggctggtctcgaactcccgacctcaggtgatctgcctgcctcggcctcccaaagtgttgggattacaggcgtgagccgccgcatccggccagattattgcttttataatgatcttctaagcttcttcctacaggctgagaaatagcaggggggacgttttacgtgtggggaatggtcagagtactttgaaaacttcctgtggctatagtgggcattccaggattgggccttttttcctgccaacaaaatctgttggtgctgttgtgtagtccacagcagcctggaccctgaggcgatcctggcagggcctgtggggtgcgtgtgttgcctgggagggagcagagtggtgctcagccttggaacctgtttcttcgttcttccttccctgtgatccctgcgtggttcctggaggtttatttggctttcgggctggcatctactgtgcttgtgagcagagcgcatgcatttcccactctttccctagagctggtgaccggaggctccggcctgtgtaactttgaaagcctggaattcatgtgacccctgctgacctaatcaagactccgaaagcacagccccatgtgctgggactctcctgaggagttattaaaaactcgcattagttcttcaagcttactgtgacacagaaattggctactcgctcatcaacacaggattaaacatgtctaaggttaaacttgtagtctaagtgatacgatttaagatggactgtcgactgggcgcagtgactcacacctgtaatcccagcactttgggaggccgaggcgggcgaatcacctgaggtcgggagttcgagaccatcctggccaacgtggtgaatcctcatttctactaaaaatacaaaaattagataggcgagttggcgcatgcctgtaatcccagctcctcgggaggctgaagcaggagaatcgcttgaacctgggaggcagaggttgcagtgagccttggttgtgccattgcactccagcctgggcgacaagaggacaagagtgaaactctgtctcagaaaaaaaacaaaaaaaaaacaaaaaaggattgtgtaggttaattggttaattttttttttttttttgagatggagtcttgctctatcgcccaggctggagtgcggtggcgccatctcggctcactgcaagctccgcctcccaggttcacgccgttctcctgccccagcctcccaagtagctgggactacaggcgcccgccaccatgccggccaattttttgtatttttagtagagactgggtttcaccatgttagccaggatggtctcgatctcctgacctcgtgatcgcctgcctcagtctcccaaagtgcggggattacagacgtgggccaccacgcccggccttttttcccttttgttcattgtctttagccaagtggtatttatttagcaagcattttaggacacaatatgccgcaaagttatcctgttgagtaagcctggtataaactgagagtttctttctttctttcttttttttttttttgaaatggagtctcgctctgtcacacaggctggagtgcagtagcactatctcgctatctcggctcactgcaacttctgcctcctgggtttaagtgattctcctgcctcccgagtagctgggattacaggtgtgtgctaccatgcctggctaatttttgtatttgtggtagagacagcgtttcgccacgttggccaggatggtctcgagctcctggactccagtgatctcagcctcccaaagtgctgggattacgggtgggagccactgcacctggctggttattttttttgcttgtttttttgtttgagatggagtctcgctctgtcgcccaggctggagtgcagtagtgcaatctcagctcactgcaacctctgcctcctgggttcaagtgagtctcctgcctcagcctcccgagtagctgggattacaagtgtgagctaccatgcccagctaattttctgtatttttagtagagatggggttttaccacgttggccagtctggtctcgaactcctttcctcaagagatctgcccgcctcagcctcccaaagtgctgggattccaggtgtgagccactgcgcccggccccggctggttatttttaagatgggactgaagttgagggctgggctgcaggaggaaaatgagctccgttctgatttccactgttggaaccccagtgcctccctcccagccactcttcagttcttggctgcgagcagtagctttgctgtctgtccttggtttgctgtatttgtaataaggaacctttgctatgaaattagtgggatacattggcttctcctgtctaattttgtgtagctctgtctacacagtttgggtcctaacttgactgctctggggctgctggtggcagaggaccctggggcttgggagtcgtgtctgcggttgaatcctctctgtgggaggtggcctgtggtgcagccttgtggcttgaagatctctgatgttggaatggttgcttgtcagcacagacagggcatgaagtccaggctgcgttcctcacatttagaccattctctttgtcctgccaggtgtaggtgagggtgcactaggttggaagtcgtggaaacccacccacctgagcccaaccctgaagggcactgttgaggcagagcctcaggtgtgccttagggcctggcacctttgctttgtgccattctgactttgcctgcctggtgggcgacttcgtgggctttgtgttggaggtggctgctgcagtgaccttgggctctgggctcccttgtttacagatgcttcccgcagctctgacggatgggcccgctgttgctctgaggagggcacgtgtgccgctgtgtcccgtctgtctcagcacagtcacggtgcgtgcgctgggggctgtgcagcagggtcactcctgaaggaaagtgggttctccacccagacagacggctgctccccagtggggagctgggggcagtcctccaaaggaaggctgcgggtaatgcaaagggaaaaggagagtgggtactgaacaggcggctggtgagcattgctaccacagcagggcctggagcttaggcctcacgtgttaggggatgcatatcctgtggagagccggttagtcgtcccggtgtgtccggaattggtgggttcttggtctcactgacttcaagaatgaagccgcggacccttgccgtgagtgttacagttcctaaaggcggcctgtccggagtttgttccttctgacgttcggaggtgttcggagtttcttccttctggtgggttcgtggtctcactggcttcaggagtgaagctgcagatcttcgcggtgagtgttacagctcataaaggcagtgtggacccaaagagtgagcagcagcaagacttactggaaagagagaaagaacaaagcttccacactatggaaggggacccgagcgagttaccactgctggctcccgcagccagcttttattctcttatctggccccacccacatcctgctgattggtagagtccagtggtctgttttgacagggcgctgattggtgcgtttacaatccctgagctagacacaaagcttctccacatcctcaccagattagctagatacagagtgtccacacaaaggttctccaagtccccaccagagtagctagatacagagtgtcgattggtgcattcacaaaccctgagctagacacagagtgctgattggtgtgtttacaaaccttgtgctagatacagagtgccgattggtgtatttacagtccctgagctagacataaaggttctccacgtccccaccagaatcaggagcccagctggcttcacccagtggatcccgcaccggggttgcaggtggagctgcctgccagtcccgtgccgtgcgcccgcactcctcagcccttgggtggtcaatgggaccgggcgctcgtcggggagactcggtccgcacaggagcccacggagggggtggggggcttaggcatggcgggctgcagctcccgagccctgccctgcaggaaggcagttaagacccagcgagaaattgagcgcagctccggtgggccggcactgccgggggacccagcacaccctccgcagccgctggcccgggtgctaagcccctcattgcccgcggccggcagggctggccggctgctctgagtgccgggcccaccaagcccacgcccacccgggactccagctggcctgcaagcgcatgcagccgcggttcccgctcgcgcctctccctccacacctccccgcaagctgagggagccggctccggccttggccagcccagaaaggggctcccacagtgcagtggtgggctgaagggctcctcaagtgccaccaaagtgagagcccaggcagaggaggcgctgagagcgagcgagggctgtgaggactgccagcacgctgtcacctctcaccggggtggaatttgcgtggaggaacgtgccaggagggccagccctcgggtgctgacccctctgtcctggaggctactttgcctgcatctctgccacagtcgctcatcccctgcggtggggctgctgcggtccagcacggccacaggcatccagttcccctgtgggacgcctgagtgcgggtccttgttggtccgtgtgtgagccgcgtggtggtttcacatacttgatttgaggaaagtgaagtgttctgcttaggtctttgtctcagcctaggaaagagctccattcctggcccttttctgtgtttgtcccactcacccactgtcattttgagctcctgggccaaggtttcatggggttcctccctggctcccccgctctgcctctgtgggaacactttctgcaccctcgggtctttgttcccattgtcagtggaactttgaacagagctggctggttcacctcgtcatttcagcggtgtggatcagcaggcaggttctgctgttgactgagtgttgggcgggaggcccagggcctgcactccctggctggcgggctcaggctctgcttcccttcagggtggcttggcccaccaggtggccttcagggctggccttgcatgcccctgccaggtccgcttggtcaagcccgcagtctcctcgccgctggccccttctgttgactgccctgaccttccttgatgactggggacagggtcttcctggatattttcgtgtgtcttcccgggccagtccagtgatgcacttgtggatagggctggtcaatgtggctgtggccagagagtggacaacagacatgtccacagcaggagcaacatggtggcttgtcttgggctgctggttcctggagctgctcagaggaccggtgggtcctttcgaggtgggcagccagcccttgccgttcaggttcccgcaggggtgcgtgaggaaccgtcggacctgctcattagtttattgactgtgtttctggtaatggcctaaaaggttaagagaagaaatggttaaaaaaaaaaagaagaagaagaagaagaaaaagaaagggcccaaaatgtgtacagagttgtctgtggaggagtggttttgggtttccatgtccgttggacctcaggcggtggtgctgttgaaggtgcccggctgcagaggggctgtgttgcaagggtgaactctgcttcctgtgcaaagggtgtggcccagggtggggtcgcccccaggcttgtcttgttaaggggacctctgctgtggtgcagagggggcagaggtgcttgtgagccatactgccccttgcgtgggctccccttgcctgggtgtggggggtttctagtctcctttggggtatttgcttcccctgtttgagcagatctgaagagaatttttttttttttttagacagtcttgctctgtcacacaggttggagtgcagtggcaccatctcggcttactgcagcctccgcctcccaggttgaagcagttctcctgccccaacctccccagtagctgggattataggcacctgccgccatgcctggctaattttttttttttttttttttttgagatggagtctcgctctatcgccaaggctggagtgcagtggcacaatcttggctcactgcaagctccacctcctgggttcaagcacttctcctgcctcagcctcctcagcagctgggactacaggcgcgtgtcaccacgcccggctaattttttttttttttgtatttttagtagagacggggtttcaccttgttagccaggatggtctcgatctcctgaccttgtgatccgcctacctcagcctcccaaagtgctgggattacaggtgtgagccaccacgcccggcctttttttttttttttttttttttttgagaccaggctggctggttttgaactcctgacctcaagtgatctgcccgtctcggcctcccaaagtgcaggggttgcaggtgtgaaccaccacaccctgcccaaagggaaattttttttgtttgtggatgtccaaggaaaactttaaaaatgattcctggccaggcacggtggctcatgcctgtaatcccagactctgctggactctgctggtgctctgctggactctgtccccacagcaccagcttgcatcccactttttttttttttccccaagatggagtttcgctcttgtcacccaggctggagtgcaatggcgcgatctcagctcactgcaacctctgcctctcaggttcaagtgattctctagtctcagcctcccgagtagctgggattacaggtgcatgcccccactcctggctactttatgtatttttagtagagacaaggtttcgccatgttggccaggctggtctcgaaatcttgaccttaagtggtccgcccaccttggcctcccaaagtgctggaattataggcgtgagccactgtgcccagtccatcttgtatttttatgcacctgtcagtgggcaaggactccaaacatattttttctcttccttagccacgtaaagctccatagtctcagacaggtttcagcagagtccacgaaagtatctgtagttgcctgtcaggccaaaggattctggaaccgagaggcccctttgcctgggcggacctcagtcctgagctgtgtgggtgggttgtgaaagggaagcactttgcagacagccagtggcagacgtgccgatgagactgtgtgcctggccctggtgctggtgctgacctgcagcagctgtttctggagggcttggggtaagtgtccctgcgggcccctgtggcccttcttggaactgtgccctagccgtgactggccgcctggcaccccagcccattctcacattttgcgccagtgtcacagatttgaattgacgcacacgctccggttctgctcatccttgtcaaacgcagacgtcatttgtagcagcgtaccctgcagttatcggaggtgggggccaggctgggctatggtggctgtcagggagagagggccgcctgttggctctttcttgggcccctccgctgcctacttgtgcgtgtggagggaagcagcttcacctcagtttttccccgtgtcacatctgtgagaataaccactcagggttctctcagaacccattagctccagaaggtgttcggtctctccactccctgagagatggagactggtcacagggctctgtgaaaacacacacagctctgccatactgctgtggcgtccagggggcccccagaggccgcacgcccggctgagtgcccatagggcccagattccatgccccttctcctccagcaaggaccctgggccctgtccggagttgaacgctggcttgtgtggattgcagcctcggcccacgggcttcctttgtgatccgttgaagcatctgctggcaaatgggctcagctcttggctcagctggctaggtggccaggtggccgggtagctgggcgtccgggtgtcctggcaggcgctgtcctcactgtgagctgcagtgggctgcttggtcctgtgccctgctcatggcactcaccctcctgcctcctttgaggttgctccagtgcttttttttttttttttttttggttttgacccactctggatctttactagctcacctgtagtctatgggattggtgtctgctcctaaacaaacatttaaaataaccctaaggagtgctgcttgtaatattccagcaaataggatgacttgaatgcccagtggcattcatacagttggatatgtgggcttttaatttttttctttgtttttctgtattttccaaattcctataacagcatgtttataattagaaagtatattattaaaagaataaaagctttaaaatatgcagctattcaaaagcacattttttctttaaaaaggatacacgtaaatgtgtcttttttttttttttttttttttttttttgagacggggtcttgctctgtcacccaggctggagtgcagtggtgtgatctcagctcactgcaacctctccctcccaggctcaagagctcctcctccctcagcctccccagtatctgggattacaggcgcctgccaccatgcccggctaatttttttgtgtttttagtagagacggggtttcaccgtgttagccatcatggtctccatctcctgacgttgtgatccaccagcctcggccttccaaagtgctgggattacaggcgtgagccactgtgcctggcccacacctggttaagttcttgtatttatgttttgttttttttttttttttttgaggcggagtcttgctctgttgcccagactggagtgcagtggtgcaacctcagctcactgcaacctccgcctcctgggttcaaatgattctcctgcctcagcttcctgagtagctgggattacagacatgcgccaccacacctggctaatttttgtatttttagtagagatgaggttccaccatattggccagactggtcttggactgacctcgtgatctgcccgcattggcctcccaaagtgctgggattacaggtgtgaggcaccgcgcccagctggtgtctgttcttttagggaaccagccctcttgggtcagggccccacgtttgcgttctcatctaacaataacacttccttacttcaagcacagccacgtgatggtcagggctgacacatattaattgggcgacacggttcggtccttagtgccttttctgagtaacgtgctcactgctatcttgtgtccactggctctttgagagctctgctgctctcctgtctcacccctaccctgaggtgttcatgcaccagggcatggtgctttcacttctgagccaagtgggtcaatcattttcttttttgagacggagttttgctcttgtatcccaggctggagtgcaatggcaccatcttggcttactgcaacctccgcctcctgggttcaagaaattcttctgcctcggcctcccgagtagctgggattacaggcgtgcatcaccacacccagctaatttttgtatttttagcagagaccaggttttaccatgttggccaggctggtctcgaactcctgacctcaagtgatccccctgccttggcctcccaaagtgctaggattataggcgtgagccaccacgcctggccattttctttcctgtacaattttgtgtgtttgtttttgagttaataatggccgtttttttcatttgattaaatattttactttccaacttaaatcttcccatattcttcagctcaatagagtgcttgtgaatattcttctcctcactgtaaaacctcttggataaagtattttttctctggaagacatgtgtcctgaagtcttccatattcccactctggttgaaacagttactctttaggcatcctgtggtactgggtgccttggagctggtgtgtgtggtactggcatgctgtgtaactgggcgcagtggtactgggtgctgttattgggtgccatggtactgggtgttgtgttattgggtgccatggtactgggtgctgtgttattggcatgcagtggtactgggtgctatgttattggtgtgccgtggtactgggtgctgtgttattggcgtgctgtggtactgagtgctatgttattggtgtgctgtggtactgggtgctgtgtaattagtgtgccgtggtactgggtgctgtgtaattagcgtgccatgatactgggtgctgcattattggcatgctgtggtactgtgtgctgtgttattagtgtgtcctggtacagactagtggccgaggtgtgcctgtgtggagatctgagggtgacgtaagtagaggcactggcgtgagggcccctcatgcagtgtcaggcttgcacctttgcttggaaattccattagctttggaatttatagcttcgtggtgcagtgtggagttatgttggagataccacaaagataaagcatttccatggtgaacaaaaaagtttacaaataaaagcagtccaggccgtttttattttggctttgttatgtgtccacttactgctgtgcattctatacgccaatgggagtgttttgtagattctcatgagttggttgcgtttggttcatttgggtaaagtgaaactccttttaaaagaagcagaaaaaaattaaatatctcataaaaataaagattttctatttctgcctcagagtgtttctctctagtgagtggtgtgtaattagtgtgccatggtactgggtgctgtgtaattagcgtgtcatggtactggatggtttgcttttggcatgccatggtgctgggtgctgtgttattggcatgctgtggcactgggtgctgtgatattagtgtgttgtggtactaggtgctgtgttattggcatgctgtggtactgggtgctatgttattggtgtgctgtggtattgggtgctgtgtaattagcatgccatggtactgggtgctgcattattggcgtgctgtgctactgggtgctgtgttatcagtgtgccatggtactgggtgctgtgtaattagtgtgccatggtactgggtgctgtgttattggcatgctgtggtactgggtgctgtgttattggtgtgttgtggtactgggtgctgtgtaattagcttgccgtggtactgggtgctgcattattggcatgccgtggtattgggtgctgtgtaattagcatgccatggtactgggtgctgggttattggcatgctgtggtactgggtgctgtgttattggtgtgttgtggtactgggtgctgtgtaattagcgtgccatggtactgggtgctgggttattggcatgctgtggtactgggtgctgtgttattggtgtactgtggtactgggtgctgtgtaattagcgtgccatggtactgggtgctgtgttattggcatgccatggtactgggtgctgttattggtgtgccatggtactgggtgctgtgttattggcatgccgtggtactgggtgctgtgttattggcatgccgtggtactggatgctgtgttagtggtgtgccttggtactgggtgctgtgttatgggcatgctatggtactgggtgctgtggtactgcgtgctgtgttattggatgccatggtactgcatgctgtgttattgctgtgctgtggtactgggtgctgtgttattggcatggtatggtactgggtgctgtgttatgggcatgctatggtacctggtgctgtgttactggtgtgctgtggtattgggtgccatggtactgggtgtgctgtggtactgggtgctgtgttattggcatgctgtggtacctcgtgctgtgttactgttgtgctgtggtactggtgttatgcgctcatgccaaaagaacttgaaggagagatgagttgggtttagaatttaggttgggtggcaccccccccataaatttagaggaatttgcaccatcaccttctgtttttctgagctgccctggaaagacctggctccattctcttcatacggtgtggatggtgctttttttcttccctccagacattttttggatgttttctttatcaacagtgttatttcataatactgtgttttgctgggggcttttttctttcatcgtgctgaagaaacttgtcctttaattctggagtttaaatggtatttgtttcttttcttttttttttttttctgaggcgagtctggaaaaaaaggcttgagcgatcctcctgcctcagcctccagagtagctgggactataggcaccagcacaccccactaatttttttttttcgagatggaatttcgctcttgttgcccgggctggggtgcagtggtgcgatctcggctcactgcatccgctgcctcccgggttcaagcaattctcctgcctcagcctcctgagtagctgggattacaggcatgcgccaccacacccagctaattttgtatttttagtagagatggggtttctccatgttggtcaggctggtctcaaactcccgacctcaggtgatccgcctgcctcggcctccaaagtgctgggattacaggcgtgagcaattgcacccggcccacctcgctaatatttttttacagttttttgtagagacaaggtctcccagtgttgcccaggctggtctcaagctccaggccttgagcactcctcctactttggcctctcagagagttgaaattgcaggtgtgagccattgattgcatctggccagaaatgttatttctttgataattccttctctccatctttaccatttctcattttagaacttatttgagatcttatttagattttggaccatttagagtgatcctttaaattttaaatctttcatatattttgcatttctttttgttgtgttttcatatcttttcaatacatttttttcctgcccttgctttctgaatatacactcaaaaaattatactttttttttttttttttggtttagatcaacattgtttagatcaaaatctttctggagatgttaagatgttaagtgtaattttttttttgttttctttttttttttgagaaggagtctcgctctttcgcccagcctggagtgcagtggcacggtctcagctcactgcaacctccacctcccgggttcacgccattctcctgcctcagcctccctagagctgggactacaggcgcccgccaccacgcccagctaattttttgtatttttagtagagatggggtttcactgtgttagccaggatggtctccatctcctgatctcgtgatccgcccgccttggcctcccaaagtgctgggattacaggcgtgagccaccgcgcccagcctggctgcaggttttatatcctgtttctaaaagttaaatatgctttacttgtgattgtgatgttgctgctgcgagttctctaaactgtccttggaccgtggggccctcagttgttgctggtccaccaccatctgcaggagctgtgaacagaggactgtcagggaccattgtcgctgctgaaggctgccgacctgtggactctcgcactgcctgtgtcaggcgtcaggccatccgcgagcccctaacgaggtgtgggagtgtcatgccatccatgtggaaactgaggccctgggagattaagtaacttcccatctgctgtagtcagggtcgggcccttagtcaccgtggtctctggaacccacaggcctggaaacagcgcttttgagcaggggctcagcgaggctgggggtcagactagtggccgaggtgcgcctgtgtggagatctgagggtgacgtaagtagaggcactggcgtgagggcccctcatgcagtgtcaggcttgcacctttgcttggaaattccattagctttggaatttatagcttcgtggtgcagtgtggagttatgttggagataccacaaagataaagcatttccatggtgaacaaaaaagtttgcaaataaaagcagtccaggcagtttttgttttggctttgttatgcgtccgcttactgctgtgcattctatacgctgataggagtgtttgatagattctcatgagttggttgcgtttctttcatttgggtaaagtgaaactccttttaaaagaagcagaaaaaaattaaatatctcataaaaataaagattttctatttctgcctcagagtgtttctttccagacagaggcttcttcctgctgcacactcagagtcaaggaaactggacacagctgctttggagtgttagggacgtccatgagctgtcagcccagggaagggctccaggatccctgagaatgtcataaagagggtagacccagcttggaacttgcagtttctaaattacttcaagggaacaaaccagagtgcttcatgtacagaattttttttttcatgtacagaatttttaccttaactagattgataagtgtccagtgttttaatttttaataagacgtggctttcagaagttgttattttcgtcttgtagcttcagcactgagagctggtctccttcaggtgagttttatgcaggattcagggaccatgactgtaagccggcaacctggttctgggtaagtgatgtattcagacttctgctgaggaggctctgaggctggcgtgagacttgccaccctgcagtctgcaagggctgcagtctggctggcctttgtaaagaccctggagcaatagggcagattgcatcttggcaaatgactctaaattgcctgcaatttgctgggaattgccacttccaaatgtttgttgcagcatagataatctgagcttgtgaaaggtcattggctgttctttggaaccagtaaattcctgggggcttctgctccaggggtgaaggctggagtgagggtgctagtgtctcctggggaggaaagcataaaacatttttttgttctactttttaaatgttaccactcttcattacataaagtgtttctcatcagatccttgtgaacctaaaaatgtgatgtgaagccatttgtgcagttccaggctctgaagagacttttgtgacattgaagaaatgtggcagtgagcagcacaaaactgaattcaatgcacggtgttcacgctgagcagaggaaagaggtcgtcagtttcataactgattgtgctgagcactaactagtgagtctcattagtgagttctttggtgcattataattttcaaagtgttcttcatgtacattattgcatagttttcagtcaatgcaaagacagattgttgtcagagttctatatgaaagacgtttggtagcgggcacagtggctcacatctgtaatcccagcactttgggaggccaaggtgggtggattgcttgagcccaggattttgagaccaacctgggcaacatagggagacccccatctctagaaaaaaatagaaaaattgagatgagtgtggtggcatgcacctgtggttccagccactagggaggctgagatgggtgggtcacctgagaccgggaggttgaggctgcagtgagctgtgaatgtgccactgctctccagcctggttgacagagagagaccctctctcaaaaaaaaaaaagggccgggcacagtgggtcatgcctgtaatcccagtactttggaaggtcgaggcgggaggatcacgaggtcaggagtttgagaccagcctgaccaacatggtgaaaccccgtctctactaaaaatacaaaaattggccaggcgcggtggctcacgcctgttatcccagcactctgggaggctgaggcgggtggatcacaagatcaggagattgagaccatcctggctaatacagtgaaaccccgtgtctactaaaaaatacaaaaaaaaaaaaaaaatagccgggcaaggtggctggcacctgtagtcccagctactcgggaggctgaagcaggagaatggcgtgaacctgggaggcggagcttgcagtgagccaagactgcgccactgcactccagcactctagcctgggcgacatagcgagactccgtctcaaaaacaaaaaaaaacaaaaattagccgggcatggtgttgtgcgcctgtaatcccatctactcgggaggctgaggcaggagaattgcttgagcccgggaggcggaggatgcattgagccaagatcacgccattgcactccagcctgggcaacagagaaagatgccatatccaaaaaaaagaaaagaaagaaaacacagaacaaagaaatggtctgatatcccactgctcagagatactactattctatctagatcgctctagatttttcttagcacatttttttcatcaaaaatgggatcctaattcatgttacccactctgtatgtttttcagtatctttttttttttttttttttttttgacagtctcgctctgtcgcccaggctggagtgcagtggcgcgatgtcagctcactgcaacctctgcctcctgggttcaagcgattctcctgcctcagctcttgagtagatgggattacaggtgcacaccaccacgcctggctaatttctatatttttagtagagacagggtttcaccatgtcggtcaggctggtctcgaactcctgacgtcgtgatcctccctcctgccttggccttccaaagtgctgggattacaggcgtgagctaccgtgcccagcccactatcattttaaatagttactggtgtgagcagcgtggcagcacccaggggttgtgcagagaggacagggtgcctggcagaccctccctgcccgccatctctcctggaaagcggagcagcagcttcagtctgtgggggactgtgcagagaggacagggtgcccggccacactctccctgcctgccatctctcctgtctgtagcacccgttgccatgtgcctttcaaaatcatgagtgtttgggttcctgtgaatatgctgttcttgttaagtatttaatttattattattttttttgacatggagtttcgctcttgttgcccaggctggagagcaatggtgtggtctcggctcactgcaacctctgcctcctgggttcaggtgattctcccgcttcagcctcccgagtagctgggattacagacatgtgccaccacgcctggctaatttttttttttttagtagagatggggtttctccatgttggtcaggctggttgcgaactcccaacctcaggtgatccgcccgccgcggcctcccaaagtattgggattacaggcgtgagccactgcacctggctgtattattattattttttttagtgacagagtcttgctgtgttactcaggctgaaatgcagtggcatgatcatggctcactgcagcctcagcctcctgggctcaggcgatcctcctgcctcagcctcctgagtagctgggaccacaggtgcatgccaccacacctggctaattttttaaatattttgcagagacgaggtctcaccttgttgtccaggctggtcttgaactccaggactcaagtgatccatctacctcagcctcccaaaatgctgggattacaggtgtgagctaccccgcccagcccttggctaatttttgcaacatttttttgtagagacaaggtctggccttttcactcaggtgggtcttgaactcttggctttaaggcattctgcctcagcctcctacagtgctcggattacaggcttgagccactgtccccagcctggtgaagcatttgtttagagtctcacagacagttagttggaattgtgggtttaactgtgacctgcagcctttcccacccagtcccctaactaatgtgcaggacactttggttgctaggctgtagtgagggctttctgcatcatgtgcctggcctcacccaagcactgtttgctgaaatgctcagaaactttataaagaagtggccactgtcatttccgctttgtaagctaggaattggcagactgcctgtggtcagtagccagtaagtgctggtgaggggcatttggccacagtttgagctgttggactcccgggatggcaggtgtgggtggctgccagggctgccccgcctgtgctgcgcctgtggacagtctgcagaaacacacaccctccctatcgtcactgtttgattttgatcataaagggcctttggtgtgttgtgcggttcacagtgagtgggtgggggcaccagcggtgttataaaacaaagaaaaggctggccgcagcgtggaaccacagcgaggcctcctaggcacaggccgcagggctgagccggaagctcctgcctggtgcctggtgactcattctcttgcccttttgtgtctgccaccctgagtgaccgagaaatcacctgctcattcagtgtgagcagaaggggtgagagtgccctgccccatggtcattcaatgctgtctggtcagcccatcacctgttcctgcccctgagggtgacaccaagtgtctgccgccatgcagaacacccacgagatacgtaggtggagtattctgggacctgatgggggtgctggcaatctttttttttttgagacggagcctcgctctgtcgcccaggttggagtgcaatggtgcgatctcggctcactgcaagctccacctcccaggttcatgccagtcttctgcctcaggctcccgagtagctgggactacaggcacccgccaccgcacccggctaattttttttatatttttagtagagatggggtttcaccgtgttagccaggatggtctccatctcctgacctcgtgatccccccgcctcggcctcccaaactgttgggattacaggtgtgagccaccacacccggccagtgctggcaatcttggctgacgcttcaggcagaggccacatccctgattttatggaggaagtaaaatagagattttcatagctgacggtggcctgattttgatcactttttttttttttttgatcccactctgtcaccaggctggagtgcagtggcgcgatctcgctcactgcaacctccgcctcccaggttcaagtgattctcctgcttcagcctcccgagtagctgggactacaggcgtgccaccacgcccagctaattttttgtatttttagtagagatggggtttcaccatgttggcaaggatggtctcaatctcttgatctcatgatccgcccgccttggcctcccatggtgctgggattacaggtgtgaaccaccgtgtccggctctcaatcacattttttagtataaactttgtgacctttgggtgcaaaggtaggttatttatctataggtgtgtatatatatatatatatatatatttttttttttttttttttgagacggagttttgctcttgttgcccaggctggagtgcagtggtgtgattgtggctcactgcaacctctgcctccccagttcaagagattctcctgactcagcctcccgagtagctgggattatgggcgcctgtcgccatgcccagctaattttttgtatttttagtagagatggggtttcaccattttagccaggctggtcttgaactcctgacctcatgatccgcccacctcagtctcccaaagtgctgggattacaggcatgagccaccacgcctggcccttgttatatatatagtatataagtgacagcatctgcatgaatgggggccagttgtcagtattgctaaaacagaagcgagacctctccatgccggtgtgaaccagggcgggccttttcgtggccagcgtgagtgagtggggccctctctgtggtcagcatctgcattttgtgtgctgtgcctttgtcacattcatatggaagttcatgtgaggtgaggaaatgcttgtcctgcttctcccagtgcctgtctgctttggtcgtttcttggtgtttccgaaggccccgtcatgagagaagatggagctaacacagagcaaggtgccgtgttggggaatggctctcctctcttcttctcagggctggagcctgcagccacgtgggacagaccataagttgtacacacgacgctgtggcagccatcactctggggcggtgaccgctccttggcagtcggcccctgcgggcagtgggttgagccctggtctgggcgcccttgaccaggtttgtgtctggactgggggaggcgagacgtggggagggcgctggctgtggcctggctgttggcctcggggtcaactctgcccgctgggaagcgctgccccaactccagtggcactgccaagcagttggagaaaaacaccgtggtgcatcctggcatgccacggcataaaagggatgagtcgctgataaccatggaggcaggggtgcatctcaggatcctgtgccagtgaagaaagccagagcggagggggcgccggagcagcggggggcactagctccccatgagactgcgtttatacagaattctagaaaaggccgactgacctcgagcgacaggtggatttccccaagggaagcctccccaggcttccgggttgaatatgtgggctgaggcgatggtttcctggggtgcggggccgcccgcggggctgaggcgatggtttcctggggtgcggggccgcccgcggggctgaggccatggtttcctggggcgcgcccgcggggctgaggctgtgatctggtgcgcgtcagaacgtgccaggtaggactgtggttctgtgcgggtccgctgagcacccagccgtgcgtcagtagagctgatttttacacagccgtttccttgcctttgttcatcccggagttctgcgcccttaggaactgtgcaccgggcgctgctgcctccctgaaggcttgggcagagcctttccctgcgcgggactcgggggctgggcctgggaagggcctgcggctgccggaagctgcctctgcagggcgggttctgtctgctggctgtgctgttccggggggtcgggatgcaggtcgctgatggcactggccgtgtctgaggattggaccgctcacctggggtgcccctcctcctcctggtataaagtacgacttagcttgtcaaaacagggatcaagtaagtgtgtctgtgtcatgtgctgacgtgcggcgtgtggtcttgtgataacactggaagcgcctactgaccacctgcgggcgttttctgctcagttgtgtttgtcaagcttctgtttatctccacaaactctgcgggacactgggcgggttggttgggaagctgctcatggtgcccttggccatgtgatccttgcaaacctccccggaggaccgcgggcctgtgaggcctgtgcctgacccgcctttccatatcgcttctgccctgcgctgcttccagccgtttctatgcacccgcattccggcccccagcctcctcccaggagggctcagaaaggatccggcaggagacctgtagagcaaatgtagcccccatgccatggcatcggcgtccttgagcaggtggcctcgtgcccagtgccgacccgtaatgtggcccggaagacccgtaaagacccgtaaggcggctcactgacacttggccccagatctgcccctcatggaggctgctggtcagtgcggacggtcccgggtatttcagatgtgactcttgtgggctgcagggctctcctgcactgggctccccatggtctgcagggtttcctgtgggctacggggcttcccatggacaggtctccccatggactatggggctctcctgtgggctttggggctcccacaggctggtgtctccagggtgggttgctcattctgtgccgtattccatcccctgtcgcagttgacaccttttccctttgcacccacagtggtgaagacctgtgcttatgctcctagagagacgcaggtgagaacccaagtcacacccctcagtgttttgttttgttggtgtgtgtgtgtgtgtgtgtgtgtgtggtggagtctcactctgttgcccaggctggagtcagtggtgtgatctcatctcactgcaagctccgcctcccgggttcacataattctcctgcctcagactcccgagtagctgggactacaggcacctgccaccacgcttggctaattttttgtatttttggtagagacagggtttcactgtgttagccaggatggtcttgatctcttgaccttgtgatccacccgcctcggcctcccaaagtgctgggattacagttttgagccaccgtgccccgcctgttttgttttgttttttttaatcttattttggctttttttctttctttttttttttttttgagacggagtctcgctctgtcgcccaggctggagtgcagtggcgcgatctcggctcactgcaagctctgcctcctgggttcacgccattctcctgcctcagcctcccgagtagctgggactacaggtgcccgccaccgcacccggctaattttttgtatttttagtagagacggggtttcaccgtgttagccaggagggtctcgatctcctgacctcgtgatatgcctgcgttggcctcccaaagtgctgggattacaggcatgagccaccgcgcccggcctctttccttttcttttcttttttctttctttctttcaagacagggtcttgacctcttgcctaggctggtctcgaactcctgggcttaagcagctctcctacctcagtctcccaagtgctgggatttcaggcctgagccacgcttggctctcagttttgggaagcaagtggcattggcatccatggcctctgccaggtgaccgctccctgccatctggtgccagagccccttccctggacatgactgcagaccagagctgggacgcagctgcaggccatggctcacctcttcccccaggccactgcccgccatcctcagaggccttttctgcctgtgttgcttcttgccaggcttttgtgtctgccagtgtctgggctctaaaggatgcactcatccgtccaccgcccacagctccagaaaatgaagagggtccccgggagccagcgattctgtgtgtaggattcacccaccatcctcagtggctctgtgggactcaggtggctggagacacatggatggggtattgaggggcagacgcacacccgagtctgcatggactctttgcctcgcggacagccaggtcccacttgctttggagaggaggatgtgcagcccaggggattctgcctctgtgcccaggtgaggcacaggtcagcaccagcacctgccatgctaactcagctcctgcacaggcctcccacacctgtgcagaggaaacacagccgtaggagcacatctgtccccatacctgagcacaggtgcacactccactgcgggcaggtacagggtgatgggttgaggggagacatactcagtcatgagttattgcctcccgttagaccgcactaccagcagggccatccctggagcctggggtgtgcgccatgttccccagctgcccctcggtcacctcctcctggagcctggggtgtgcaccactgtttgcagccaccctgccctgagccaggcctgggagaagcacccagcctcacgcctgcggcatgcgctgcctgggtttccctggccacaagacggggctctctgtgcttctcagaaggtcgtgcatctttgggtctgtgcggccacctccgtcttcatgtccagctcacttggaattgggctttcattggctcattcctggcttatcatccagggctcacagatgtgtgtttccagccattttactaattccagcctctgtctttcagaatacagctggtctctaacttaggatggctccacttaggccttttcaactttacaaccagcctgaagcattcagggtgcccgtcaacgaagggcaaggctgtgtctggataacactttgaggttggaatccactttccacctcatattcccagctatgagagggtttaacccttcgtgggttggaatccaccttctacctcatattcccagctatgagagggtttaacccttcgtgggttggcatccgccttctacctcatattcccagctatgagagggtttaacccttcgtgggttggaatccacctacctcatattcccagctgtgagagggtttaacccttcgtgggttggaatccaccttctacctcgtattcccagctatgagaggtttatcaggacacagccttgtcgtgagttgaggagctctgtggttggagaaaaaggcgatttgcctttcaaaatggctataattattttacgtggtgtactgacctgtgctgcttaagcaaaaccatcagaacttacttttaacaacacagaagtcttggcggggtggggcacgtgctatgcagagctctcctggggctgctgtttgctgtttccccatagtggttgtcaccagcaggtgccatgtggtgccttactaccagggagggtggcggctcctgcctgggtatggaaatgtggtgccttactaccagggagggtggcggctcctgcctgggtatggaaggcacagagagcagcgggcccagagcatcccagagcgtgggtagcaggaggcaggagggcctgtagcagtggtttcgggtgattcccagggccagatctacctccagcctcctcttcccatgttctgggtggcatccgtcacaccaggtggtcttttggcatgaaacattttttgtgggcaggcgcagtggcttaagcctgtaatcccagcactttgggaggccgaggcgggcagatcacaaggtcaggcgttcgagaccagcctgaccaacacggcgaaaccttgtctctactaaaaatacaaaaattagccgggcgtggtgacgtgtgcctggagtcccagctactcgggaggctgaggcaggagaatcgattgaacccaggaggcggaggttgtagtgagccgagatcgcgccactgcactccagtctgggcgaaagagcgaggctccgtctcaaaaaaaaaaaaaatatatatatatatatatatacacacacacgcatatacgtatgcatatatacatatatacacacatatatacatttacatatatacatatatatttgtttttaatttttatattcttgagtgtacttagtaattttaaaggtaattgatgaggaaagctggaactctctcaaatttgcacgtgtgtgttaagggatgtggagggatgctgtgaagcttgacctgtttctaaatttctccatgaaaccatcacagcgaagcatcataattttgtgtaacttttctgtttagattttatccgcccctatgttgcattattggtgttgtcatcttaccttgctggaatccttttaaagcatttacccctttgcagttcagtaattaaaatgatctgatttgtggccaggcatgatggctcatgcctgtaatcccagcacattcggacaccgaggtgggcagatgacttgagcccaagagttcaagaccagcctgggtgacatagtgagacctcatctatataaaaaatgaaaaagtagccaggagtggtagtgtgcgcctgttgtcccacctacctgggaagctaaggtgggagtccagggaataaaaaagaaaatgtcagtgcaggaaatgcgttgcttgtgagtgtgtggggggctgtcggttctgaggttctcatgcggcctgggaagaggcaggtgtgatgtgtgggattgagacatgtccaggcacaggaaccaatgaaagaactgtacaacatttactttttcagagggaggaaatggaaagcaaaaaataccccaaagaaggcaagaaagagcaaaaggaagtagagcagatgtgataaaccaacccgatccgacggtggcccagctccctccacatcacactaaatgtaaccggaccagacagcctcattaaaaggaaaaattgttatgctacctttttaaaaggcaggctgcttacacaagtagaagaatatagaatggttaaatgtgaaaagacggaagatgaaagtaccacagtgaccagagagccggtgccgtggccatgctggatgtgggagcagccgcgggagtcccagagaggtgccttcctggggcaggaggagcacctttctccaccatccatgaacacctgggcaggggagaccttctgtgtggccctgacatttgggcctcctaggccagcctagagtgcactggccgcctcatggcttctcatttcctgttgccttgaagctaatagggtccttgtagctgtcaaaccccacaggtgtttgtttatgacacagctcctgggcattgattctgccatcagcgcctcctcaccgctccactggactttcccttctgtgatgggcacgtttttccctaagtcaccgtgtcttctcatgcctcctctccacgacatttttgtttttgagacagagtctggagcacaggctggaacacagtggcgtgatcatatcttactgcagactcccgggctccagcgagtctcctgccttaccctcccaagtcgctgggattctaggtgtgcgccaccacaccggaccctaaagaaagcctttgaacacacagaagagttgcgaggagtctgtcactacctggctctacagggtctcccagcctctgtgtccccggactctgcctgagtcctggcacctgttccagaagagctgtgcacgttttcctgtttgaggtcatcagcgtggggggctgggcacagctctcaccaagtctccggccgcattctctccgcacagccagagccgctctcaccaaggccccggccgcattctctccacacacagccaggggtcagagccactctcaccaaggccccggctgcattctctctgcacagccaggggtcagagccgctctcaccaaggccccagccgcattctcaccgcacacagccaggggtcagcatctccactgtctgagaagtgcaggtgtaggtggaggtgctcgtgaagggcgggcatacaggtgcacacatgggcatgcgggcgcgcacacagatggatacgtgggcatgcacacacaaagcacgcatccataggcgcacgcacaggcaggcacgcgagcacatgcccctcccgccactggatcccagctatatggggggatcctggaactcccatgtgacctccccttggacgtgtctttgaccagaacgttcttggtcgcatctgctggtagtgaaggccaagcccggccgcctgtgtcttcaggtacaggagccatctgagtgctgagggcagatcctgagagccagggcagttgtctgggattgttacgaagatcaatagtaaacaggctgcccttcttccttttcttttctcccagccgccttctcccgcttctctcccctttgctgcctgaccttggtgcttgtgtgcagtggaacttgctgtgtgctggagcttgtggaaaatgggaaacctgcgtttctcctgcttctcattttaaagacaaacaggttttccaaaaatgtgaaaggcacacctgggaagtcagagtgggagaaggatttggaattggacacatgaacacagaaggcttcgttctgctgtatgtggctcccaagtgacgggacaggtgtgagccccatggcagcatgagggcagggcacgtgcttccagtgcgtgccaagacagacacgccatgtgccgtgggctacagacgcgccgtgtgctgtgggctacagacgcaccaagtgccgtgggctacagatgcacccgtgtgccgtggacgtagacttcttaaacttctgtgcggcagtggccttctctcttccatttgaaatgtttttatttggccaaatagatgtttatagaaagttaccaaagttcagtgttccttcatagtaatagggagactttagtacttaacctgagatctgaggttggctgcagtggttgttacagtgataatatcagtagctgctgagcagctgtggctttaagtatcaaaggaataatggtgtcatttataaatactgcatgatgcttaaagcaaagagcctgaagctgcaggctggtatcattttatctgctctatgtcaggtacagagaggagacgaggagtgaaccaaacttacaaagcccagccaccggtggtcggtgtttccagagaacccatttcccaagagcggccccatggttgctgtcagcctgaggctgccgtcacctggccgtgactgtctgtggcctgcagtgagcgaccaggccacagtgggtgggtcagagggactcgtggacatcggccctggcaggggcctgacatcgtgaaccgtgttttccattgtggcatggggtcctgcacctgcctcccgagcagctgagcacggtcaccagcactgttcgtatgaaaggccctgcttgtgtgttctggccccatgcgataccctccagagggcatggaggccacagccccaggggaaatggccccgtgcagcgaggccctgcccagcaccgccacaggctgtccccagctcgcagtgctcgctcatctccccaggcatcccatgtcaccagagtccaaggtgctgggctgcctgcccccctcccatcttgtcaaagggcctttcctggtgtaagtagaactggggctttccctaggttctgttcatcaggtggatggctggaagctgcgctggtccctccctccacaccaaggactctgatgcgcaggtgtgcttgcacctccgacatggcagttcctccggccatgtgcacgtggagggcggcccattgtggtagccttgggaggtgtcttggttatcttgtgtcactgtgacctgtggagatccaactgaggtagtcatcacccctcgggggacacattccaagacccaggtggaggcctgaaatgcgatagtactgaaccctgtatatactgttttcccctctgggaacacacctctgatcaaatttaacttacaagttaggcacagtagagactaaaaaaattgtgaatcaaatggaatgattgtaagggtgcactgtgataaaccccctgtgaggctgacgactgtcagggtgcaatgtgataaaccccctgtgaggctgacgactgtcagggtgcactgtgataaaccccctgtaaagctggtctctttctctcgcagtcttaccgctctgtgcgcacctagtttcagaccttggctgaacgcaagtaactgaaactagggaaagcaaagccgagtgggggcagccgctagaaggaaggggcagcctcagggcacactgtggggcttggcagttagggaccctgcagagtccacatgccagttggttggcagcacagcagagcgcccggaaggggcacatgcctttgacaggagttagatgtggtggagagaggcgcttaaaattattgaggacaagatgggttatttggtatttaatgctaacagctgtatctccattttgatgtgaaggagtgagctagattttatttattttttattattttattttttacctttaggctctgctggactggcctagattttgtatacacacatttcaggtgaaggtctaaaaaaaactggagcatataaagaaaaatagaatatatgtgtaattctggaataaggaaggactgtgtttccaaaatagaaaataaataaataaataaaggaaaagattggaatatctgattgatttatttattttatttttgagacagagtcttactctgtcgcccaggctggagtgcagtgctgcgatctcagcttactgcaatctctgcctcccgggttcaagcgattctcttgcctcagcctcccaagtagctgggattacaggtgcgtgccaccacacctagctaatttttgtatttttactagagatggggtttcaccatgttggtcaggctgttcttttttttttttttttttttcttttgagacagagtcttgctctgtcacccaggctggagtgcagtggcgtgatctcagcttactgcaagctccgcctcccaggttcacgctattctcccgcctcagcctccgaagtagtctgggactacaggcgcccgccaccacgcccagctaattttttgtatttttagtagagacggggtttcactgtgttagccaggatggtctcgatctcctgacctcgtgatctgcctgcctcggccacccaaagtgctgggattaaaggcatgagccaccgcacccggcctgtctgatttcatagaaatgaaaaattttgtttgaccaaaatcaacctgagcaatgttaaaaagaaaaatgacatttagggagaaaatgttttttgcgtatataaccagagattaataacaagtctatttgaagacttctgtaaatcaccaagaaactcataatccaccccatagaaaatggtaaaccatatgaacagataaagaggaagaagtttaaatgacaaatacgctaaactgccaatctgaccattaatcagggaagtgcagattgaaaaaaggtgtcatttcctggctaattttgcagtaacaagaggaggtgaatcgtcccaggagctggggaggaacctctgctctaggtagggggacaggaggtggcaccacccacacacactgtcacataccggccctgacatcagtcccgtggccatgcttggacttgggcacaggtgcagagacgtctgagctgaatcccaagggcctcatcctgatcaaaacccagtgtcctctcccgacgcgcactgcagaatgagcagaacatctgcgtcccatttctagtaccgtgcacggaaaacaaacccaaatgatcacgtgtggatgctctgtgtgtgcaccaaagcccccgcctaaaatcagaggagagatctggaaagatgcccggtgctttaatgcaccccgttgaaaaggacagagggacaagaggacaggtggagatgttggtcttttctccatgctccttattttctccaaattgcttgtgtttttaattaatacattgagatattcagataacatgaaaatgtgaaataaaatgagaggctgttggcaggctgtcactaacatgccctgcttgcctgtttgcaggtatggatcctggcgggagccagtcaacccctattatgtcaatgccggctatgccctggccccagccaccagtgccaacgacagcgagcagcagagcctgtccagcgatgcagacaccctgtccctcacggacagcagcgtgtaagtcccgccccggatacccagtccctcacggacagcagtgtgtaagtccggtcccagacaccttgtcccttgaggacagcaatgtgtaagtcctgccccagacaccctgtttcttgcggatggcagcgtgtaagtcccaccctgctgcagagcgcggccagctcagagggggcttcgtgctgacccagagatgcctgggctttgtcttcaggaaaagtgtttcctggctccccaggtctcagtgagagtgcgtctggacatgcaggcaggctgtaccgcagaggctgtcctccaagcagtacaagtgagggctcagctttgtgtcggttgcttctctctgtgaccagggctgctgggacctccctatgaggaaggatcgagggtgaacctaagacagtctgtaggctgcccgggctagagtttgctctttggttttcagagtctggggtttcagcttaaagacaggcacaggccagctgcctcaccactggctgtggcgagtgatgtggtccctgagggtggcgtttctgccgacgctggtgcagtacagggtcctgtcttgtccctgtcacccacttggcaaggggctgggagcaggagtgagggaagatgctgtggttgtgctgaggcctgggccacacatgtgtgacgctcgaggtgacaggcagaagcttattctttcattgtccagggaaaccccatgtgtaggaacgtgcttgttttatgacctcttcccctgtgcttcgcagctggctttttgggacctatgtacaccccagccattagatgatgccaacagtcttgttgcagtagggcactggctgccagcctgtgggggtcatttggggttttggttacccatgaagctcagaccttcccagctctggtctgtgcgccacacgccacctgcccaccagccatcctagccagggctggggccgagccgcaggaaccagggtctccctgcagcagcctcagcattggaggaagccagcggctatgaacttgtgagcagctggagcccgcggaccaccaccctccatccccactgcggccagtggtgtcccagatgtctttcccgcttagctgggttctccatgaggaaagcctggagatctggatagggctggaggaggagagagggacttctcacctactggtgattctgcccatctttttatgaatatgttttaagtgatggtcccactgtatgtaccatttttatggttcttttcattttgagacaggatctcactgtcacccaggctggactgcaatggtgcgatcttggcttactgtagcttctgtctcctggtcccaagcaattctgcctcagccttcagagttgctgaggctacaagcgtgcgccaccacgcctggctaatgattattataatttttgtggagacgaggcctcactatgcagtctcgaactccgaggctcaaacggtgcacccacttcagcctcatgagtgctgggattacgggcatgagccactgcatccggctgatgatgatgattatttttgtggagacgaggcctcactatgcagtctccaactcctgggcgcaaactgcacccacttcagcctcacgagtgctgggattatgggcatgagccactgtgcctggctggtttgttcttttcatttgcctgtctttaaacatttttccaaaacctgaatttcagatgaggagaacaagttgtcacattctgtttctgaaccagattcagccagcccacattgccgtaggtcttggccccttggtttttccccaggtagctgtggtagtgcaggggcagctccctgccccttccgggcagagctgctgtgtgtggcttctcctggtttctttcatcctcgtttaattttgaatcttcaaaataaaatgttgacgtgattttagcagcacctgacttgaggttactggagttgaagcagtgcctgccgtggtcctgaagcctcgggccaggtggttgggtgcagtgcagcccacggagcgcctgacatgcatcctagcatctggtttccctcttccccaaaactctgttactacaacaaaaagtaacctgccaactcagttttctcaaaaagtctcctaattctctccaagaaaagggacatatgtttcctaaagggaggacctaaaataaataggtattttttttcttgatattctgttcatcttggtttgtactgaagtgtttaacaatttggaatgtgaaattgctacacgtactcgaaagcaaatcagaggtaaaaagtggacaggtgaagagcatcattccggtggggcagctgccctcagcttttgtgctggcggcaagctcacaacattccacatggcactcgagaggctgtgggctgtggacacagatgtggggtcagtgtctaatccacggaggcctgtggaggttacccaatccaagtatcatgtctaagaaaccagtaggttggtggcttcaggacacttcaacaaaccccgaggcaagtgttaggtgagttttagattcacttgttcctgacgcccaccgtggctgagccagacctggactcggctcaccattgcccacaacactcagtggtgctgtgacagccgaggatgcctcaggagttgccgtgtctgccacgcagccctgggtcgggcgctctcttcagtcgtcctgtgtctcctggcagctctgagaggcccctgggtgcggcacggatccctggagctgccgtgcttccgaaggcagcttttctttctttcttccttttcttttttgagacgtagtcttgctctgttgcccagactggagtgcagtggcacaatctcgcctcactgcaacctccgcctcccgggttcacgccattctcctgcctcagcctcccgagtagctgggactacaggcactcgccaccacacctggctaattttttgtatttttagtagagacggggtttcaccgtgttagccaggatggtctcgatctcctgacctcgtgatccgcccgcctcggcctcccacagtgctgggatgacaggcatgagccactgcgcccagcccgaaggcagcttttctaatagctgggagagggcgagggctttcatgaaggatggttgtgcgtgagttatcttaaccctggggtaattattcagaccatgtataatctgactttcgtgttttaatgatcttctaaagggttcataaagaaaacctgttgcgggctgggcgcggtggcgcatgcctgtaatcccagcagtttgggaggccgaggcaggcggatcacggggtcaggagattgagaccatcgtggttaacacagtgaaaccccgtctctactaaataatacaaaaaattagccgggcgtggtggcgggcacctgtagtcccagctactcgggaggctgaggcaggagaatggcgtgaacccgggagcggcttgcagtgatccgagatcgcgccactacactccagcctgggcgacagagcaagactccgtctcaaaaagaaaaaaataaaagaaaacctgttgctaaagagctaccttgtgcctccctcagagaccacactgccctgccagctcctggagagaagcagagtgtgcagccttggcatctcctatctttccgtggggcactggttgtcctggctgcccactgtgcaatcctgaaatgtttttggtccatttagcaatgccctccaaggcaggcacactgcacagtggtctaggccacaagcaggggccagcaaacgtttcccgtgcagggctggcagtgaatatgtgaggctttgcagccgcatgcagtccctgtcacagattcttcccccaccctttaaaaatgtagaaaccttggccgggcgccgtggcttgcgcctgtaattactcccagcactttgcgaggccgaggcgggcggatcacgaggtcaggagatcgagactctcctggctaacacagtgaaaccccgtgtctactaaaaatacaaaaaaattagctgggcgtggtggcgggcacctgtagtcccagctactcaggaggctgaggcaggagaatagcgtgaacccgggaggtggagcttgcagtgagccgagattgtgccactgcactccagcctgggcgacagagcgagactccatctcaaaaaaaagaagaaaaaaaaatgtagaaaccactcttagctgtcaggccctaaagaacaggcaggcacaaggaggctttgtggaggtgcccagtaaataccagctaggaagacgcgtggctgggcacctgggctttaccatcacgtgtgaacctttgtgtgtacatgttcccctgtgcacacatgggtgcctgcatcacctgtgtgcacgtgtctcagtggtggtggctcacaggtgtcctcatcattgcctgctgaccggcggtcggggccaggagctctattggcacggtgctggccctcctgctcctctctgagttaacggctgcctctttctcctggacagggatgggatccccccatacaggatccgtaagcagcaccgcagggagatgcaggagagcgtgcaggtcaatgggcgggtgcccctacctcacattcccgtaagtaccggctttgcggtcctcagcccatcgtcctccccgctcagcgtgggcctggtgaactggtccgcgggaaaggcacttgcctggcctcccacgagccaggcttacctctaggcgtaagcgtgtgatcccagcaacatctgcaagtggccagtccctgagggcagcaggggacatcaagtctcaggcagcatttagggcccagagggagctgttcattcagaagagcccccatgccccaaggccacaccctccctggtggcaggaagtgtcttgccttgtgaaggtggatgcttcccctcaagagggggagctctgagcctttctcaagactcagagcccaggcctggcccctgcacagcccttggggaaaacttggtgtttttgtggctgaacagtggtcgtctccaggtaaacgtcttgactttaaagctgccttggctttcgctgttgcatagaataatggcacctttgcccagtctcgggcatgggggcttggctgggcagtaggtcatggagctgagtgctagctggagcccagcacagcctgactccgtctacagagcattcctgcgctgatgaacagattaatgatctttccttattttgatgggttgactttgaacaggaaagatgttacgggaagatgagaaaagtgttttctttttttttttttgagataggagttttgctgtcactgcaagctctgcctcccgggttcacgtcattctcctgcctcagcctcccgagtagctgggagtacaggcgcctgccaccacgcccggctaattttttgtatttttagtagagatggggtttcaccgtattagccaggatggtctcgatctcctgacctcgtgatccgcccgtttcagcctcccaaagtgctgggattacaggtgtgagccactgcgcaacgcactgttagccgcggtgtctgaggttaaaccacgtgaccatctgagtgtctgtgcagggaagtaggcattttgagagcactgacacagtcttggtcaggatttcttagccttttagcttttctgcagacatcagtttccaagtcaggaatttctttatggttgaaaagaaaggatgttggtttgttatcacttctgagaagatgccagccaacccttgactcaggtttggctaaaactaggcactgatggtgtctacttaacaaaaagtggctgacactgtaggctgtgtgtgggtgcgtgcgtgtgtgcgtgcttgtgctgtggaagatctggggccctgcctgccaggcatggcccaaggctatcatgaggtcacagcccaagtcgagggcacctgcacagccaccggcctctgattttcaagtcacaggtcctgaacgtcaagaacccgcggagccgctgggatgacggaggcccgagagacaagacagctgagcaaccacaggcccggaacagccctctgtgcccatgaggacggggcttgagtgggctgaggcccgcgggaggcttctgtccacaggggtgccccgattttggggtgctggtcagagtcttcgtgtgtagaaagtgcatgccacagactctggatgagggggcatcaggcagacaacctcccctcagaagggtcaggaaggacagaagctgtggagtgcgttggtgcctggaacgtggacctggaaagacctctcaggatgcaacacagagaaaagaggatgcctatggcgagtccctggtgtcgtcgtcagaaccttccagaaccgagggaagcacagagccctcaggtcctggagggtcacatttgagtcgccaggaagatgaaagccaacagaggcggcaggcacagacaggagcaggccctgctgcgttccgcacccccagagggcccttgtgtggtggggtgggggccgcagtgtgcgtttctgtgtgaacagtctgcagcaaacaacctcatcggaggctctgtaggaacctgcatcaggtccatgtggcctgtcaggtggggctgtggttggaaccttcggtgggaggtccctcagccagaggcccaagtgagaaacccacatcacgggcacagctgcccggggcctgctcactgctgctactgggaaactggacccgaggatggtggtgagcagaggcggggggaggcccaggaagccgataagctagcaggacgtgccgtggttgcactgcccacttctgctctgttgagggccttggttttgcaaaagctatgccgtttctctggtgagtccatggctctgcagcagggacagcaggaggggagtagcttagacgctcataggagcagaaccctgttgtggctgcacccacggaggcccaggctgtgtgcaccttgtgagactctttaacacctgcccatcagagttggagcaggttcatcccgaaaagccccctgcccccactgtccatggaaaaattgtcttctacaaaactggtccctggtgccaaaaggttgggggccgtggctttacagcatctggtaccagaatgcgtgccctgcggggaggggcctcttcatctttagcctttacaattacttggaagtttcacgttttcatttacttggctttttcctttatgatatttttttctgttcctctaaagctggagaggttgccattctctgtaaatctgatgactctgacagttttgctgttctcagaaccgtggtgacgcagcctgcaaggccacctggagtctttttatggagctcgcgtggcggcatgagtgctcctgttggcccctcagccgtgctgctctctgggcctgatgatgggcttttcatcctgcccttggtctctgtggtgctgactgttcagaccataagcgcgtctgtctgcgcctctggctgtctgcagacacagcagccgtggtccctgcagtgctggcagctcccattcctgtgtgtgccactcccacgtctgcgccttgcccagcactgggcacggaaaagccagcatggccccccagccacccagcctccaggccccgggtgcagcgggaaagggtggcttgttagttccttgccatctgtgtggacgccctgccgtccacacacccggacacaccggcccacatccctgctggtgccagccccagccttcctcatcatcttccagaagcactggatgctcctccttggctccgggacagaccccttcctggcgctgtgcacggcccagactccagcagtgacttttcccagctctgaggcatcacccagtgtcctgggcgtgcccttggccccttcatactccacgttccttgaagtgaagcctgtggctccagggccagcctctctctgagcctcgtctactgtggaacatctgagcctggaggaggccttttgtgtggcccctgtgtccagtctcaccccatccttctcaggtttagatgctgtttctactctcattgtgtagatgagaaacgggtgcacagagccaggactgcgccagagcccacggcgggagggcaggaaggccacacacacggagggtcccacctcccatctgccaccctgcttgcttgtcacaggggagctgtccctggctgcatccctccgcggcttagacactggcggcctggattttaaaacatgttttgctatgaaggatgttattggagcagctggcaaaattggaataagatctgccacgtgatgttattgtatcagggtcagtttttttaaccatccatatttgtactgtggttaggtatgagagcgaccttgcttttgttaaatacactctaactggttcagaaaagtgagcgtgcctgtgtgtgtgcgtgtgtgtgtacgtgtgtgtgggtgtgtgtgcctgcgcatgtgtgggcatgtgtgtgtacgcatgtgcctgccggtaaggggatgataaagcagttatggcagaatgtgagcccttggggaatctgggtgaaggtggacgggaattccttgttctatttttgcagctgttttgaagtttgaaatttaaaatgaagtacccttgaaagttacacagggccaggcgtggtggctcacaccggtaatcccagtgctttgggaggcctaggtgggaggagtttgaggccagcctggacagcaagacccccatctctatttttaaaaaaagctataggggggccgggtgcagtggctcacgcctgtaatcccagcactttgggaggctgaggcaggcggatcacgaggtcaggagattgagaccatcctggctaacacggtgaaatcctgtctctactaaaaatacaaaaaaattagccgggcatggtggcaggcgcctgtagtcccagctactcgggaggctgaggcaggagaatggcgtgaacccgggaggcggagcttgcagtgagccgaaatcgcgccactacactccagcctgggtgacagagcgagaccctgtctcaaaaacaaaaacaaaaaaaaccaaaaacaaacaagctatatggtatattactataaaatacattgcagatgtattgttattattttgagacagggtctcactctttcacccaggctgcagggcagtggcatgatctcggctcactgcagccttgatctcccaggacttatgcgatccgatcctcccacctcagcctcccaagtagtcggaaccacaggtgccaccacacccggctaattaaaaaaaatttttgtttgtagagatgaggtctcactttgttggccagactggtctcttaatttctgggctcaagtaatctgctcgcctctgcttcccaaaatgctgtgactgtaggcgtgagccaccacctggcctttagattcttttaaaaaggaaagcctgcctttcccagacctcccctgtcctccaaatcctgggcgtccttccctgccgtggggcctcgggggccttctgctcacaccttctgcaggcgtctcctcgagtgcttctctgaagtgggtggggagcgccggctgtgtgtcctgaagctgccctgctcaggcctcttgatctggtagtcgggagacgctggaaagaagcagccctgtctcctgggtccgtggggaatgaaggacagactggccggacacgaaaagggggaccgtgaggaagttgattcccaactgaaaggaggaaaaagtaaactcttgctttaaaatacaacaaaggccgggcccggtggctcacacctgtaatcccagcactttgggaggctgaggtgggcagatcacctgaggtcaggagttcgagaccagcctggccaacatgacgaaaccccatccctactaagaatacaaaaattagccaggcgtggtggcgggcacctgtagtcccagctacttgggagaccgaggcaggagaatcgcttgaacccgggaagcagaggttgcagtgagccaagatcacgccattgcactccagcctgggtgacagagcaagagtttgtctcaaaaaaataaaataaaatacaacagagatagcacacgctctttcccttcacaaagaaatgtttagcctgtgacctttcaacccccgtgcctcacagtcctgtccctcgcagcgcacgtaccgggtgccgaaggaggtccgcgtggagcctcagaagttcgcggaggagctcatccaccgcctggaggctgtgcagcgcacgcgggaggccgaggagaagctggaggagcggctgaagcgcgtgcgcatggtgagtgggccgcgtcggtgtcgcgctccgcgtcggtgtcgtgctgttttcttgccgccgggatgtcctgatgttcttcatggggatgcccggggctggccgaggcctgctgacccatgaggcctcccggctgagtcccctgttcccctttctctgcagccgagccccagctcaagatgggatgtcccagcggccccatgccaccctcagaggcccagagacccaccttggtcacctgcattgaaggggccgggggtgacacggctgcctgctgtgtacctgatcctttgtgggtggcagggccacaagctgagactgcagcgggtgatctcaacttcttcaccccgtgtggctggcaagtgagatgagcatgtgcagagcaggaagggctagtggcgtgcagtcgggggctgcgatgcctgagactttctgccacctcctggtcacttttggttccttgaggccatggtgcacggccctctaggcacttgtgttgtaggactctttgcttagttcagctaaaaacaggtccctttcacatggccacgaaaaattaggctcacagacaattcgaagggtgagaaggacagagtttattgggtgaaaaggtaaaaagggaaacgggcgggcgagtggctcacacctgtaatcccagcaattttgggaggccgaggcgggcggatcacctgaggtcaggagtttgagaccagcctggccaaaatggtgaaaccccatctctaatgaaaaatacaaaaattagccgggttggtgtcaggtgcctgtaatcccaactactcaggaggctgaggctggagaatcgcttgaacccaggaggcagaggcttcagtgtgccaagattgcgccactgccctccagcctggatgacaagagtgaaactctacctcaaaaaaaaaaaaaatcacttcccgcaaagccagagttctgctagtgtgcttcccgcctcgcagattgaatcccaggttccacctaggaagacgcggggcctggctcctccccgctgcaaatggtgcagacttctgtggctccaccccagtgtgcgctcctcccagtgcgcaggccggctggagtttctctggagaccccttcccacctggtcgtctcacttgcaaggctgcctttgctggccgggcgggcagtgcacacctgtgaccccaacactatgggaggctgaggcgagtgaagcacttgagccgaggagtttgagcccagcctgggcaatgtggcaaattcctgtctctagaaaaaatttcaaaattagctgggcgtggtggcacacacctgtggtcccaggtattcaggaagctgaggtgggaggatcacttgagcccaggaggtcaggtctacagtgagccgaggctgtgccactgcactccagcctgggtgccaaaaaaaaatgcctttgcttttctcttagccagattaattcctatgggaggtcagtgggcaccatcgagtcggggggtggtccttcattctcctttcaatgttcgtgaatatgaatacttagaaaatgtatacacttctgagcgtttccattcacctgatccttgatgtaaaatgcagaccttcagctctcctcagaccacaggagacccctcggtacactcactctttcacccgctacccgggtgagctgtgccctgaagcctggagatgccaccgtgagggtggacgcagggtgccgctggtggtgcccatctgggaaaccgtgcgccgggcactccattgagatggcaggcagaccttacatagctcgttgagcagctgggattcatggcggggaccaggtgtggtcgctgcagatggtggagctccccatgaaggggtttgtgtggaaatgtctcacacacagacgtcgatttgttttatcctcagtaaattgttttgccaccatgtggagctgcatcctctcgtctcccctggccgttggtctgagggtgaccctcatctgggtagggcacaggtgtgggtggtgccagctccagggctctgcaggtgccaagttcaccttctccacagtcccccaaggaaaggactcagggaatttgtcctccaatatcgggaacctagccggggccgcagggctggcaggagcagcatcagtgccgcgtggtccctgtggcggtgagagtgaggcctcgccttgcagacctggtggtcactggagcggctcgcttgcttcctggggtggccctgaggaggctggctgtgcgcacctgaggccagcggcattggggcctgcctgggagccttactgggctgttgtctgaaaaccaaacattgggaacagagttaccaagaatatggacatgtccgcaggccacatccgggcccacgggctgtgacgtcagcatcatcatttgggtggcaggtgaaggttagcagcccttaaacaaacatgctcacaacagaaacgtaagaaaggaagcctttgctgttttgctgccgtgttggccgctgtcattttctgcagaagcctttgctgttttgttgttgtgtcggtcgccggccgctgtaattttctgtggaacgctttgctgtcatgttggccgtctgtaattttctgatctttgcgccttcacccgttcgcagggtgtgcttctagtagggcaggttcccattttgagtgagacattttttaaaaaaaatatttttgtagagatggaatcttgctatattacccacactggtcttgaactcctggcctcaagtgatcctcctacctcagcttcccgaagtgctgggatttcaggcacgagccaccgtgcctggccttaagcaagacatgttaaaggcaggcgtagccacaggtgctgagtgtgtggctctcacctgtgactctcaaggcttccccaccccatggagtcctggctctgtcccagcaacagggagcatggcagtgcccacaggtgtgtggatccagcaccaccagggcccaggagtggtggtccttccctaaaaggaataactccagttttttttttttttttgctttgttttgttttgttttttgaggcagagtctcgctctgtcgcccaggctggagtgcagtggcacgatctcagctcactgcaagctctgcctcccgggttcacgccattctcctgcctcagcctccccagtagctgggactacaggcgcccaccatcacgcccggctaatttttttgtatttttagtagagacggggtttcaccatgttagccaggatggtctcgatctcccgaccttgtgatccacccgcctcggcctcccaaagtgctgggattacaggcgtgaactccagattttttaaataacctattttcattgtgaaatttgggaaattaaagcacaaagaagaaaacaaaaaccattagccgagtggttaagttaatctgtaacatttcacagccccatgatagaattcctgccgatgtggagctcggccaaggcagtgaacggcatcaaaactccaaacacttttagtccctaggaagaccctcggttaagatttctccccagagtgcccgggccctttagtcctacaaaaccaaggaaagggaggcagcatagctgcatccgccaggggatgcccaccacccacctgtcccccggctctgctccagcatccgtctgtcctctttagtgccatatttcaccctcagccccagtgcaggtgcccgcagccaagcccacaccagctctggggcacgcctgttccagttgcatttggatacttttgcaggtgtgagagttgggtgctaaacgttgggaggtttgtttatattaaaatatagaggtaggtggggcacagtggctcacatctgtaatcccaacactttgagaggccaagacagaaggatcacttgaggccaggaatttaagagcaggttggacaacatagtgagattccccatctctacaaaaaaaaaagaaaaagaaaaaattaatgggacatggtggcatgcacctgtagtcccagctacttggcaggctgaagcaggaggatcgcttgacccctggaggttgaggctgccttgagctgtgatggcaccactgcgattaggtgtggtggctcacacctgtaatcctagcactttgggaggccaaggtgggtggatcacctgaggtcaggagttcgagaccagcctggcaaacagggtgaaacccagtctctactaaaaatacaaaaaatttagctgggcatggtggtgggtgcctgtaatcccagctacccgggaggctgaggcaggagaattacttgaacccgggaggcggagattgcactacagcctgggacacaagagtgaaactccgtctcaaaaaaaaattaaataaataaaaataggccgggcacggtggctcacacttgtaatcccagcactttgggaggccgaggtgggcagatcacgaggtcgggagatcgagaccatcctggctaacacggtgaaactccatctctactaaaaatataaaaaattagccgggcgtggtggcgggcacctgtagtcccagctactgggcaggctgaggcaggagaatggtgtgaacccgggagacggaggttgcagtgagccgagatcgtgccactgcactccagcctgggtgacagagcgagactctgtctcaaaaaaatgaaaataaataggccggttgtggtggctcactcctgtaatcccagcactttgggaggccgagggtggtggattacctgaggttaggagtttgagaccagcctggccaacatggtgaaaccccgtctctactaaaaatacaaaaaaattaggcaggcatggtggcacactcctataatcccagctactcggtaggctgaggcaggaggattgcttgagcccgggaggtggaggttgcagtgagccaagatcgtgccactgcactccagcctggctgacagagcgactctgactctaaataaataaatacatacatagatacatggtaacttagttccctctctttcttttgtattgacaccagatttactcaatactgttttagtttgtcagtccaataagatgagaaaataagtatgagatgcaacttggaattaaagtgatcaaatgtttgctctgacagataagcttcagcacctgttaacttggagaatcaagtgaaactccaccggcttcatgtggaagctcgtcaggcagcatcacaacatgtacataacccaagagccgttctgtacaaggttctccttaaaatataatgggaggccgggcgcggcggctcatgcctgtcatcccaacactttgggaggccgaggtgggtggatcatgaggtcaggagttcgagaccagcctggccaacatagtgaaatcctgtctctactaaaaatacaaaaattagctgggtgtggtggcgcacacctgtagtctcagctacttgggaggctgaaggaggagaatcacttgaacccaggaggcagaggttgcagggagccgagatggcaccattgcactccagcctgggtaacagagcaagactctgtctcaaaaaatatatatatatacaggccaaggcaggcagattgcttgagctcaggcattcgagaccagcctggccaatatggtgagaatcgcatctgtccccaaagtacaaaaaaattagctgggcgtggtggcacacggctgtggtctccgctattctggaggctgaggtgggaggatcgcttgagcctaggaggcggaggctgcagtgagctgagatcacaccactgttctccagcctgggcaacagagcaagaacttgtctcaaaaaaagaataaaactaaactaaatctgtgcagagctctgcccacagccgatacatacgctgcattccttgaggccttgctgtctccgctccttctgtctatgccccgtcctgcctctccatcctcagggacaggaccggtggcgaggggcccccggccaccctgggctgggacggcatctgctggggctgctgggtcaggcctgatgctttttgttttccccaagtgtgcagctggtgctgagaggtgatggtgctgcttgtccccacacaggaggaggaaggtgaggacggcgatccatcgtcagggcccccagggccgtgtcacaagctgcctcccgcccccgcttggcaccacttcccgccccgctgtgtggacatgggctgtgccgggctccgggatgcacacgaggagaaccctgagagcatcctggacgagcacgtacagcgtgtgctgaggacacctggccgccagtcgcctgggcctggccatcgctccccggacagtgggcacgtggccaagatgccagtggcactggggggtgccgcctcggggcacgggaagcacgtacccaagtcaggggcgaagctggacgcggccggcctgcaccaccaccgacacgtccaccaccacgtccaccacagcacagcccggcccaaggagcaggtggaggccgaggccacccgcagggcccagagcagcttcgcctggggcctggaaccacacagccatggggcaaggtcccgaggctactcagagagtgttggcgctgcccccaacgccagtgatggcctcgcccacaggtgagcgtgcgcctgtcagtgaggagggggcttggggtgaggctgtgtccctgcagaaggccagaacctcctcataaaactcaggaaacccaggaccgccagcaacaggcaggaggcccctctgctggagggagtggactgggccctgggtcaggggagtccacgccgtgacctcaggtgggagatgaaggttaggggacacagcccgaccctggctcccgctctggccctcagtcttcagggggtgagcagtgactgcctgtgtgtttagagaggaaaccaacccccagacagcaccaggacagcgggcaggggacagcgggtgggggacaagctggcgggggacagcgggtgggggacaagcgggcaggggacagcgggcggcggctgcaccacgggagccttacagatgccaggagggggcctcgcagacgaggaaggggcacagcctcggccaccggaggccagggcgactcgcagctcttgcccttgcagtgggaaggtgggcgtggcgtgcaaaagaaatgccaagaaggctgagtcggggaagagcgccagcaccgaggtgccaggtgcctcggaggatgcggagaagaaccagaaaatcatgcagtggatcattgagggggaaaaggagatcagcaggcaccgcaggaccggccacgggtgagcaccccgcacgcagccagcctcgtggggcctgctttgccacccctggcctccgcacagtctcagtgtgtgcagcttcagtgtgtgtggcgagtgtcgcctgtgacgcctcacacttcccctgtcactgtggcaccctcccgggcaccctccagcaggctccctgggccccacgtctccaggaggaaaacctcatgtccccagagagaggctgtccctgaagccccgagcaggagggaagctgacgtggctgtcaccccgcaggcagcacagatgctctcgggaggtcatttccagtctgacccccacatgagaatgacctaagtcacctgggaaggcccccactgaccatcactcccgaggtgcccacggaggagccttctgtgctcacacctggccgtcctgctgagggctggggaaggctcttgtgtagcgtgagcacttctctcctcccagaagggcagaggcctcgtgtgtggtgtggagcaaggccccggcgccacaggtccagcccctgccgctgcccgccgggccggtcttggtgttgctcctgctcgccccctgggcctgcactcgtgcccggaacccagcaggagggccaggggccccacagaggtggtaccccccaccttcctgtcgtggtcagaggcaggtcagctgggaagtgttggccctggtgggtggatggccccagcttcctcagacttaggtcctgatctgccccccaccctcacccaggccctggccaggacgcatctccctccacattacttgatgagaacttgtgaggcagctgagcgcctggggcgtggccctcctgcctgtgttggaagcctgtcccgcaaggccttggggtccccatcggtgctgactgaggtggggacgggctcatcgtttttctggggctcccgagggaacaggggtgcacagcaccttgcctggctcattttttgtagagggggtctcagtgtgttgcccagctgggtctcaagcttttgggctcaagtgatcctcccaccttggcctcccaaaatgctgggactacaggcatgagccaccattcctggccttcgagtctttttttttgagacggagtctagctctgtcgcccgggctggagtgcagtggtgcaatcttggctaactgcaacctccacctcctgggttcaagcaattctcctgcctcagcctcccgagtagctgggattacaggcgtgagccaccacgcccggctgatttttgtatttttagtagagaccggggcagggggtggttgccatgttaggctgatctcgaactcccaacctttggtgatccgcctgcctcggcctcctggagtgctaggattacaggcgtgagccaccgtgcccggccgaatcctttttttaaatagctgtatatactaaatattgcatgtcccatattttaggataagtattaatacattccactttgagacatacttatactttttattcattaagactttttttttaattttttgcgacagagtctccctctgtcaccctggctgaagtgcagtggtgtaatcacaccgttcactgcagtctcagcctcctggactcaaagctatccgccggcctctaggattagtatataatttgtatcccagtaaagctgttaaaaataaaatgtaaaaaaagaagcctcatcccagcactttgggaggccgaggcaggtggatcgcttgaggtccggagttcgagaccagactggccaacatgacaaaaactccatctctactaaaaaaaatacaaaaaattagccgtgtgtggtggcgagtgccagtaatcccagctactcggtggctgaggcaggagagtcgcttgaacctgggaggcggagattgcagtgagccgagatccgaggtcgagccattgcactgcagcctgggcaacaagagcaaaactctgtctcaaaaaaagaaaaaaaaaaagtctccatgaaagaattttttttttttttttttgagacggagtcttgctctgttgcccaggctggagtgcagtggcctgatctcagctcactgcaagcctcgcctcccgggttcatgccattctcctgcctcagcctcaagagcagctgggactgcaggcgcccgccaccacgcccggctaattttttgtatttttttagtagaggtggggtttcaccgtgttagccaggacggtctcgatctcttgacctcgtgatccgccctcctcagcctcccaaagtgctgggattacaggcgtgagccaccgcgcctggcctttttttttttttttttttttttttgagatggggtttcgctcctgtggctcaggctggagtgcaacaggccagtgtcaacgcactgcaacctccacctcccaggttcaagtggttctcctgtctaacccacctgagtagctgggattacaggcacccactattatgcccagttaactttttgtatttttgtagaaacagggtttcaccatgttggccaggctggtcttgaactcctgacctcagatgatccacccgcctcggcctcccagcgtgctgggattaccgcgcctggccattttttttttttttttttttttttgagatggagtctcactcttgcctaggctggagtgcagtggtgcaatctcagctcaccgcaacctctgcctcccaggttcaagcgattctcctgcctcagcctcccgagtaactagaattactggtatccaccaccacacttgggtaattttttgtattttttgagtagagtcatggttttgccatgttggccaggctgttcttgaactcctgacctcaggcgatccacccaccttggcctcccagagtattgggattacaggcaaatgagggttggttttttgttgtcttttttattcctgagactgagcctcactctgtcacccaggctggagtgcggtggcgtgatcccggctcactgtaacctccacttccccagttccagccattctcgggccccagcctccagagtagcagggatgacaggcgcccagctaattttgtatatttagtagcgatgaggtttcaccatgttaggttgatctcgaactcccgacctctggtgatctgcccgcctcggcctcccgaaatgctgggattacaggtgtgagccaccatgcctggccgggatgtttttattgtgtggtctgtggaggacgtccatgtggcttggtggccaggccccagtgccccatcccatcctatccctcaaggaggctgcccttgtgagatgagtgtagccccaccaggccacctggccagggtgtcggccacagtcacaacttgttctcttgttccccaaggtcttcggggacgaggaagccacagccccatgagaactccagacccttgtcccttgagcacccctgggccggccctcagctccggacctccgtgcagccctcccacctcttcatccaagaccccaccatgccaccccacccagctcccaaccccctaacccagctggaggaggcgcgccgacgtctggaggaggaagaaaagagagccagccgagcaccctccaagcagaggtacggccgcgtcgtggggtggggtgggtcttgggggttaccacagcaccactcctggggctgaagctccccgaggcctgaggtcttcaggggaaaaacggccctctgggtgtcccccagccatactgggcccttccatccactgagaaccactgaggggccacgtggcaggccaccctgcggtggacggaggctggggctggagctttcacacacccgaggccgccgcgctcattgctctggaggcggggtccctcctcaacctgagcccagtctgcagggaggctgcagggccccagtgtgtggggaacgccggtccccagccagaggctgctcgctgctgggcagcctgggctttagggcagaggtcctggaggcatggcggctgcctcttgacagttgcgtcccaggagccctgagtggctctgcacggtcggaaagctacgtggttctgaaagccgtgcagatgtagaagtgtcgtcctggacgtccagcccacagccctcctcgctgtgtcctcttgtcatcctggatgtccagcccacagccctcctcactgtgcccttctctcatccgggacgtccagcccacagccctcctcactgcgccctccttggtcttctgggctccgtagccagaccctgttctctccctagggcagggaggcttctgtctgggctgcagggaggtctcccctttgtgtgggcagcattttcgctccaggccagaacctggcttctccattttcagcttgctcataaggccagttttctcggccatcctgggtcattggaattccccacagatcagtgtctctttgagggtcctgggagcctatagctcacccaggccctggggctgtggtcacagaggccatggttgccttcagaggtcaccagctcctcctgtccaccttgggtcacctggggcctggggtccaggcccgcctcccgggcctccagctttggggctgtgccactccagggaggctgtggctaggggccttattctgccgaaccagcatcagggttcagacccttcccagctgaaagcctgtgtggtctcaagtcattaaaggttcctgagcttctgccaggctgtgagcctaatgacagctctggggccagaaagggtcacagttacctcaaacccaaagggtgaccactttatgaccaaacatctgtgaccctgtgatcgtgttcggccaacaaggagctggagccccctgccatgcaggagcctggagtgtggtgctcggagccggggcgtgtgactgggctggcagatgagccgtggtgggcatcgtgtgcagcaggtccgaggccctgggcgtgtgtgggctctcctgccggggcttcctgagccatccttgctgggctgagcaggggtctctcaggttgcgtctgcgctttcccctggtacccgtggccccacatgatggcaggggatgcccgctgagccgtgggaccactcccgccgttctgagacacgaccctcccgcccgtttggctgctgggctccagcatccccccatggggaaacccagagttgctgggtttgtccgtccaggggatgtgggtttttgcgagaagctgtggagacggagtgaaggcccagaggcaggttgggtgctgggccctgtcaggatgtcagagtagaaaccaccatcaaggtcgcccagtgtaccccggtggaggtgtccacgtgagaggagctgctgtgctgccccaggatggcctcagttgtggcgccggggggccctcagcctccctgaggtgcagaccgagttgccacgcacgccccagagccagtgtccacgctatcggtggggaattcatgccaagagactgaaggacagactctcgggacgagatgtcatcccaccagaggggatgaggtggtgggatcccagcacccctgatcggaagctccccaaagtgcggtccagggaactcagggggttggtgccgggatcatgaatgtggggcgcgctgcagtatcgggtaccaccaaggcaggcctaggaggggactcggtgtcttgtctaccctgcaaactggagcctgcgcagggtgggttgttcgggcccttcacgctccgtccgtccctgcgcagcagcattggtcgaggctccctccccagggctggtggccgccggcacagccacctttgacgcgggttgttccctaggtatgtgcaggaggttatgcggcggggacgcgcctgcgtcaggccagcgtgcgcgccggtgctgcacgtggtaccagccgtgtcggacatggagctctccgagacagagtacgtgcgtcctgagggtcctcccggtcctgcccaccccagccctggcgtcccaagccaggtcccatcgtagagccgccgtcccggggcttgagctcgggtaccacgctcagaagcagctgtggcaggagagggtcccgtggcatcagactcgaagctgcccgagagccttctcctgtctccatcaaaggagacgctgactgtccagcatgatgacaagtgaccaaaaggcccggctggaggcctgggcacagccagcccctgcatccacacaggtgtcacggccaggcttcctgtggggcagagacctgcctgcgcctccacccggcttggaacgggccggtccctgccaggcctgacttgaccaggctcggggctgcaggtgctgaggtgcccggggtgcgtctgcttgcagtgtgggtctcagccatgcgtgtctgtccagcccgtgcagtcagtgagtcggggctctgctcccacctacaatgctgactgctctgaacccgtgagaaagggctcagaccatgtgatcccacatgggccgtgtcgacggcgcctttatgtgctcaaggtggcaggaggagggggcacaccccaaaaggggccttgagaacaagggtcccccaggccttgccaggcttgccccagatgcaggtttgttgtggccctcatcgtgtaggcggtcttggggcagccttcacctgtccctggggcagcccccacgtgttggctcttctctgatgggcctggctccaggaggctccgaggatgtggcactgggaggacgtctaagagcgcacgtggctgggggcctggtgtgcaaagaggatggtcacatggctcaggtggccatgaggccttcctgccctggtgttggctctggaagcctctggtgcacccagccaggaggaggcccaagggctgaaccccagtgggccaggggcagcttctggagtcacttgaaggacaggtggcggcggggtagccgagtggggggtgcgagagcaaccaggccccgcccgtcatcccggcacggctgtggaagcacagcacctgtcagaggagggcccggctcagcctgggcaggagacggtgccagccctgccccctctgaagggcctgctggccacccccgccccagtcctccgacaaacttcgctgcggggtcaggcttatccagaaatcgtgcacagttctgtttgtccaatccctgcccttcagatgtttttaaggtttgggggccgtaggtcttcctgagataggagccctgcagcctgccctgccatcctagaggtgggagctgcagtgcacctggcagccaggccctggccagtcgagggtggggctgtgaggcagcagggagaccttcgtgctcccagtgagcggagccgactccactgctagcggactagatcccagattgagatgctgtgcgggggctgcgggccccaggtgtttgaatggggtgctgctcacccctgcaggcctgccccgccttacactggcagcctgaggccagcaggagggaccctgtgggacctcagtccaaaaccaggtaccaccgctgcatctctttccccaggacaagatcgcagaggaaggtgggcggcgggagtgcccagccgtgtgacagcatcgttgtggcgtactacttctgcggggaacccatcccctaccgcaccctggtgaggggccgcgctgtcaccctgggccagttcaaggagctgctgaccaaaaagggcagctacaggtgagtgtgagggctggggtgccccctccccgcacgagtatgtgggtgcccaacggtatgaaaaagagggtttccagccgggcacagtggctcacgtcctaatcctggcactttgggaggctgaggtgggcggattgcctcagctcagcagttcgagaccagcctgggcaacatggtgaaaccccgtctctactaaaaatactaaagaaattagccaggtgtgctacttgggaggctgaggcagaattgcttgaactcgggaggcagaggttgcagtgagctgagatcacgccactgctctccagcctgggtgacagagcgagactctgtctctacccccgcccaaaaaaaaaaaaagaagaaaaagggcttccggccatttcagctcatgtccctcatctgcaactaaagccacttctccaagccctaggctgagggtggcatcaggctttcggccccacaggactgagagggtccaaagggacccccgtccagggccctcatcttcggggtgggaaaacagaggccagacccctagacgacgatggtctgaaccttgtgttaggctcccctaggccgaccttgtctccaggctctggactcatgtgcttttgcctgactgaaaagccaagccccctcctaccaaggttcattcgccctgggccactcagccctgcagggccctgcgtgcagccagccttggaggctcccgagtgagcactgggcggtgagcagagggggcctgaccccaagagcctggcagagcctggcgggtggttcccaccgtccacaagccactgtgcaaacaccccatgactgcagatgtggtgctgagggagggccccagttggggtcacctccatgacggggctcagcccttgggaagcagacaccccacacccgtccacttcccccctgcaactcctgagaggctggggcaggtactcccagggggatgtggggtgctcccagcaggcagtgaactcaccccccatggctgcccacttcacccacatgtggtcattgcactgttcactgttgccctgggagggggcgcacatgcagtgggggccgtggggcatggacaggaggctcctcgggatggggtgtggacacgccgtcccctgccacaggcctccttcccatctgcggtgctgcctgctcactgccctcctcacctccgtcctgcagatactacttcaagaaagtgagcgacgagtttgactgtggggtggtgtttgaggaggttcgagaggacgaggccgtcctgcccgtctttgaggagaagatcatcggcaaagtggagaaggtggactgataggctggtgggctggccgctgtgccaggcgaggcccttggcgggcacgggtgtcacggccaggcagatgacctcgtactcaggagcccgatggggaacagtgttgggtgtaccacccatccctgtggtctacccgtgtctagaggcaggtagggggtccctccaagtggtccacaagcttctgtcctgcccccaaggaggcagcctggaccactcctcatagcaatacttggagggcccagcccaagtgaggcagccgaggtccctgctgccagcttcaggtgacccccccccatcccccggcacctcccttgggcacgtgtgctgggatctactttccctctgggatttgcccacgtacccaggtctgggtggggcccaggcccggatgcagaggcctgcagggcctctgtcaattgtacgcgccaccgagtgccttcaacacagcttgtctcttgcctgccactgtgtgaatcggcgacggagcactgcacctgcctccagccgccggctgtgcagtcctgggtcctcctttctgagggcccgtgtaaatatgtacatttctcaggctaggccagcaggggctgcccgagtctgtttttcatgcgatgacacttgtacaattaattatcttttcaaaggtacttggataataatgaaataaaactgtttttgaacctgc

SEQ ID NO: 11 - DNA, 33085 bp, Homo sapiens
cggctgtgattggcgcggcgggatcactggctccgcgagcctggcccgggggagtcggctggagccggctgcgctttgataaggtcctggcaactcagtaacagcccgagagccgggaaataaaaataacccctcagagcgatggatttcggggccgcccggcggccgaggcgcccgccgaaggccctgctgtaaaaggtgggggtggaagctcggccccagcggagccgcttcaaagaaagcccccctcttacagggggcgaggtcgcgccgagccgcggcgtgggcgcggggggcgggagggggcccggccaggcggaggccgggcctggaggggggcgcgggcggggcggccctgcggagcggtggcggggctgcggggggcggcccggggcgcggccggcgcgtacctccctttcaggaccgtgcgctcggctcgcgcctttgaagtgcacagttaaatccacagcgcagtttttgttggaagcgcccggaggacatttggtgcgccgagtgactgctggaaacaggacctgcgttgaaagccgggccgggcgggggcggaggcccgctcggatcttttgcataaaaggggcggcggggcgcgccgttccccctccccggccggtggctttcgctctgaacccgggattgttgtttcccgcaccccctcccccgccgcacgactccccatgttccccgacgccgcggccggcccgggggggcccggggctgccgccgcgagccgagccgggggccggggccgggcccctgccaggggcgcctgcgaggtctcgccgccgagcgcgcgcggggatcaatggtgagtgccgaggccgaggcggccgggcggaccgcgcgctttgatgtgcggggcggccctttgaagttggcaggccggctatttcggggcgcgctaggggccggcgcggaggggagcggcggacccggcgcccagcgttccggggggcttggccgggcagccttgcgcgccctgcgccggagccccctccccagcgcggtgaccgggttggcggggggcccagagaggagacttatccgagtggcggcagtggcgggggcggagagggggcagataccccccgggggtcgcgtcgctgtcgcggttatggatgtgagtcggcgtgtgagtgcgcgcgggagtgcctttgggaggtgggatgaaagggtagcggcgccccccgcttgccctcccccgccccccgcctctcctccgccccatcctctcctcctacttctcttccccctccccttttcccctccctgccgcgggtccgcgctaaggggcccacagcgctggcggaggctcagtctgcgcgcaggaccggcccaagtccggggcgcccgtgtccctcgcgtccctcctcccggcccgggcccctcgcccgtggccgccccggccccttttgcggagaggcagagactccgcgcgtcgccatttctggactaggctgctgctttctgtgctttttctgcgggcgcctctgcaaacggcggcgccggggaccgaccccccgcccgggctcggggcgctgctggcgtgtcccggggttccggcctcgaggtgtgcccgccagggctctggaggcgttcagttgcatttgggccgggggaccgggccggaggggctcggaggacatgagagcctggcttcggcggccttcgtcttccaggtaacggggccgctccacctcccaccgcccgggtagcgcggtgccaacggcagccccacttctccgtgggccgcgccgcccagccccgcggctcgaggctctggtcgggttcagcgtgcacccatcccagatccggggtccctggcttctcgcccggggttgcaccccgttcagcccctacccttcttagtttgatcttttccgtgctagggaaagcagcttgtttattggttagataagacttttttctttggaaaaaagacaggcttgaaatcagtagagtttgggattcttggcacaggcagtagtggcgtgagacggctggtgatccagttttgtaggtttcgcggatccgggaggtgggttgggggcacgggggcgacggttccgaggcttctcagctctctctcaaagtttgaagatgaaagtctcccctgagtgagttggtttctggtttggggggaggtcagggaagacagaggtgttgactgagctggattcttggtgggggtagggggcgcgtagcgaacactcaaatctgagttggggagggggtgtttgcgtgctgaatctgggagtccgggagcccaatccgcctatgctgggcgggcttctcttgggccaggatcttctgaatttttaaggagtgggaagagggagcgcagagggagggggtgggtggggagaatgggaaccagatgccggggaagggcacgtttggagctcgagttatctgtgcagggccgagtggggaaatataccgaaattggtttcacctgcacacagcctagcggctgggagtgcgcctttttggagttgatggtatcgggggaggggaagggagggaaggcgaggcgcgggctgagctgccctgcgtgcgccctggccgagtgggtttttggaaggttgtgtcttacacctccagtgtccccctgccgtccccagctcttgccttcctctcaccttccccgcctctttcccaacagctccctcccacccccaaccccgaaaagtgtgcagggagctcagatttcgcttttgaaaagcagcgcctgatactttagatgagcacctcgcagatagctgggttgcttgatttgaatttgaggagttgaaaagcctgtttactttcttgctttgatgttgggtagatctggttttgattagatcaatacccttttctctctccccacctccccccttccttttctttccagagaggaggttcagatgagcccctgctgacttgagagagacagagagaccacgccgattgctgagaggaactggaagaagaaaaattcccagactcagtgggaagagctccctcaccatgagtagcgctatgttggtgacttgcctcccggaccccagcagcagcttccgtgaggatgccccgcggcccccagtgccaggggaagaaggggagaccccaccgtgtcagccaggggtgggcaagggccaggtcaccaaacccatgcctgtctcttccaacaccaggcggaacgaagatgggttgggggagccggaggggcgggcatctccggattcccctctgacccggtggaccaagtccttacactccttattgggcgatcaagacggtgcttacctgttccgaactttcctggagagggagaaatgcgtggataccttagacttctggtttgcctgcaatggattcaggcagatgaacctgaaggataccaaaactttacgagtagccaaagcgatctacaaaaggtacattgagaacaacagcattgtctccaagcagctgaagcctgccaccaagacctacataagagatggcatcaagaagcagcagattgattccatcatgtttgaccaggcgcagaccgagatccagtcggtgatggaggaaaatgcctaccagatgtttttgacttctgatatatacctcgaatatgtgaggagtgggggagaaaacacagcttacatgagtaatgggggactcgggagcctaaaggtcgtgtgtggctatctccccaccttgaatgaagaagaggagtggacttgtgccgacttcaagtgcaaactttcgccaaccgtggttggcttgtccagcaaaactctgagggccacggcgagtgtgaggtccacggaaactgttgacagtggatacaggtaagactttgacgggggcgggtgggctgatgctgtggactttgcagatgttttaagtatggtggatgggtggatgggtgtgctgcagagactgacaggtctgttgagttaggactgctggccatgaaccctttttgatcttgctttttgttgttgaaacagggggaaagcgatgcacatacagtaaatacctgcagtcttccagtgctgacttcaaacagtggcaagcagtattcactaatgtgggttacttattatcccgggctagtgtctcagaagaggttgagagagagagagaggacagcagcttttgatgcctctgagtcaccagatccactaagcgccggttttggaaggggtcacttcaccactaatcagtagagggtggaattaatgtggctagggaggcagctgggttgtggtggaggcacaggaaataatatgtgcacccattgaggggtaagtgggatttttttttgaacttttctgttaagataagagccagcaattggcttaactgagcttgtggttccctttgtagaattagatatttacccagcaagaaaggcctctaactagggaaggtcctgtgactttcccaaatgaaggacccttacctttagagcttgctggcatattaatccaggttttaaatgctcatgagtccgagggtcagacttcagttgattattttgttagtgctgatggagaagagatcttggcccgggagtactggggccctggagtactttctctttgaggcttcaaagacaaatagttctttgcagaatggccaagtcttaagattcttgacctttggaggcaacttcagacctcttgttagaatgagtttttctgttttctcccctcctcccgacttccaaatatccgaaaagagaatgagcctcttaattccggggtgtggttttatgacaggcaggggatggggctgcacttgactgctctctgaatgatttatcttgctctctgtgtgaatttctctgtgtgttaggggcccaggatgcggtctgatagctgcctctggatttccctttctctgtaggatgtggtctctagtgcccagcagcaggaagagaggtgggcaccagatggttgatcttgagcctctcagggtggccaggtctgagcctagcgggccatgattttaggggcggcagagagagttgactgttggcgaggagaggaagggcttgttctccaaccaccagggggcgcgcttgtggcttgggaaccagttttactcagacatctggtctacacctaagtggaaccaggttgacttttgcaaggaaacacaggttccagggaggtgtttcagtgtctttatgcttgtggagtcaagttgtctgggaggaagatcctgggtctggcctctgcagtaggtcagtcgccgggcacctgctacgcctgcccgccccattatgagaccatttgggtaagcctctggcgctggcctccttgccctctagcctggcagccagagctgagactacttaagagccgtggtaaaggctgcttctccaggggcctcctgactggggcttctgtgtctcccactgccgggaccagagtgtcaccttcgtaaatagcacagtgtgtggttttggacgccctccccaggcagggctctgctgtgaaccctcccctttgtgggtgggcagttgcgactcagcctgggcttgcctcatctgggatattaccaggatgcaactcatgaagcttttgagatccagaaggcagggacagaagctcctgttttccagggctgccttcttggctgtgaaccgtggacatcactgataaagaggtgacagcttgtcattgacctgagagtttccatacgagattcacgtgtgccttctcccactgttgggttgagatgaagcatcttaaaggactctctgaagctcatatgtcttaactgggcatatttaaagagaatttaagacatagccagatgatctcacatcattttaacgtgcaagatattcgagtgtgtgcacagtgtatggaaaggtctgctgactccttattcaaaggcttgcattccagcccggtccaccacttactgcttgggtgttgaagcctttctgaatggcatgtgcccatctgtaaaatgggtgggcaccattccttctgtctgtgtcataggattgttattaggaccaaaataataaacatgaaagccttttgtagagagaaacgttttgaaccgccgcaaagtgttataattagtataattagtaatgatgatgtaaataggacaaccaggttgggatgtcacttttaaagggtgactcttggcttagcccattttccattgtaaggttttagagtggccccctgacccccatgcctcaactttcttattgaactgaagtctgtttttccagctagttcttggaatgtagagatcccatctaaggtttaagttccccccttccctctcccgcacactcactcattctgcagagtacctggcatctgggatgggcttaataagttagtaaaatgaatggaacagaaacgtcagtgctgctgaggatggtctttcttcatcagctgctgaggagcggtcttggcagccggatgcctggggcactggccaggcttgcaagccctgtgtttacctcgggcactcaaaggagcctcgtttttaacgacttgtttgtgtccttactgatttggtgtcaggtttaatataaatagttggggcggaagagcaggaattatcctcagagggcaggactctggtctgagtggttgagggggatgcctgggcttttgacaatggctataaataacctagagcaaaagcaacttgttggtaggagcacgtgtaaaatccccggcacacagacacacacacgcacagtgtcgaggtgtgtgcgaaggggggttgtgggattgggcactgggcccagcatttattttggggaggagaataaggtgctgggtgcacagagccctccctgtgtcctcgcctttctgcacgggcccttgtgtgtcctgcccaaggtggggctcatctgcctcccattgggccctctgctctggcctcccttaaaagaagtcgggcccagcagatggccctctgctggctccgagtgctgcttccagttctctgaaagaactcgctgatgaggcccgtttttgtgcggagccattggaatcaagcttggcttcaattatcaaagaaaatgatgccataggaaagatatgctggaagcagtagtccacaattagaggatggaagctctggtgagggcagtttgctaagatccacttgtaaaagtttgcctgttttcaaaaggtcccgttgcccagtgctgttggagtcctggccccttgccgagtgtcccttgatcttgccttagaaaatgcttgttgaagagggtattgccttttgggcagtgaccttgtgagtaaattttcagagggctcttggaaagccctgaacgcacagacttagaagcatatacttttgaagttgcattgttttgagaagggaacgtgaggaggaggaggaggaagaggaagaggaggagaaggaggaggacccctatggtcagttctgtcaggtcagttctgtgctccctgcctggaggctcccctctggtttatggggaggggcagggccacagcatctcattaagaggagataagaacaggataggggaaaacagaaagcagccggcacctcctttccctgaaggttccgggggtctctgccacctgcaggctgaaaaccctttgcttactgaggttgcaaaccaggtctgtggatgtgaggctgatgcagaagctgcagcataggcctctactctgtgtaggaatttaaaatccttgcagcaactggaagcacaacagtcctgaggaaataaagcatctgggtacaattactgtagcgtggtttgagtttcctccccccccccccgcctttttttttaagtaatcacaagaaaacagccccactccgttttcttaaaattatgtggcacttttgacaaaggtctgggttctgaaataccgagtctctgcctctccccacaaccctgcctcctttctctgccctgtcttgttatgattgtgggaaaatccaagtactttattgcagtcaactgagttaagagcagtatattccatttttaattactggtcacacagtagtcctctatgttggaagtgaagggagacaagtttattttgggatccatgtgttaaacaacgagtgcaaagccgtgtgagcacacatagggtttgagttaggtgtcttttttgctgggaggaaggaattttctattgagtcattttctccccacagaggttgaagtatagctcttacagtggagacatggttgatgtgttaataccaccaagatagcaggactgaaggcatggaagaaagagtgtttgaatgctatttaaggctgttttggcttttttggtgttgcaccatgcctgttaaactaaaaaacttttccagtgacccatctaatggtcttaggtcctttaaggagagtcagcaaggttttcagtcactgccacgtgccactcactactttcagcgtcggagattcgtgtgaggacagggctgtccctcatggagcttacagtctggtttcacaggacaggtgttcaacatggaaacaccagtgtccagtcattatagatcatgataaagatgatgaaggaaattagggcagttgagaaaatgggagctctctggttttttgtttttgtttttgttttttttgagatggagtttcattcttgttgcctaggctggagtgcaatggtgtgatctctgctcaccacaacctttgcctcccgggttcaagcgattctcctgcctcagcctcccgagtagctgggattacaagcacgcgccaccacgcccggctagttttgtatttttagtagagacggggtttctccatgttggtcaggctggtcttgaactcccgacctcaggtgatccacccatctcggcctcccaaagtgctgggattataggcgtgggtcaccgtgcctggctggggctctctgtttttgttggcactcggttttttcttggaattttcctgtgatttcccccaaattactgtgcctttgttggttcatttggaggacctcagaacttggtgcagaggccatgatccaactgcctgctcttcaggtgggtgcccacctctggaggggttgtgactcagcccagcagtgagcactgcagccaagccggcagcagtgcccagcctctgacttctggtccctactgagagtttacagaatgtggcctcatcactggattcctaacaacaggaaaaggccccaaggaagtcatcgtgtgcatcctgcttcaaggcagtatccacgccttacttacgcacccagatggctgggcactttggcctgttttaaagacttgggtgatttcacagcctgtccccacctactttatggatttcctctgaccatttagaagtatttttttctctctaacttttgaagtctatttccccttgttcttcctttagtggggatgctgaacagagagtcccccttctcaactacgaggcctttttcactgaatcaaccttctcttctccagaagaatgaactgttctttttactctcaccactcctctctgcccttggtgttggggaattccggattgaggacacatggaccaggaggaaggcctggaagatcttaccgttctcatttaattttcaccaaaaaaatcccaggaggtcgtgagacttcttgccctctacagatatgagaacagggtcagagtgtccaagtgacggtcacaagtcacttggtcaaaagtgttgaggggttcatgtgcagtgctcctggtctgcaccttctggtcagttctatgcctacagcatatttctaagatctgacttgatgcagtcggacaggatccagggcacagctgtggtccggctcctctggccaagtctgacaaggcctttggcccacatggtgctaagttacctccttgggtggttgtgatgattacaggggtcccttctggcttaaaaagtttatggccctgtaactttttgtgtgtgtttggtgactccaacaagcgcaaactccttaaaggcagagactgcctctcctaccttcttttccatcccaccatcccctgttgagacagaccctcacaccaaattgtggcggtggcttcccccagggctccctgcctgtacctacccctcctttccatccagtctggtgacagaccttggatcctatgtgctgatgggaatgctttctccctgccggtcccctggcacccctgctgtcccctggcctcctggcccctccccatccagttaagacaggactatgaccttgcactgaagacctacgtcccttgccaggccttcttagcctggctaattagacccctctctctccctagtctagggagagcttttcgctacctttcccttttttccctttacctagtcctgggttgtcatctcctcaaattcctgctcaaccatgagtcccatctgccatctgtcccagggagtcccgttagtcccattagtcccatcagtcccatctgtcccagggagccgtccccaactgtccctcctagaaatgttctatccgtcatctgggttacctgtactaaggcactcctttcctgctttttattctgtgagaacttggaaacatgttgagtctagtctttgtattgggaggcagtttgattgagagccacgtgactcaatccatgcccaccagttccagctgtgtgatctgggcaggctgctggaattctggactccaagggcctcatctgtagaatgggcacagtccagtgctccttctcccctcctcgtgagcctgtgataacactgagcgtacctccctcatgacacccccacagtatggtgacatgcccccaccaggccatgggtgctggaagaccagagttcagcatgtagcaagtgagtaggagcttggtgaacatgtgcagacagctgactgtcacctttctgggtccttttcatttgccaaccccacggccatctttacagaccagctgctgtggactaatagaatatattctcttttctgagcctttcttttctccctcacttgatttctttgctgctggcatagacttggtgggaccagtggaggatgccagggtctttgtaaataggcctcctgcgacttcaggccttaacgtgcagcctgccgacctatctgcccctccccgctacttaagcccctcactggtgacacaagaggaatgcggcccagcaggagatgtgcacactggttgttctggaaggagatcaggagggtgaaattaggagccagaggccattgaaacaaaagggctggagataccggaggaggggcctgggccttcctttgaaacagctgtgttgctcatttcaatcctgctgcactagccagtcctggggagaggaagctgggggttgggggaaggggcatggcaacggctcatggcagagctcacaggtgggattggagtcctgaacgttgtcttgaacttttctgtcccgtctgtccagctcactgtgggcccagggtcaaagtgagaaggccacactggcctctagctgtttgcatctctggactgggctaacagaccccagacaaggagtttaggtacttaagatgtcttggggccctgaaattgtattctttggtgcaggattggatagggaggtggagcagagaaagatatttcatcttcactgactcgttcccctcttctattccatggcctcctctcctaaagcagagtccagttccttcctctaagtgcatttagagcttcacaggatcccctgggctgcctctggaatactctctgccctggcagacccaccactgggggcagaggaaccagcttgctttccccagggtgaaccggtggctcaggaggcctcccttttgtggcccctgctttctgcccaggtgagcaactggacctgggcagcaggttggcgttgagcagattgtgggatagtgtgctgggttgtcctggggtcacctgattacctgggtttctggtgagggtcagtgactgaaccacttttgtactttgcccataggtccttcaagaggagcgatcctgttaatccttatcacataggttctggctatgtctttgcaccagccaccagcgccaacgacagtgagatatccagtgatgcgctgacggatgattccatgtccatgacggacagcagtgtgtgagtatcctggccacccttccgtgggcttgcttgggagtggatgccacctgagcacttagccagaatcgtctgtcatcctcagctggctttgcagaccgcacctgtgcatgtatggacatcagtttggtgggaggggagtatgacaagggtatggtgctgattaaggaggatgacatggtcatctgggtagggtaaagcttagagctttgaaagttgggaggatattgtaacagaagaaaaactaaaggacagtagaagattaggatgaatgaatatttatagattccttgagtttaaaaaaccttcttctggttgtcatcatctggttgtccctgtgggaacagttgcttggctggtccagaaacccaggtatcctgtctgcagaaccaacagctgggagacaaggtggcattagaagggtctgtgtttaggtattcattgtttttggaggaaaaggcattgcaagtgggggtgagaaagccagaaatctctaaagagccacagtgtgtaatgttccgcattgttttgtttttaaatggacatcgtttattcagtaagtgtgggtggagtgttagatactctgtgttagatactgaggaccctaagtaggggctctctccaaagtagtgtctgatctggatctttggcagacagcctttgatttttgaaagtaacccaagacattggcgtggtccgatgaggtcagaaggcccttagtcaaggtaacattttgaattttaggtcatttgaagtcaagtcatggcaatctctgtggatggacagcagtgatcctcagtgagtctcatgaggagggatgtgtagctgtggcctgggtatccctgtctccggctgtcctttgaggttttggttcaggagacccagagtggagcctggggataggggatgggtaaaattccccaaaggcttctcacccaacacccggttgagattcattgttccagaaatggtcttgaaagcttttcaatgttttggagtcagaatttcgcctgctaaaggaacaattttgaaaggcaaacccattgaaccgtgtaagttctggcacacttatttagagtttgttccttttagcttcctaaaactggaccatctattattccagtttgtttgaaactatctggtttttactggccaatgtcctgttgcctggcctgtggcatgggaccagttggagggaaagttgatgaggtgagtttgggaacctactatttattttgctggtggcttttattgtgttacctcaaattcccttgttagtacagggagagatatcctcaaggtgaaagtttgaattttaataaaaatagcattttggcattagtacacgtctttcatccaatatggaaacaggaaagtacacatctttcatccaatatggagatatgagaagtttcacagaagtgagttttccatattgactgaaatttcggtatccatacttgaaaaaattgtgctttgataattttttggtggacatatttcttagaatacattttgctctgtcattattgcatagtattagacagggcataatttatctctcagttatccaaataatatcaagatctgtttgtgtactttgttgtggtatttctctcataggcaatgagggtgcatagggttatctgaccctttcccctttgaaaagtttctcttttctcttttcattctccctgctgttgtgttttgctgtctgtgtgcttgcttctagcaagcattcctcctgtagcatatattactttgtggattgtgtgggaatcttagcattatgtgtaaaataagagtaagttgaaattgattgaaggcattgagtgaatctcctaagtcaaatgcagtttacgtcagacgataagacttctgtttagttttcttagagactatttttggcttgcttcctggtccttggctgcatgtcagtccccatcattgaggtgttattctgggttcatgatgagataacttgggtgtagtcccatacttatttctgtttgatcctcccaagacccaatcaggaaggcaggcaggcagatacttgggactttacagatgaggaaataaggcctggtgcttccacagccatgcacctctgagacagacttcaggtccaggccagacacaggccctgtactttgcccgctttgcccttcccccaggcatgagcgttctcaacatgagatctgtgaataggaccggttggtcatgagacctttgagccactttgggtttcttttatttatatttcttagtaatcaagactgctttttagaaagactggttctgggaggggtagaagggagcaggttctaagttctcccctgcagcctccccatttacttcctcttcttttatccccttcccagaagaaaaactttcttttatttagaggtgactttaaagctttcacccttccccctttagctgaagcactttggattccaagcatgggggagccacttttcagggatcagaaaggttacctttgccagtccctattctaggtggcaagggttagtgtgtagttcagtgaggtccacttggatacagagacagaacaggtcaagtccctcatgtagcggctttctctttggggcacagtagatacctttgggttcctggtggcagaacctgtgagtattaataagcctatcctgtggcaaagctgccttggatggatagtgaataaaccaggaagccaggaggaagtgctgcaaggcctagagacccgtgggctcatggtgttggctctgttcgtcctggtggtgttgagtggctctgtgccctctcccaatcaagtgcgcaggttatcagattaactgtcacagttgtgcccacctgggcatttatactaattaggagtgcatttggcatccatgtggggtcactgtctcttgggcattgtctcatgctgcctctagtggggctcactagaaaacatcagaagggtctccagacttgttggcactgactcaagctgccattgggtgccaggcatgggggtctctggggccctccccactctgctgcaagcagacttggcgatgcaatgtgttctctggccgactggccctgggtgtgtgtgatcctgcccagcaccgggcggtcacccgggattcccagggctgggatcagacctcctcttcagaactctgccaattgtaggcctcgtgcagatgagagcgccgggcgagaaataaagtgtgtgggggatgaaaagctgaactgaatcgctttcagcccattgttcatcccgggaagcttagaggggataagagggtagcaggcccctttgaaatttccttgaacaagtgaataggagcgccccataaagcatgaaaagagccctggctgtttctcccgtcacaatggccagtgcgggctgtgaggggctggggaggggggctggctgccctgctgggagctggggagggaacagggctggggagggggggagagggagagagggggtcacaggcagccttcaatagactccagaaggttggagttcattagacacaaacccaggaaagcaatcgtctcatttgcgacagaaccaattaagtcctgggggcctttgcaagaggcctgggtagaagttggggcagtgctggcctgcacttggttggttattccagggagccacatgccggggcctgagtgtgcagagcaggcaggggctttaaagaaatcattgccttctcccaaagcctactgctgacttctgttttcctgctaagtaaaaagtcctgttaaagatggctgggcatttgggcctctgagaaggctgttttatgagcctgttactctgaaacctgcattctcggaagaaatggcttaatttttttttgagacagagtctcactctgttgccaggctggagtgcagtggcgcgatcttggctcactggaacctccgcctcctgggtagctgggactacaggcgtgcaccaccacgcccagctaatttttctatttttagttgagacggggcttcaccatgttggccaggatggtctcgatctcttgacttcgtgacccacccacctcggcctcctaaagtggtgggattacaggcgtgagccaccacaacctgccaaaaaaaatttttttaacgttaactgccagactcccaccaaaatccttgcagcactggaggcagaaggcttgtgggccattccagggcatcaggcttagaaggatggagtaaagagggtgaaaatgtcagaagcagcagactctttgccgcccaagtgtagccatggttagatgttgccaggaatcatgaaagctaagtcagtggtgtggaggcctttgtctcttctttctgctaggagttgctcttgtaatcaggatcagctacgtttgtatgttgcttcagctctgagtgtccccaaatcagcacaagatgattttttggtgtttcacacagggaatgtcgcgagttatttatttgtatttctttatatcttatttatgggggtttactttggacaccaggaaatgcatctgagtgaacttcaaatactaaccttttcctacaaaccaggcttttgatgttggctgtgatcagaggctgccttcagagtggttgccaaatgaagatgcgagtggacgcatgtgtgcatgagtctgctatttcaaagtcgccagaaaatgacattcaggttaggtcgggcacggtggagtcaaaaggctaagctaattggctcggctcaaatggcagctaagtggagtccacacttcaaaaccatgctccccagaaacagctgggcccggcagcaggctcgttaactaaaatgtttataattaaaggagaccgtatagggaccacaactctggtgctctccagcccacaggcttgagcagccaggaaactgatcacagacttttagagcttgaataaaagaagagaggcccccttttggaatgaggggctgttttggaagaagattcttggctggagggaattaaagccacatttccttgaaggtgcctgttaagcctttctgagcctctacaggctgacatcttccttttctgctctggttacaagttgcctttccagcagtttagtccttcacctgccctgggtaatggagtgtgtgtggtggtggtggtgggggatggggggcggggtatgaggtgcttatgaaatcatttgttccttttgccttcaatattgcagttatctactcccctccccatccctacccccatcctgttttttttttttaaccttattatatggaagaagaaaaagaggcataaaagctctaccactgactttcatctgggagaaggaagagtgaaagctaccagtggaaatgtcaagagtcttggagggggtggacgggggactcttctaggactcttgaagccttatgtcacttgtgtcatggtggggtccatggagtgcttgactcctgcccccaagactgtcaggaacagggctgaagcagagtcatccactgtctaagtccctagaagagagatggaggatagacattgtcttacagccctagggcagcagaatttggttagaccagcatgagcccaatctgtgggataccgccacccctaccatacaaggtatcttaggtgagagatggggatattcagcatggcttgggaaccacctggcgagccccatagctagtgagtactaggtggttggggaggacttcccagaaaattccacaaatttccccctcatgccttatcaatgtcaggtgactgcgtggggcttaggaaatggcatctccacattaagaccatcaggaagcttgactgctgattggggctgggaagggcatcttattgaaatgaccaagtgtaggttgttacagatgcctgttctggagtccagcagtggcttgggtatgagttgtcaatctgctactgactgtaacactaggtgagctattgagcatttctggtcatctgtaaaatgtggctcattaaggttcttatgagaatgaagtctgattataggtccaatgtctgacgtacagtagggactcggtatctatgagctggcattctcaggttggcatcagttgccttgggtgcgatttggtttctggtcaagccaggcatgcttataagtcccgttttcagctacccaaggtgaagacacagagttttgataaataatctttaggtgggcttggtcaggtgccgagcctcatgagtaggaggctgtttctcagtcatgagtagaagacgtgtttctccagcactggtcagccagctgctgcgaatccttcccacagtgctctgtctctgctccatacttacctttctttggggcagtactcacacttgggggtaagttgttgctctggatactgatctctcttctctcccttccctactcacctcagtgcaattatcgtttatgcactccttagccagggtttggttaacatacattggtttgttgatctattggaatcttcattgtcccttgtgttcctgttttctgacctaggtcagtagacttcctgaaaatgcagctatttagaattctagggcatttcagataaggagctagaggttgactagttactcctggcttgccccctgggtatttttagacattgctaattatcctatttttcttccaccctatgatgaaccagacattggggaaagggaagtagccaaacacccaatttcaatatttacagcctccaagtatgattcattatgaaaatgtttgcaccctgaggcttttgtaaataagtggcctcctgaagggacatcaatgggaaaatagtcacaccttgaccattctgcttttaagaaggaaattctttctggaaaaaatcatggcaactctaggtcatagttgtagtgaacactagctggagtggcagctttttaaaaattcttctacttgttaatgttttgtttttaaaaatataatggataggggcccatacttcttcaggtctttgcccaaaggtccctttctcaatgaggacttgacacccacatccaatttaaatttgcagcttacccactcaccagtgattctccttttcctgctgtgtatttattcatagtacatatcactaacatactattttttattttgttcattgcctgtgcctccccattagaatgtaaacttcaagagggcagttgtttgaattatgtatccactttgtctactgctctcttgcctagtgcctaggagaagatctggcacatagtaggtgctaatctttaaatggattgcacagaccaccacatagtaggggcttttctcttcatgcccacattggtcatgtgtctttgaaaattcattggttgggggtggtagggtttggagctgagagaaggggcctaaatgttatatattctttttattaatcacgctgtactggtttataaaaagaaatacatttggaaatgactaggaggttgacttggagagttatgcatgcttcactaatgcctgatttagccctctgtaggtttggttcttatccctacaactttctgccctggccctatccataaggcactggttcctggtttgaagcagtgggaacaagtgggaggaccagtggggcctgagaatctcctacttagggcacctgtaaaataggggagcctttgctctgcctgggctggctggagtgtaacccagttctaagacaacagtccgagagattaactttccaggctctttccaagttgatgcttctgcatccaaggaagccaagtttccatagatgattgatgggcaggatttaaatttgaccttgggtgggtccttccctgtgggagcaccgatggtatctggagacatgtgacactcctatggaagcatgtggccctgtcggcgggatctcaagatggcatatgacagtagcccatgtgatgtgctgaaaacatcctcgtaagcctgtggattctgtcttttcctttcccttagagatggaattcctccttatcgtgtgggcagtaagaaacagctccagagagaaatgcatcgcagtgtgaaggccaatggccaagtgtctctacctcatttcccggtgagtacagtctggagtgaggagacagctgttttctgccatgttgagtcctaaagaaaagaaatgggtggtggaatggggagaggtatagggaaggtagaaaagagcagtacctaaggtcccctagggcaaagggagagaaaagaactggacaataggcattacatggttttttgggttgtgatggtgagcacagtgatgtgattatgaggtatcagtcagttttgctataaaggaatacctgaggttgagtaatttataaaaagaagaggtttacggctgggcacagtggctcatgcctgtaatctcagcactttgggagtcggaggtgggcagatcacctgaggtcaggagttcgagacccagcctggccaacatggtgaagccccaccactactaaaaatacaaaaattagcctagcgtggtgacgtgcgcctgtagtcccagctacttgggagcctgaggcaggggaatcacttgaacctgggaggtggaggttgtagtgagctaacgccagtgcactccagcctgggcgacagagcgagactccttctcaaaagaaaaaacaaagaaaagaggtttatttggttcatggatctgcaggctattcaagaaccatggcgccaacatctgcttctggtgaaggtctcagggagctttcaatcatgatgcgcaaggggaaggagagccagtttgtaacatagcgggagaaacagcaagctgaggttgggggggtggtgggcaatgccatgttctttcaaacaaccagatctcatatgaactacagggaaaacttgctcattactgcagggagggcacgaaacacctcccactaggtgcacttccaccattggggatcatatttcaacatgagatttggaggggacaagcatcccaactatgtgagaggtttgatgacctatttttgaacctttgcattttctgaattcaaaaaaaaaattccctatcagaaagaaactgaagcacttatttcccagaaactaagaaatgctagatgatccatgcttctctacagcttggtgagctcactgtatttccactagaatggaagccctctgatgggagggagttttatctattctgttaacctctgtatgcacagagactagaacagtacctgacacataataggtgctcaataaacatttgagtgaatgaataaggaacctctgcccccccttgggacatcctcctgctctcttcactgggacattctacttcttgtgtcaaccacaggactccaagtcattttagtcagtgattttagtcatttatttatgtattcattgaccatttctcctcctggctcctgaagccctggagggtagctgttcctttccaactccagaacttggcttggtacctgctggtgagtctgtgcctatcaaatgcggaatgaacgaagtgtttagaagtgaggatctcctgagcagcttcttcctgtgactgagatggtggatgaagggctcttctgggacctctgcttttatttccatgcttgctaaagcagccagcacatggctgtactcaagagaacttccccatctacattcccattttagggctgtgctgtttacaacagcctcagatccaggttgcaaggaggggaggggaagaaagcacccagctcacagcaggtgtttatgaatccttcctgccagcttcagagaatctaattggtctggttatgttgtgtttaaaaaattaacacattgaattgctaaacccatgttgcattagtgcacaaactatagctcttctctgaaagctcctcacacagacaagggcagacttaccttgttttaaaattagcatattaaaattgcttttctgaggacctctagcatcccctccctctacagataacaagtattgatgacatactatcattgtttttttgactgggggatatgtgagttaacaaagaaaagttctatcgcccaagcttgtaaattagatgattttgtcctggggtgtgcaaatcgactttctccatcaggcagcgctttgatcaggggctgcaaggagccagcctgtgtgagaatggccacctacacaggagcctttctcttcttccccagtttctgcagctaagtggttgccgtggcaaggcccatcttttcagctgggggagatgctagcctttgcaagttagctttctgctacccccaccccagcccaaagaaaggagctaagcaagagggagattaggaagaaggaggtagaacaactggagaggtggggggttgggtggggggagcgagatgacaggaaaaggacagaaagctgggcagcaggggttctctctgtttgctgcttttggcaggcgtactcggtgcctttttatattctgcacttgatttggagatgttcccttttcccttgatagatcagcttcaggcagccaagctcagcagtgttctgctactagcctgcagcagctttcttcattttctgtacaaagagagagggaggagggaaggagaaaaacgagggagatcgaggacagtgttgagacaccaccacctcaaaggtgcgcagtgtgcggccaggaaataaattaccacttcttctctgatccaggccgtttgactcccttttcccccactttctttcctcccacctcctttccaatcttatttttttaaattttcaactctctttctgtttagattctactttctattccttgagttggtctctcccctccccacctcagagggctgccttttttttttttttttttttttttttttttttttttttgatggttgacaacagtctttgaagattttctacttcaaagtaactactgatgggctggttgtactacagaaagaacaagcagggcctctcggagtgcgaccaactgctcctgcccaaggcaaacgctggtggggaccatggctctccatgaggccatggcgctagcgcataaaagtcccgagcagcccaggccgccttgccatccactctacacccgaacatgggtttgcggtgcacagcgcctggtgcgggaagctccggccaagccaccgcccacctagcctgctgaacgtgcctcctccctttcctttccacgtcctgtagagaacccaccgcctgcccaaggagatgacccccgtggaacccgccacctttgcagctgagctgatctcgaggctggaaaagctgaagctggagttggagagccgccacagcctggaggagcgcctgcagcagatccgagaggtaatgcggcctaggccttcttcctgcttccgtccacggcgtgagcgctcgtatgtgtatgcgcatgtgcatggggtgcgttagggtgtgcgcatgtgcgtgggttgcatgcgcatgcgcgtgggctgcgtgtgggtgtgtgcctgggcgtgggctgtgtgcgcatgtgcatgggttgcgtgtgggtgtgcatatgcgtgtggatatgtgcttgtgtaggcgggcctgtgcgtgtgcgcatgggcgtggctgtgggcgtgcacacgggtgtgcgtgctcctgcgtagggagccgaatgttgcaaccccagggcctctggcccttctgcttcctgggtcacttctccttctgacgtcttccctttcaggatgaagagagagagggctccgagctcacactcaattcgcgggagggggcgcccacgcagcaccccctctccctactgccctccggcagctacgaggaagacccgcagacgatactggacgatcacctgtccagggtcctcaagacccctggctgccagtctccaggcgtaggccgctatagcccccgctcccgctccccggaccaccaccaccaccaccattcgcagtaccactccctgctcccgcccggtggcaagctgcctcccgcggccgcctcgccgggcgcctgccccctcctcgggggcaaaggctttgtgaccaagcagacgacgaagcatgtccaccaccactacatccaccaccatgccgtccccaagaccaaggaggagatcgaggcggaggccacgcagcgggtgcactgcttctgccctgggggcagcgagtattactgctactcgaaatgcaaaagccactccaaggctccggaaaccatgcccagcgagcagtttgggtaagtgccgggcggaccgcagtgtcccgtgtggggcttgtctcccagccaggtccatgggcaggtgtgaggtgggagccgcattacaggcatttagtttctaagagggcggcagagtgcacggccgggtgagggtgcggggagcaggtgcatgggtctttcgtgtcaccagccccccgacttgctgaattgtctgattctaggagtcccggagatttaaccgggtctctgggttgggtgtggttcttggttccccacagcggcagcagaggcagtaccttgcccaaacgcaatgggaaaggcacggagccgggcctggccctgcccgccagggaaggaggggcccccggcggagctggggccctgcagcttccccgggaggaaggagacaggtcgcaggatgtctggcagtggatgctggagagtgagcggcagagcaagcccaagccccataggtaaacaccgcttgccgccgccgcggccgcgagggtcatgggcactcagtacggaggtattgtgggaatggctgtttttgcagtccgcggaatacaaatgtgactatttgctcctgccatcttaatattaaacgttggactgagcagaccacaaaaatgtcatgttttggcactgacccctgttcatgttatggtagttttttttttaactctctctctgagcagaatagacaagtttctattgaagtcacattttccagttcttctaacccagtttctttccttctgttttctctctgctcattccttgtttagtgcccaaagcacaaaaaaggcctaccccttggagtctgcccgctcgtctccaggcgaacgagccagccggcaccatctgtgggggggcaacagcgggcacccccgcaccaccccccgtgcccacctgttcacccaggaccctgcgatgcctcccctgaccccacccaacacgctggctcagctggaggaggcctgtcgcaggctagctgaggtgtcgaagcccccaaagcagcggtgagtggaagtgaagggtcctaggttgaggcagggattgggtttgggtggagacctggtctgtggctaatggggagggcctctctttctgcctgggtctcaaaccctcccatgagaagaagaattacttatggatgagtaagctgctgctttccagcttctagaaattgttcccttcagttatgttcattctactagagttaagccaggatctgtgaggcaagtcatgcctagaattgggagaatgaatttcagcaattgcttacaaatcccattccttacaaatgtcttgattgtttaaggctggttagttgagtatataagaagctgtgagatggaggatcaagagtcctcagccctttgctggggctgagaatgtcccatcctgggctcccaggggggcttagaatggctgttccaagacgtcttcctggcctcttcagccactgttaacccagggtcttggttgggtctccgtaaggatggaagtcgggttcgtgtctcttcaggaggccaaatagtaattttctgtctgcttttcaattgctctggggacaacagtgtacctctaaatccctcgccctggctgtgtcctcaggtgctgtgtggccagtcagcagagggacaggaatcattcggccactgttcagacgggagccacacccttctccaatccaagcctggctccagaagagtgagtgtctttacctgacattactgagatctgccgagtgctttatgtttcagaatattcgctatctggagtttcattttcatgaaactttttttggtttttaaaatcactttgattttagcgctagtgatgaggaacagtaaacgtagatgttgccatccatgtcctgccgacaaatgcatcatagcaaaagtttttctggtcatacacaaatcaaaagctgggacatgaagccattagcagaagtgtagaagggacctcaaattcagctggaaaagttgcccccattcaacttgcaatttagtagtactggaaacatttgtcacccctgagcagaaagatcattctccactgtggcagaggtggaggggaccatccttgtgtttttgtttggagaagacagaatatcttcccccaaattgggcagtgattctttttgtaaatttagtctctttcaaagtaggttgaggagcctgctcgtttaattactggatggtgcaattaaaaagaaatctgctaaagagatctaaaatggtctgtatcaagttttctttcttagtgtcttcatcctgagcaatgagcaatgtttgaagtcctcaataggccactgccctggaccctttcattgtttcaattggttgaccctaagtgtaccagctctctgggtctgggccagccacttttttttttctttttgagacagagtctcgccctgttgcccaggctggagtgcagtggcttaatcttggcccactgcagcctccgcctcctgggttcaggcagttctcctgcctcagcctcccgagtagctgggattgcaggcgcccaccaccacacccagctccttttttgtattgttagtagagacagggtttcgccatgttggccaagctggtctcaaactcctgacctcaagtgatccgcccacctcggcctcccaaagtgctgggattacaggcgtgagccaccacgcccggcctagcagcctttttttcaagccattctacaaaatctcagaagaaatggggaaatggacatgactgtgtgataacccccattagttgttctcattctgctggaataaggggtgggctttaggcattctgagatcatgccatcccaaaggtgtcctgctctgggtttgtctctttagcactctccaatccaggtgagacccggcatctctgtgataatttctcttctctcatcttcttgaggaagcaccccatttatgccagcctgaaagaggccgccgtatactttcatttggtggcggtgggggaaatgataccaatttgtacaaccaaaaggaaatcatccttttctgcatgctgcatgcagcacatgtggggttggactgtgtgtcccccagagctgcctgactctgggatgtggggctctgccccagcccccactttgggtttacaattgcagccctagtgtttggataccctgtcacttatgcacatgtgcgcacgtgtgtgtttgctttagatgtgtgtctgctttaaaatgctaaacttgttccattccatcttattttcagtcacaaagagccaaagaaactggcaggtgtccacgcgctccaggccagtgagttggttgtcacttactttttctgtggggaagaaattccataccggaggatgctgaaggctcagagcttgaccctgggccactttaaagagcagctcagcaaaaagggaaattataggtaagagtcctgtggcttttttctgctctcagtttgtttgctcagaaccaagagccagagcctggagcagctcccctggctgagcagacctaggtggggcagggtgggagggggctcagcaggcgctgggggaggctcccttctcatttcttctctcccctcaccgctagcagcaataacgaagcagcagccgcaagagggaggctgcgtggagggttctctgggggacctggccaggctctttccaccaggtgaaccagactgaggagagaaaaggagcagctgcttgcaccgacaggagagtggggctcaggccacactgcagaggctttacctgcaattgaggggcttgtgggcgagtggggagcagggagcaaaaagagggacaggcacactgattaggagggagggtctggaagcgccgccctactggcttgagtttaggagagacccccacattgaaggctccaaatagtcaggaaccatgcctaggaaaagtcccccgtgtttttcttaccctgcctttccacctgaacagcctccctggattttatgggccattagaagcagagatgcgcctttgtccataacaaagaaggggctggacctgcgggtgggcacagggtgaatagggcagtctactcctcctgtccaggcctgggccccgctgccttctcccctgcaggggcttcaggaagggaacttcctggtctccttaccttgtctgcagagtggacggaggtgcccttgagaaggtccatgctgactttttagggcccttgagagggttcaagagctgaggaggatgagggccagccctaggccattccttctcttgatcatttccctcgtaaggagcaggtgatgactctgcctcagttcatctggagtcctcccttgcccctctccatggcctgcagcccaagagaatgtgtggattctgctccagttctgtcccaggtttcccaggtttagggctccaggctgggacaagggtgagacaggggcaccctagtttaaggaggtgctcactctggggtctacacccaagacagagttccaactcctcagctgtgtgctgttgtccctgtgccaggaccacagtctattcccaggtgtgaacccgttgccgccaccagggccaggggtgtgagtggaaaactctgaatagcacttggtaacctgccaggtgggcatgggctcctggacggggatgagtccacctgcagggctctgagacaccctcccctctagagcaggccttgtatagttttaccagccaccttcatctgggagttagtttgggcgggggctcaaagtgattctctttggagtggggaggggatggaggttggactgagcccctggaggtaactggccagcagggcgtgttgctgggtctggatagtcccttttatacctgggcagagacaattgtgaaaaggtatcaaaggggtgggggaacaggcctggctgctgctgctgctgcttttatcttgaaaagacacaaggtgaaactaatgacacaagtgtgtccctctggggattcattttgatcttggctttgtctcggctggacttcgagtggaactgcaggtgaccttggagaagagccatgtggcgctggcataggcttgtggggaaagtgcctccttcagctgctgtggccacatctggctctgattttttttttttctccctgaggcacagttaataagcctggctttgaagccctggcctcccctttaatgcacaaagacttgcacaaatggtcaactctccgatcctctccagttctttcctgagtggatcaggctgtgggaaggccctcccagctgccttatctctgcagggcctgagctagactcagtgtcctcctggggtaggacagggacacagggtgtcacgcctcaccctcccagcagggctggtgcttcaacatctcaatttgtacaaatacatccccccttcaaaaaaataaaaaagacccagtgaggttggggccgtggagcaggggtgggaggtgggggggacctgggatgcgttgagtaatctcaacatggcaggggttcaaaaagcaaacagtcccttcagacgcgccagacgctgttggtgccagatgtcagaagaaagcaaagtttgccacatgaagcatgttgcagtggaaaagcctgtttcttggagaaaatgagggcagtgcagtgtgtttgaagtcctgggggtggggctgagagaatgtggcctctctcctctctggaggaggttgcaattatgtaaaaggtcgctgcgtgtttgctcagacatgctgtgaaagcccaacttggtaaaccctggaggggtcggagctggggccaaaggggtctgacggagggtggcgttgggatttgagcctcttatgtggagaagtgacttttccccccactgtcctgagtctcctgtgcacagagcccctccccattttctcactgtctcctctcacgctcccccgagaattttgaccccttgacatgacgtgtcttcagtgctgcctagtcagagccatgccgttgttcaccccactgcattagctgggtcaggaatgctaaaaacaaagaaccttgactaaacccagctgttcactgtatttagccttatctcctacgaaagtatttggcttgcctttattaaagagggaaaaaattgagctctaaccaaggggagttaatttttttttttttaaagggaaaagacaaagcccaaccataaccctgagacacaattaaatgcttgaaaggttctcccatccccccaggggactgtgaccttccctctgtgagtggcctttatgggctggaaatgacagcttgcaggggcaagtttaatccctctgaggggtctcccttggctggggacagggaaggaagaggcccttgcttaatttcctcggaaggggtttaggggtgggcctggcccaagaggacagcagttgtttccgaatgtggcactcctgagaggccaggcatttgcatctgtacaattaaacagcctcagaagaaagaacgctggggagggatgaaaggagcctttaatcaacgggcataatagaagggcctttggtgtttgaccctggagggatgggatgggagaagaggcctggaaatggggagaagaggggagggcatcatggggccagtgccgtctgttcggccctgggaagctgcgctgggctggcttgcctcctgtgtggctgtgccagggccatccaggagtgttgcacttgggacctggaggatgggaaggccgagaggcctttggactgctaaaccatctggaagtcagccttttacagacttcggcaggttccggctctccaggtgtgatgggttcaggatggctgaacctggagatagtctggagtctctttgaaggacctgcttggctcctgctgcaaaggaactgcaggcatttgtccttcccttccctcccccaccccactgctgaaaaaggttggcggggggaaagcagctctgcttttcacagtgtatacgtgtcaggagacagcagaggtgctgggttgaagattgcaggtggcaggcccagcccaggctgctgctcagtgggtgcctggccttcatcatctcggcccacctgcttcttgtggtgtggccagtcccagctgccgtcttaaagcagatgtgcgcaacagtgtacaggcacacctgccatagcaaattcctaggatacctcagtcctccatgttggtatgcttttcttttcaacaatgtggaaaatgcagtttaccaagaagcttttttggttttccttttaaggtattacttcaaaaaagcaagcgatgagtttgcctgtggagcggtgtttgaggagatctgggaggatgagacggtgctcccgatgtatgaaggccggattctgggcaaagtggagcggatcgattgagccctggggtctggctttggtgaactgttggagcccgaagctcttgtgaactgtcttggctgtgagcaactgcgacaaaacattttgaaggaaaattaaaccaatgaagaagacaaagtctaaggaagaatcggccagtgggccttcgggagggcggggggaggttgattttcatgattcatgagctgggtactgactgagataagaaaagcctgaactatttattaaaaacatgaccactcttggctattgaagatgctgcctgtatttgagagactgccatacataatatatgacttcctagggatctgaaatccataaactaagagaaactgtgtatagcttacctgaacaggaatccttactgatatttatagaacagttgatttcccccatccccagtttatggatatgctgctttaaacttggaagggggagacaggaagttttaattgttctgactaaacttaggagttgagctaggagtgcgttcatggtttcttcactaacagaggaattatgctttgcactacgtccctccaagtgaagacagactgttttagacagactttttaaaatggtgccctaccattgacacatgcagaaattggtgcgttttgtttttttttttcctatgctgctctgttttgtcttaaaggtcttgagggttgaccatgttgcgtcatcatcaacattttgggggttgtgttggatgggatgatctgttgcagagggagaggcagggaaccctgctccttcgggccccaggttgatcctgtgactgaggctccccctcatgtagcctccccaggcccagggccctgaggcctgctagaatcactgccgctgtgctttcgtggaaatgacagttccttgttttttttgtttctgtttttgttttacattagtcattggaccacagccattcaggaactaccccctgccccacaaagaaatgaacagttgtagggagacccagcagcacctttcctccacacaccttcattttgatgttcgggtttttgtgttaagttaatctgtacattctgtttgccattgttacttgtactatacatctgtatatagtgtacggcaaaagagtattaatccactatctctagtgcttgactttaaatcagtacagtacctgtacctgcacggtcacccgctccgtgtgtcgccctatattgagggctcaagctttcccttgttttttgaaaggggtttatgtataaatatattttatgcctttttattacaagtcttgtactcaatgacttttgtcatgacattttgttctacttatactgtaaattatgcattataaagagttcatttaaggaaaattacttggtacaataattattgtaattaagagatgtagcctttattaaaattttatatttttcaaaa

SEQ ID NO: 12 - DNA, 301081 bp, Homo sapiens
gaggtgcgcgcgcccgcgccgatgtgtgtgagtgcgtgtcctgctcgctccatgttgccgcctctcccggtacctgctgctgctcccggggctgcgggaaatgcgagaggctgagccggggaggaggaacccgagcagcagcggcggcggcggcggccgcggcggcgggagccccccaggaggaggaccgggatccatgtgtctttcctggtgactaggatgtcgtcggaggaggacaagagcgtggagcagccgcagccgccgccaccaccccccgaggagcctggagccccggccccgagccccgcagccgcagacaaaagacctcggggccggcctcgcaaagatggcgcttcccctttccagagagccagaaagaagtaagttgagtgcgagggagccaggccgggagccagcggcggcgccgggccggagctgtcaccgggcgcccgccccgcggcctccgcgccccggcgccccccggcggggtgggggcggggcgggcccgcgggcggtggcggctcccggccccggccccgcgcccctcggtagccgcccgcgcccggcctcccccgctccgcgccgcccgcccgggctcccgccggcgcccggctccgcacactttacttttcagtcgggccttttcactgggtcttctccgcgactcttcttttggagaaatttctcgtagccgcgtcttggcctagctggatcattgagaaaacaagcccggagcgcgcccaggtagtccccggacggactccgggcgaaccgccgagccgtcggcgctcgggaaactctcggagctgtcaaaacgcccgggccaggtggtctcggggcgcgggctgggggcgagaagaaagcggccgggcgagtgcagcttttgtttgtcagcgacttgctcctggaacttttcctggtcccaaacctgtgttttcttcttttgatgatatattaggaagccatttgacttcttcctcccccctcccccaacacccagcaccgcactcccgggctccgaaagcacaagtcctgtgggatcccccagcttcggggaacggcctgcctaagttttggagacgtagccagcgtcccctcgtaaggcagaataccaagagcacttattcggagagagtgcagatgtaaatgtcgcttccctcgtaagtcttagctgtaaggggcttgggaatagggtcgcctgcctttgagcgtacagtagggctggaccccagcttattagaggaccagaaatgtcttcttacagaacggttatttgacggctttgcttgtaaattaagacaccgttttagtgccagcgaactgctcggcttctgtggctctcgcgtgtgccgtggaagaactgtgaatgtctctcgaagttgtagaatggcgtgtgtgcttactcatttcgtgagatgatattctcattgaactgtcgggagtggaagggtgcgctgggacgtgaaggaagccagcacgtttatggataggctgtttctttggttcgggtgcattcacttagtaatagtattgttgtttggtgatttgtagtaaaaatagtagcgtgaactgaggcatagcagagctgggttgtgggaacccattgagctcttgacttgaatgtgctcttttcttgccccgctgtccttttactatgaaaatgattcagggccttcaacttgcctccatattttattgccagctgttacctagctatgataatcgtgagggaagcaagtacaggatgtgtgtacattattacattagcttgttcgtgatacaaagttaggacttatttattatgccacttgcgttgtaatacagtggcaagtataaaatgcccttattctgtattaactgaaatttgtagaaggaagtggaggtttaagtaatttttagacatgtaagccacttttttttgcatcctttaaagcaactcaggacaagccatattggggttttaccttgattgcctcccatttcactatttgcaaagcatttcttcatctcttactgaacattaatttgcaagtattgttttaaatttgcatttgaattcttactccagaaagattagatctatgttgtcacaccccacaccccatactcctgtaagggcgtgcttgtgcacgcgcacacgcgcacactcacacgcacgcgcacactcgcacacaccctacttttgaaatgagctcatttgtattagtgcagctcctgagtgcactggacgattagggtattgccactttattattttaattctgaatctcatgaagaaataggcagcctttggagaagataaaaaatttctgctgaataacagtataatctaactatgaaaaatcaaaacttttggaaatatttagaacaaatgtaagtctgtagagagctttttcttttagatttgaaaactagtactgctttctttataggaaattaaagtctactggtaaatttgacgggtctaaactttttagagcgttttttttgaaattgtgtcttttgaagggaatggaatctccagttgtttttagcaacatgtaaatggaaactaacatatgaattggaaagcaaagaggtttttgaattgtgtatctctatactgtataagaatccatgcagaaaagaccctgtagttggacagtaaagaccctgaaagtgaaacttatgtgtaaccagtgtaaattaggtttgtaaccagtgaaattatgtgaaattgcaaataattcacctgagaaatgaaaattaatcttctttgctaaatctcatagagatattttaagttgctaatgttacttagatgttcattaacttagtgagttacattaagtagagaagatgccttttttttttttttctggacgaagtcttgctctgtagcccaggctgtagtgcagtggtatgatctcggctcaccgcaacctctgcctcgtgtattcaagcgattctccttcctcagcctccagagtagctgggattacaggtgtgcgccatcgcacctagctaattttttgtatttttagtagacacagggtttcaccatgttggccaggctggtcttgaacccccgacctcaggtaatccactctcctcagcctcccaaagtgccaggattacaggcgtgagccaccgcaccccgctgagaagatgccttttgacaatgaagtggatttatgtatttatctttggcttaaaaaaacatgcaccaccaattacactttcctcaagtttaaatttttaataattaggtaaataaagcattttcttgtcttatagtgttagctagattgtttttgtgtattttgtcatgaataaaaagcatagctatatagttactgcttttacattaactataaatatcttaaaattttactacctaaaatcaagaaacttgaactgaagctattaatcttagagttggaaaagtaaatacatagaggtttcctattgtacaaatgtcaagtggcacagtgaaatttacattcatttgaaagttttccttaactgtaaaaagtatcaaattatttgataatttggagtagttcatcatctttatcagaggcacaggtcttaaccattggcaggcctctgtcagaatatgcacatattaaagatctcattatttttgtgttaatgttaaaaaatttttctgaagcttttttcttattttttccatccttacactgtaaattcacattaccaagttgggaagccaaagaaacattctactctactatgtttcttaccagttcatgaaagttgatgttagaaatgggtgtgggtgtgggggatgggggtggttgtacagaagcagcaggtggtaggtataggatttctgaagcactatccttggccttttttgagtaaactctttataccctgaaccactttcttttcagagggcaattgctattattagagagccaccttaagcattattgttgtagaaaaattaggcacaaccagtgattgtcattacaaggaccagcaaaaatggctaggttgctactctgtatttgtaacgcccttcccccaacaaaatttctccttttcatagctgtgaatttgaaataagtgatagaaaactgtactgcattacaatatataccatttaataaaacaagtttatagttgagagacagcactattattcatgctttttgagataatgcaaatttgtaatttttatgacagcaattcttaataatttattgtccaagagatctgataaaatttttgatattattggtctctgggactcaataggcactgaaatgttttaattcagttgaaaagttgactcaggattgctaccctctcttacctgttaggaggttgttgtttaacctgacctgaaattcccatgaataagaacctgttttttttctttttttttttttttgacagagtcttgctctgccgcccaggctggagtgcagtggtgcgatcttggctcgctgcaacttccgcctcccaggttcaagtgattctcctgtctcagcctcccaagtagctggagtagctgggactgcaggcacgtactaccatgcctgactaatttttgtatttttagtagagacggggtttcaccctgttagccaggatggtctcaatctcttgacctcatgatctgcctgcctgggcctcccaaagtgctgggattacagacatgaaacaccgcacctggcccagggaatttctaatatttgagaagatgttatttttagtctattatacaaatttatatattgtttactaatatataaatttacatattagttactaatatgtaaacttaccaatttacatattggttactaatatgtaaacttgataaacatggatttccatggaaatataaaagtatcacaacaatttgttttcccattctgacacttgtgatttattacattttcgtactatttcagttaattccataatgccagaattgttgttaatctgccaagtgacaagccacactgcttcatctcattcctctgttccgcaaaactgcaaagtttcccagaccacagtcaggtttctctgggtagatagtggttgtccaactctgtaaacttaagtcactttaagtttatgatggaggggcttcgtgaaacttcattgaccttccaaggtgaaaattggtcagtttccagttataaaggacattaaggatgggtgtggtggctgatatatgtaatcccagcacttttgggagactgagtcaggaggatcacttaatcctcatttaaaaggagtttgagaccagcctgggcaacaaagtgaggccttgtctctacaaaaaaattagctgggtgtggtggtaggcacctgtagtcccaactactctggagactgagctgagagaagattgtgtgaggcttggaggttgaggctgcagtgaacggacatcacaccactacactctagtcaggtgacagagcaagactctctaaataaataggaacattagatggtctctctgcactcttgcctggtggggacgtgttagataccctcgttaggttgtgatttagtttttaatctgtgagatgtttgggccaaacaacttttagctgccatggaataaactttacagtcagcgtgtgagtttgtgtttgcctttacttttttttttctatattgttttggtccatttttatcttttaatttcagaaagctgattaatctcttccttttctctttaaaaattttctttatcatgtttgtgctacagtggttattttgagaacttgttggcaggataagtggcaaaagttacgaagtagaatagagatgatttctgtttttttttttttttcttttttttgagacagtctcactctcttgcctaggctggagtgcagtggcgtgatcctggctcactgtggctgccgccctccggattcaagcgattcgcctgactcagcctcccaaaaagctgggattacaggcgcatgccaccacacccagctaatttttgtgtttttagtagagatgggtgttcaccatgttggccaggctggtctcagactcctgacctcaggtgatctgcctgcctcggcactcccaaagtgctgggattacagacgtgagccaccacgcccggctgagattatttctttttttattatagctattgcttgtagatatatgctggtggttatctgtgaaaatgtaatagaaaggctgggcacggtggctcacacctgtaatcccagcactttgggaggctgaggtgggcggatcacaaggtcaggagtgggagaccagcctggccaatatggtgaaaccccgtctctaccaaaaatacaaaaattagctgggcgtggtggcaggcacctatagtcccagtgactcgggaggctgaggcaggagaatcgcttgaacccaggaggcagaggttgcagtgagctgagatcatgctattgcacaccagcctgggcgacagagtgagactctgtctcaaaaagaaaaaaaaaaaagtaatagaccaatcttggatttataattggaagtgttgatccctttatttgcagaatttgaaggacttaagagcacaagttgagagaaacaaatgacacagctctttttgcactttgtaatattctagaaaaagcctcaggtaaaaggaaaattgtttcactttgtttctgctgttaattttgtgatggcagtaactacatatgatctacaagtgtaaaattgtttaacaagtcttaagttttctatacttctatgtaactttttagatctttcatttggtacatgttatttaaagagctacaaagtgctaaatatgtcctgggatgaacagtcaaccctggaagatttattgtggcctagaggggtgctcaaagatttggaggaagtagtatttgaattagaccttgaaggattggtgggatttagccaagtagaatgacaagaaaatgagtgtgtgagggagcaatgtgaatgaaattattgagggaaggaggtgtaaaaggtggggtggcttctgactgtgtgactagaacagaggctgtgtgtagtggtgaggccaagctgtgatagttcttgaatgccagactcatgagtttgggctttatcctgtagtccaggagttataaactgtttacagggagcaggtaagcaatttaaatgaacagtaggctgcttctaagaatctgaatgacaactgacactttagaccttgggttggggagaaaatgggaaataataacagccttggggaagtctaggagtccttatgccctgcttaaggtgaaactgatacagaattctggctgatggttgctatttgagatgctgtttctagatttttcaagagggcggaaatttggatttttatgatttttttttttcttttttgagatggagttttactcttgttgcccaggctagagtgcaatggtgtgatctcggctcactgcaacctctgcctcccgggtacaagtgattctccttccttagcctcctgagtagccaggattacaggcacccaccaccatgcccggctagtttttttttttttttttttttttgtatttttagtagagacggggtttcaccatgttggccaggctggtctcgaactcctgacctcaggtgatccacctgcctcagcctcccaaaatgatgggattacaggcatgagccaccgcacccagccctttttatgatttttaaacttggattttaagtgtttttcattaattagaatctaaaacggtatttgcgcctatactttgtaggctaggtttaatctgcggaccaccaggggactacaggtctcaatctctgctttatgcccagttattttattttttaaatgaaagttttcaaagcaggtatttacagtattcttgaggataggaaccttactaaattactttgtattctgtttagcatttatgcatttgaatgtaggcactcaaatacttggtgatttaatgatgcctattattaaaaaaacactgtggtaataatatggagacaggagttacctggaggcagagataataggctgttacaatagttgtagtgtgagagatcaagccaaagcatagaatgttggtagtgcgaatggggaggaagattccagtcactgcaaaggaggaattcggcagtttctggcatagatgttgtagcaggcatccaaatagattggatgcctgctaagcattcggggaagtaggactggagttgaggaatcgattaggataagtatttaaagatgtgacttaacatgtaatcactgagaatatggcgtatgggaattagtaaaggattaggatgctttgttgcccttaggagataggggaccagttatacccggaaaaacaagaaaggaaatcagaatatattctcatgacaaatggacaacatatacatacaagatgctcatggcagcagtattagtagtagagaaaagttggcaacaacaaaatatgcatcaatggactaccatgcagttttaaatcaagacatagagatagatctgtgggccctgaagtgggagaatgtctatgatacattgttgaactagagaaaaacctttccaaaagttgtaaagcagtaagtttagcagtaactttattttgtgaaaagcacataaacccaaactgtgtgtatattttgtgcatataaaaagattgggaagaatacataataaatattaatactctgggggccgggcgcagtggctaacgcctgtaatcccagcactttgggaggccaggagggtgagtcacgaggtcaggagttcaagaccagcctggccaagatggtgaaaccccgtctctactaaaactacaaaaattagccagtcatggtggcaggcgcctgtaatcccagctactcgggaggctgaggcaggagaattgcttgaacctgggtggcagagtttgcagtgagctgaaatcgtgccattgcactccagcctgggcgacagagtgagactctgtctcaaaaacaaaacaaaacaaaacaaaaaaaaactctggggagtatattctttcagtatacatttatgcatttaaaaaaagaaaaaagcttaatacttcagaaatggtaaatcatttgacaaatgagaaaaccaaattctgggggcatcactgattatagagcctagaccttctggattcaagtctaggttgtactacatattagctgtttgaccttgggcaagttacttaaattttttgtgctatggttgcctcacctgtagagaggacgtaataatacacctaatttaggattgttatgaatttatatatatgtgtagaatttagaacagtttctggcatagactaagtcctattaagaggtgctgttgtaaggatttaactactgttgttactgtcattgccactaatcatcaattatcaatcagttgcctgttataaactatttagagacagaagtgattagaaaccaaactcactccaaaaatgccatgatataaggctgggtatgttggctcacacctgtaatcccagtgctttgggaagcaaaggtgggaggattgcttaagtctaggcgttagagaccagcctgggcaacatagtgagatccccatctctacaaaaaattaaaaatagctggatgcggtggtatgcacttgtagctccagttacttgggaggctgagatgggaggattgcttgagcccaggagttggaggctacagtgagctgtgatcatgccactgcactccagcctgggtgacagagcgagaccctatctcccaaaaaaaaaaaaaaaaaaaaaaactatgacataaaataatgcagttgttattggaggcggggatagtggggtggcaaagattttctttgtacgcagatgtccccaatatatagaagaaagatttttaaaaagctaggtcagcagaaatctctatgaaatgtttttcattatgagcaatacacgaaaaacagtcaaagcaattccctaggagttgtatatgtagtaatattattccaaagttttttattgctcaaacttttaaatgttgttagagtagatttttacatattataactctactggctagggttttattagtaggcctccctcagtgagacttgttttaggtggttttaaaatgatttcttacatcttttatccttggtcactttaaatctttacaccttattgtaatcgatttacattagaagcagcatacttgatggtctcagtgaagtctgtgtggtggtgttcttttagtggagcctagcaaaaaaagaatttccttgatttcctgatctttgggattctagtcatatggaccacatttggaataagcacatagttgaatataaaatgacaaaatgaaacataaccatattcttaaagttctcattgaattgttctaccatagttgaagtgtttggtcagtatggccaagtgtttgtttgtttttgagacggagtttcgctcttgtcaccctggctggagtgcagtggcacgatctcggcttactgcaacctatgcctccctggttccagcgattctccttcctcagaccccggagtagctgagagtacaggcgcccctccaccacgcctggctaatttttctatttttaatggagatggggtttcaccatgttggccaggctggtctcgaacttctgacctcaggtgatccacccaccttggccttccaaagtgcagggattactggtgtgagccactgtgcctggccctaagtgtttcttatattagactttcatacttatagagttgtagaatattagaactattaatagatgagaattcaagaagattgagtctaacccctcattttatagataactgagccccagagagattatggaatactagaagtcatatattaaggtgttacttttacagtaaataaaggagatggtagtctactgtattggtgtagacccatagtaaatcatgcctatgggtattcatgctattgtatagtcatctctctttgtatctcgcctagccctgtgactcactttaaccagtagaacatagcaaaaatgacactttgctatttttgggtacaagccttgagcatgtcaggcagcttctacttttgtactcttgggagctctgagttgctgccgtgcaagaagctgtcataccttgctggagagatgatgtggagaggaagagattccaggactatatggaaagagggaggcttaactatctcagtgtcctagctgccttcagcccttagttgacttgcctgttgaatacagacacaaaagtgattagtaagattagcgaaggggccggcgtgggggcttatgactgtgcagtcccagcactctgggaggccaaggcatgtggaacacttgagcccaggagttcaagaccagcccgggcaatatagcaagacactgtctctacaaaaaaatacagaaattagctgagtgtggtggcatgtctctgtagtcctagctacttaggaggctgaggtgggaggattggtcaagcccaggagggtgaggctgcagtgaaccattatcttgccattgcactcaagcctgggcgacagagtgaaaccttgtttctctctctcacacacaaaaaaaagattaacagaggaaccacctagctaagctcagtccaggttacgaaatcataaataagtaaaatgctggttgttttaatctgttttgctggaagcagatagttttctgaattaagggacgctaagaacaaagagtatttggagctgggtgtggtagtacatgcctttagtcccagctacttaggaggttgaggtgggaggatcacttgagcagaggagttggaggctgcagtgagctatgatcctgcaactgcaccccacccagcctgggtgacagaacaatacccggtctcagaaaaaaaaaatgcatttgggatacgagtgataaaaatcattattttccatcctcttttactgaaatagttaaatgaagtttctccttaaccttaccctttatttttctaaagtattttgaaatacagatttttattattgaggactttaaatagtatttaaaaatggaattgtcacagtgtagattgggctatagttaggtcatacagaatagaaagataaaacaattatgaatatcaaccctaaaaaggatatagtttatttatttatttatttttgttgacttgtacagagatctttatatatttgagcatcctggactcttgacagaagaactgatttctatttctgggccaattcttaacagccgggtatatcagtaaggactaggtttgtctttatgtgattgaaaaccccgtaataataatgacttgaacaggagtgtttatttctgtttcacttcaaaatctggagggtaggtactgaggctggtattgtccctctacactgcaaagtcatcaggagtgtctccctttatctaacttctcagacatttctaggttgtggcctttgccctaagattccttgatggctactaaagtcccaattacattacatgcatgtcccatgaagcaaaatacagaaaggagtccaagggcacacagcctcctcctttgaagaaatattgtatgttttctcttacatataattggctagaactatcacagagttcacatggctacctgtagctgcaagggaggctgggaatgtagtttgtttgttttctgagacagagtctcgctctgtcatgcaggctggagtgcaatgacatgattttggctcactgcaacctccgcctcccgagttcaagcgattctcctgccttagcctcccaagtagctgggattacaggcatgcaccaccaagcctggctaatttttgtatttttagtagagacagggtttcaccatgttggtcaggttggtacgaactcctgacctctggtgatccacctgctttggcctcccaaagttttggaattacaggcgtgagccaccgcacccggctgggaatgtagtttttttttctttttttctttttttttttttgagatgagagtctcgctctgttgcccaggctggagtgcattggtgtgatcttggctcactgtaagctccgcctcccgggttcatgccattctcctgcctccacctcctgagtagctgggactacaggccaccatgcctggctaattttttgtatttttattagagacggggtttcaccgtgttagccaggttgatcttgatctcctgacctcgtgatctgcctgccttggccttccaaagtgctgagattacaggcgtgagccactgcgcctggttgggaatgtagtttttttagatgagtaccttgctacttagaataggttcaaagtctggttactgatggtgggaataaatattacagaaatagctagtaaatagtctttaccactttgagcaattggtttatcaccataggcctaattttctcatgtgtgagaattatgatactgaagttcttgcgatggcagataatttcatgttgaggcccggttgattggtagtgactgctttcaacaatgctttgttgaatcctgagcccccagggttttctttttttttctttttgagacagagtcttgctctgtcgcgtggctggagtgcagtgatgcgatcttggctcactgcaacctccgcctcctgggttcaagcgattctcgtgcctcagcctccctagtagctgtgattacaggcatctgccaccacgcctggctaatttttttttttttttttttttagtagagactgggttttgccgtgttggccaggctggtctcgaaatactgacctcaggtgatccacttgccttgtcctcccaaagtgctgggattacaggtgtgagccactgcgcccagccctaagcctccagtttttgacctcagcatggtgaggaagtagtagaagtatgtattttgggtgaagaggagagtaaaagcatgctcccatttatatgctaacgctgtgctttttaaaaatgtggttacttcaacttttgtaatcttttcattgaaaacatttggttattctgctaacctttgactattctctttaaaaatgtcctacattcattccatattttaaagttttctaataaacctgagttcccacttgttttttttccttccagcttttattttaggttcaggggttacatgcacagatttgttaacatgggcacattgcgtgtcgctgaggcttagagcacaaatcattttgtcactcagatagtgagcatagtacccagtaggtagtttttggatcctcaacttcctcccagcctccaccctcgagtaagccttggtgtctcttggtcccctctgtgtccacatgtacttagtgtttagctcccacttggaagttagaacacacagtatttggctttctgttaattaattcgcttacgaataatggcctccaactgcatccatgctgttgcaaaggatcatttcattctttttttatggctgcacagtattctgtctcgtatatgtaccatgttttctttatccagtccgctgttgatgggcagttaggttgattccatgtctttgctgttgtgcaaagtcctgtgatgaacatatgtgtatgtgtgtctttatggtagaacgatttctattaatttgggtatatatccagtaatgggatacctggattgaatggtagttctcagttctttgagaaatccccaaagtgcttttgacagtggctgaactaattaacattcccactagcagtgtataagccttcccttttctctacaaccttgccaacatgttttttttgtgtgtgactttttaatcatagccattctgacttgtgtgagatggtatctcattgtggttttgatttgcatttctctaatgataagtgatgttgagcattttttcatatgcttgttggccacatatgtcttcttttgagaagtgtctgttcatgccctttgcccatttttaaatggggttgttttttgcttgttttttttttattataaactatttttttattatactttaaattctagggtacatgtgcacaacttgcaggtttgttacatatgtatacaaggtgccatgttggtgtgctgcacccattaacttgtcatttacattaagtatatctcctaatgctagttttttgcttgttgatttaagttccttacagattctgtatattaggcctttttttttttgagatggagtctctttctgttacagtctggagtgcagtggtgcgatctcagctcactgcaacctgtgcctcccgggttcaagcaattctcctgcctcagcttcccgagtagctgggactacaggcgtgcaccaccgcacccagctaatttttgtatttttagtagagatggggtttcaccatgttggccagaatggtctcgatctcctgaccttgtgatccacccacctcggcctcccaaagttctgggattacaggtgtgagccactgagccaggccaggcctttgttgaatgcatagtttgcagatattttctcccgttctgtaggttgtctgtttactctgttgataatctcttttgctgtgcagaagttcccgctttgtgcagaacattccaaacactggagatagggatgatgcagataaatactaaactcctttaatgtgtatatcagaatatacagaatatgttacggtgacaaaggatcccaattcttagtggcatcagtcacaaaggttcatttcttgctcatgctatgtgttcatcacagatcggtgtgggtgttagattataggtgacttaaaatctcttcctttcaaagtacatttctgaagcatggtttattcttagtcagatttgcttttcctatttgttctctgttaatcacccaaggaggatgttaggcaaaatcaaatactgagaatctgctgtgtattatacagtggagagaccaaaataaggcaagatccctaccttcaatttctggtaactcagtgcaaagtataatgcaaatgacacattttacaatagatttcagaaagtgctgaggaagcttagagaaggaagaacttatctcagaggaactgaagaaagaagacatctttgttgagtgtttaaaaatgaaaacagactttaccgaagagaaaaaggggagtgagaaactagtacctggctattatgtgttaggcactactagtgcttaccagaagttacctttttgataattactgatcacatggggttgaatcattagtacgttttacaaatgaaagatgaatttttatatagcttgtaagtgattgagtcaggatttgaatccaggtgtgtctgaccctgacctttgctttttaagagactacagtccaatatgggaggaaatgaggaagggaaagtaaattgggcattttgaatattaactgtaaacaatagggagccattgaagatgttaaacagaggtatgacattgtatctgtgttagaaaaataaccggcaacaactgtaaaactggaactaatgattttttgcatgtgattaagtatcaaatgaagtataatttctgatctcctttaatttgtttgtagtattttataattttcaatgcacaggtcttgtactttttttgttaaattgattcctaagtatttcattgtttttgatgttgttataaatgtaaatgttttctttcccccacttttttttttggagacagagtctcgctctgttgcccaggctggagcccagtggcatgatctcggctcactgcaatctccgcctcccgagttcaagtgattctcctgcctcagcctcctgagtagctgggattacaggcgtctgccaccatgcccggctaattttttgtatttttagtagagatgggcttccaccatgttggccaggctggtctcaaactcctgaccttgtgatccacctgccttggcctcccaaaatgctgggattacagacatgagccaccatgcccagtctattttttttcttttaaatgaaaaacaaatctttttatgtagggacagtcgtctcactatgtcacccaggctggtctcaaactcctaggctcaagtgatcctcccaccttggcctttcaaagtgccgaaattatagacatcagctaccacacccagcctgacctattctctttcaaacttttttcatatacacagtttttttttttttgtgatactacttatgtacatttagagttttgtaacctactttcccttgtaacatgtaaaagaaaatttccgtattgttaatcttttataacatttttgaagggtgcttaattttccattgagtaaaactgagggctgagtgctgtcgctcacgactgtaatcccagccctttgggaggctgaggcaggcatatcacaaggtcaggagttcgagaccagcctggccaacatagtgaaaccccctctgtactaaaaatacaaaaattagccaggtgtggtggcatgcgcctgtagtcttcagctgctcaggaggctgaggcaggagaatcgctggaatccgggaggtggaggttgcagtgagccaagaccacaccattgcactccagcctgggcgacagagcgagactctgtctcaaaacaacaacaaaaaactgagtaaccacactataatttatgtaaccatacagctgtctccccttttcctcttctcaccctactgccttttgttactatgtgtaatgctctggctgacctttttgtagataaagcctttttcatattttggttatttttataggacagattaccataggcaggataattaggttaaaaaataagcatttggccgggcatggtggctcacgcctgtaatcccagcactttgggaggctgaggtgggtggatcatctgaggtcaggagtttgacaccagcctggccaacatggtgaatccccatctctactaagatacaaaaattagctgggcgtggtggcgcacacctgtagtcccagctacttgggaagctaaggaaggagtatcgaggcaaaggttgcagtgagccgagattgtgccacttcactccagcctaggtgacagagtgagactccatctttttttttttttttttttttaaaagaaagagggtgggcgcggtggctcatgcctgtaatcccagcactttgggaggccgaggtgggtggatgacgaggtgaagagattgagaccatcctggctaacgtggtgaaaccccgtctctactaaaagatacaaaaaattagctgggtgtggtggcaggcgcctctagtcccagctactcaggaggttgaagcaggaggatggcgtgaacccaggaggcggagcttgcagtgagccgagatcatgccactacactccagcctgggcgacagagcaagactccgtctcaacaacaacaacaacaaaaaagcattttttgattcttcatagatattcagaagcatataggctctaatgtctatttgcttattgtcaaattctggtcttatcactttctagttgttggactttgtataagctgttcaatctgtatctgtttgttacctataaaatagggatgataataacatctttgtcacaggattattaaaagatttaaagagggtatatgtgttaagaaagccgctagaggccaggtgcagtggctcatgcctgtaattctagcactttgggaggccgaggtggatggatcacctgaggtcaggagttcgagaccagcctgaccaacatggtgaaacccatctctagtaaaaatacaaaaattagccagacatggtggtgggcacctgtaatcccagctacttgggaggctgtggcaggagagtcgcttgaacctgggaggaagtggttgcagtgagctgtgcctattacttagtaagttcttagtaaatacgaactttttaaaattttttccttcttatatttgatgccttagcaagcaataaatataaactctttttttgagataaatataaactcttttttttttttttttttttgagatgatgtctcactgtgtcacccaggctagagtgcagtggtgccatctcggctctccacaacctctgcctcccaggttcaagggattctcatgtgtcagcgccctgaatagctgggattacaggcgtgtgccaccatgcctggctaattttttgattttagtagagacaaggtttaccatgttggccaggctagtcttgaactcctgtctcaagtgacctgcctgctttagcctcccaaagtcctgggattacaggtgtgagccaccgtgcccggcttgatctcttatttttttaaattacattgaattttttttttttttttgatacagagtcttgttctgtcacccaggctggagtgcagtggcatgatctccgcttactgcaacctccgcctcctgagatcaagcggttctcctgtcttagcctcccaagtagctgggattacaggcgcgctaccatgcctggctaattttttgttgttgttgtttgtttttttttgagatgagtcttgctctgtcgcccaggctggagtgtaatggcgtgatctcggctcactgcaaactccgcctcctgggttcacgccattctcctgcctcagcctccctcccgagtagctgggactacaggtgcctgccaccatgcccggctaattttttgtagttttaatagagatggggtttcaccgtgttagctaggatggtctcgatctcctaacctcgtgatctgcccgcctcggcctcccaaagtgctgggattacaggtgtgagccatcgcgcctggcctacgcctgactaatttttgtatttttagtagaatactaaaaatacagggtttcgccatgttggccaggctggtcttgaactcctgacctcaagtgatctcccctgccttggcctcccagaatgcttggattacaggcataagccaccatgcccagccctgatctcttatttttattaaagttttgaaatgccactccctaaaaaggttgcatcaatttgtaatgtcattagcaatgtgtgataggtctagttttatcaaacctttgtcatgtatgatatattaaaatctttatcttaacaacagaaaaaaagtagttctaagcttttacttacttgattagtaggactaatgaatattttgaatttctttttcttttttctttgagacctgagtcttacactgttgcccaggctggagtgccgtggcacgatcttggcttactgcaaccttcgcgtcccaggttcaagcagttctcctgcctcagcctcccaagtagctgggattacaggcatccaccaccacgcccagctatttttttgtatttttagtagaaatgggttttcactatgttggccaggctggtctcgagcacctgatctcatgatccacccgcctcggcctcccaaagcgttgggattacaggcatgagccaccgcgtcagcctttttttgaattttattacttgtatttcttgcgaattgcccagtcgtgttttgtccatggtttattggggtgggggcattctaactgtttcgtatcattaatttaagcttgttgtatgacatatttgctctaagaatttcacctcatttcattgtataggtaattatcttttgtgtagtgaaaagtcccattatttcttttagttcatttaagattttattcaattatttatagaagtagtaagataaatatttgtagataggtaaacaaagcattagaatttttgacttttagaaagtaaaatcatttgatttaatgtctatttttgttcattcctatttcctatctaattaatagaacacagtactgggaggaggaacaaaattttaatcatgatattgctgtttttcataataatctaggactagtaataagtcctctctttcatccagaaaatattgaaggccggatgccatcacctgtaatcccagcacttgaggctgaggcaggctgatagcttgagctcaggatttcaaaatcagtctgggcaaaatggtgagatcctgtctctacaaaaaaataaaaaattagctgcatgtggtatgcacctgttgcctcagctgtttgggagactgaggagggaggatcgcttgagccttggagattgaggctgtagtgagctgtgatcatgccactgcactctagcctggtagcagagcaagaccctgtctcaaaaagaaaaaaaaaaagaaagaaagtattgagaagttaacttatttcattaccttaatgaaaaatagttaaggccaggtgcagtggctcacgcctgtaatcccagcactttgggatgctgaggtgggtggatcacctgaggtctagaatttgagatcggcctgaccaacatggtgaaacctcttccctactaaaaatacaaaaatgagccaggcatgatgccgggcgcctgtaatcccagctaaaaaaaaaaaaagattttttccaaatacagtatttttattaaatcttattgagtagttttcacattggcaactctgtgtgtttctttctttttttgagacagagtttcgtgcttgttgcccaggctggagtgtgatggcacaatctcggctcatggcaaccttcgcctcccaggttcaaacgatactcctgcctcagcctcctgagtagctgggattacatgcatgcgccaccatgcccggctaatttgtatttttagtagagatggggtttctccatgttggtcaggctggtctcgaactcctgacctcaggtgatccgcacccccttggcctcccaaaatgctgggattacaggtgtgagccagccaccacacccagctttttgtgtttcatatgcatttttttttttttttgaaacagagtctcactatgtcgcccaggctggagtgcagtggcacagtattagctcactgcaacctctgcctcctgggttcaagcaattctcctgcctcagtctcctgagtagctgggatcacaggcgtgcgacaccacgcccagctaaattttgtatttttagtagagacagggtttcaccatgttggtcaggctggtctcgaatttctgacctagtggtccgcccgccttggcctcccagagagttgggattacaggcatgagccatcgcgtctggcctcatacattttctaaatgacttttgtaaatttttttttttttttgagacggagttttgctcttgtcacccggactggagtgcagtggtgcgatctcggctcactgcaacctccgcctcctgggttcaagcgattttcctgcctcagcctcccaagtagctgggattacaggcgcccgccaccacacctggctaatttttgtatttttagtatagatggggttttgctatgttggctaggctggtctcgaactcctgacctcaggtgatccacctgcctcggcctcccaaagtgctgggattacaggcgtgagccaccatgcccggccagtttttgtaattttaaagagaacaaaaatcctgagatggaaacttatgtagaattttattcatagttgaagttagttacagtggaaataaaaactagaaagttgcattgtatcttctaaacatatgtatttaacataatttcacatttcattatagatggttctttggaatgatatttaaaaattttgtggctgggcgcagtggcttacacctgtaatcttagcactttaggaggctgaggcaggcggattgcttcagctcaggagctcaactagtctgggcagcataacaaaaccctgtctctacaaaaaatacgtaaattatccagctatggtggcccgcgttagtagtcccagctactcgggaggctgaggtgggaagatgacgtgaacccaggaggtcgaggctgcagtgaggtaaaatcgcaccactgcactccagcctggacaaagtgagaccctgtctccgaaaaaagaaattgttataatgaatgaatagatttacattgttagtttagttttgttttttttctcagaagtgtagagtttgttcttagtctgtccatctgtatacaagcatgaactgtacagtcaactgccttgtagaggggctggtttttggttatgtcttaaatcttaactccttttaattattctgaattttagtgggattcctatatcattgtagatttggaaagtattgagtaggagatgataatctataatcaggattctgagttggtaagattttatagatctgaaaaaagtaatttcttgaccttggcctcaataagaaagtcagaacttgacccttatttaccagcaccatcccccccaccacaatatttaaagtgtttaaatcatttattttgaaattcttatgtgatccaagaccactgtgcatttaagctagtttatttgtttattaaaacaaaagaagtagactgcagttacgttgtttctttttctgttgtttggtgtcaggagtagaatacatttggccagcttcatgagaggattagaaagttggagaaggaaaaatagaattgtttacggagccaggagaataattgtctataattatagatgcttgttttgaggtttggaaaaggtggtttaaaaaacttttaagaaaaaacatgataaacatctataaatatgaggaagaaaaattggttgcaacattaaaaaaatttttttttgagagggagtcttgctctgtcgcccaggctggagtgcagtggcaggatctcagctcactgcaacctccgcctcccgggttcaagccattctcctgcctcagcctcctgagtagctgggattacaggttcctgccacgatgcccggctaatttttggatttttagtagagatcgggtttcaccatgttggccagactggtctcaaactcttgcctcaagtgatcagcctgccttggcctcctaaactgctgggattacaggcatgagccaccgctcttggccaggttgcaacatcttcattagacttgtttaaatgagaattttcctttgttaaatggaagaaaataggctctgtttgggagagtgaggcccaagtaggacatccttgatacacattgaagatctatttatttatttatttaaattttttgctctgcaaaattgaccaaagaatgaagatcattttagttggttaatatttcagttttgacttcctggccagagatagtagattggaaaggatttagagatttactgagggagttaacccaagattttaacattgtgatgcaaaatgatgttaaaacgcgttcgtttcccttttattatttaaagaaatcctagatttctttaaataatacaaagtaattaaatggacctgttgggttatttgaaattaagcagtagacaggggaagttcttgtaagtggttactaaagcgttaacattagaggcattctccactggctggctgtagcagagtccctgatctgggctttggagaaatccatcccacctttttttaggtgcctgctttacgtcggatctactttctctactcgtgccttttcttccaccttcttccccctcctctttctcatagatggtgtggaggtgggagagagggagggagagggagatcaactgattattgtgtgttgagggggtggggggtcagagattctctgggccataaaagttgcacgaaataaaatgctcttttttttcttgtgtgggccctgccatgagatcaggttgtcggacttgattgggagccacggatcccgccctactgaaaacattgttgcaggatgggatgggatgaagctgaaagtcttatcaagtggtattatatctggcacaacaaaaggccagaaccccaaaatatcctaaggataaaaagtttttgtttcttttcataggatatttttgtatctggtttggaaggatgacttgacttggattgtactgttaaagacaaaatgaactattgtatttattatgtatttaaccttattaaagcattaagtatgacagcactagttatagagaattgtgtgtgtatgcacacatatacacacatatacatatatacacacaccatatatatattttttttgagacttggtctcgctctgtcatccaggctgaagtgcaggagtgagatcttggctcactgcagcctcgaccttccaaccccagtgatccttccacctcagcctcccaagtagctggggccgtggggatgtgccatcaccaccagctaatttttttatcttttattttttgtagagacggcgtctctcgatgttgcccaggctgacctcgagctcctgggttcaagtgatccacctacctcaacctcccaaaatgctgggattataggcgtgagtcactgggcccggctgagatgtatatattatatatacatctcatatacatatacatatatacataatctcatatataaaaattatacattatatataatatttataatataatatatataaattaaaacttaaaaaaaattttattttatttgagatggagtcttgctctgtcgcccaggctggagtgcagtggcgctgtctcggctcactgcagcctccacctcccaggttcaagcgattctgctgcctcagcctcctgagtagctgggattacaggggtgtgcttccacacctggctaatttttttttttttttttgagacagggtcttcctccgtcgcccaagctggagtgcgagggcgcgatcttgactcagtgcaagctccgcctcctgggttcacgccattcttctgcctcagcctcccgagtagctgggattacaggtgccagccactatgcccagctaatttttttgtgtttttagtagagacggggtttcaccatgttggtcaggctggtcttgaattgctgacctcgtgatctgtctaccttggcctcccaaagtgctaggattaccggcatgagccaccgtgcccggcctatatttttaataatgaaatcagaactaggtttgtaaacagggaaagaacaaataatcataaaagttttatattctggatttggaagttggttgatttaagagtaatgagaataaataatatcccctccccctttagttctcaaggttttccacttagtttaagtagttttattagctatagtagagtaactcagcattttgaaatatttgtataatttgaaaagtctctgaaagaacactgtgattcgggtatagcattgcaagtttgaggggtttcaacagatttcttcatgtgtgtttaattccatgatgatttaaaaaaaaacccaagaaataaaacctctggtcacttaaccagcattttattttatttatttttattttattttattttttttgagacggagtcttgctctgtcacccaggctggagtgcagtggcgtgatctcagctcactgcaagctccgcctcctgggttcaagcgattctcctgcctcagcctcccaagaagctgggactacaggcgcccgccaccacacctggctaattttttttttttttttttgtatttttagcagacatggggtttcactgtgtggtagccaggatggtctcgatctcctgacctcctgatgcacctgcctcggcctcccaaaatgctgggattacaggcgtgagccactgcacctggcccacttaaccagcattttaacatatttcttctgaaaatctgattaccagaatttaattacattagaagaaattttttaaaaagctcataactattacgtagcaaatatgttttcaaagaacttgttttaaggtgggtcttggtggctcacacctctaatcccagcactttgggaggctgaggcaggtggatcactcgaggtaaggcgttcaagaccagcctggacaacatagtgagaccctgaccctaaaaaaaatacaaaaattagccaggtgtgatggcacattcttgtgtgatcccagctaatcgggaggctgaggtggaaggatcaggttgagctccggaggtcaagactgcagtgagttgagatggcgccactgcacttaagcctgggtaacactaagcctgggtaacagagggaaactctgtctcaaaaaaaaaagagagagaaacccacccagtttgatgaattagatgcatgttaagtgaaacagttttttagatagtgtagaattaacttcattatgttcacagttaaattcatattagactgttacctattctaagatatttgatattaaccctcaagggacattggctacattttttttttttttttttttaacaaaaccttgtagtttatgttagtggtctccaaactttttggcaccagggactagttttgtggaagagagttttttccacagaccccagggggagcacggagtggatggttttcgggtgaaactcttccaccttagatcatcaggcattagttaggttagttagattctcataagaagcatgcagcctaggtcccttgcttgtgcagttcacaatagggtttgtgcttctatgagaatctaatgccgctgctgatctagaggaggccgagctcaggttaatgctggcttgcctgccgctcacctgctgtgtggcctggttcccaacaggctaccgagtggtattggtctgcagctataggtggggggaaccctgagtacgataaactatcttctagaataatttttttaatatattgaagcagtagtgcctagtttataagtagacatatgtatagtataaactatatagtttatattcagagtacaaaatccaccttggccactatttttttttttctttttttgagatggagtctcactctgtcacccaggctggagtgcagtggcacgattttggctcactgcaacctctacctccctggattcagcgattctcatgcctcagcctcccaggtggctgggattacaggcacacgtcaccacacccacctaatttttgtatttttagtagaaacggggtttcgccatattggccaggctggtctcgaactcctgaccttgtgatctgcccacctcggcctcccagagtgctgggattacaggcgtgagccaccccacccggccaccttggccactattacaaaagtaaagctaaataatactgaagtatatgttccatattttgtaaggactgttgatttggaaacagtgtattctaacaagataaattttaaatgtaactaatagtatatgtttctgaataaatagttgctgcttctaatataaagtgtcatatttgttttaaaatcattgctcaagttgtatagttgttttgggcacgtattttcaacttctagaccaatacaaaatgtaaaataagtaaaagacgtgatatagttgtatcctttctaaacactgacctattttttttttttcctttgctaccttttttttttttttgagacagagtctcgctgtgtcgcccaggctagagtgcagtggtgcgatgttggcttactgcagccttcgcccctcgggttcaagtgagtctccggcctcagcctcccaagtagctgggattacaggcgtgtgccaccatgcctggttaagtttttgtatttttagtagagaccggttttatcatgttggccaggctggtttcgaactcctgacctcaagtgatctgcctgtcttggcctcccaaagtgataggattacaggcgtgagcctccgtgcccggcccctttgctacattttaatgataatgaaaatgtaatccaagtgtcagattattcagtagcttcctgtcttttggtttgtgggaagtttgatacgttattttttaatgtttcttagtcctttgttatatttcatggatagtggggaagtgagtctgtgacttgattgaaatatattgtacaatgcattcatctgcatcataggcacttggcttttaatggtaaagtggaaactaaacttctccttaggaacaatttgcactaatttatttaactgatattgatgatgctccataaagataaaaatgtcattgcatggaggcttacttgtgatgtaatttgtactttggagaagtaaatcatagtatgattttagatgttttattaacatctaaaatgtttcagtttctgtagtagaatattgttaaataaaatggtaaacactgtaaaccttaatactccttcccaagaagaaaccattaccaccactacctcttctccctccaaaacagaaaccattaccacctccacctctaacaacagaaaaaaaaaaccaaaaaataaaaaaacccttttttggccccacaccttttttggctcacacctgtaatcccagcactttggaaggccaaggcgggatcctcttgagaccaggagttcgagcccagcctgggcaacatcaggagacctcatctctactaagaaaaaaaaatggctgtgtgtcgtgatacacctatagtcccagttatttgggaggctgaggcaggaggatcacttgagcctaggagttcaaggctgcagtgagccatgattgtactactgcactccagcttgggcagcccaggaagactgtgtctcaaaaaacaaacaagaacacctttttaatctgttaactcatggtttgtttaagattttcttttagccatttttgatgccttttttttttttgagacaggttctcactctgtctctcaggcgggagtacagtggtgtgatcatggctcattgcaccctggacttcccagaatcagatgattctcctacctcagcctcccaagtagctgggactacaggcacacaccaccatgtccagctaatttttgtattttttgtagagactgggttttgccatgttgcccagagtggtcttgaactcctgggctcaagtgatccacccaccttggcctgccagagtgctgggattataggcatacgccagctgcacccagcccatttttgatatctcaaatctttcatcatagtttagtcagccatatttttcctagaatttttttaaaaactattttgtcttgctatcaagctattactctgtagttttacatacattctttattttaactaaactgttatgagcaataatttgtgataacttttttttttttctgagacagagttttgcttttgttgcccaggttggagtgcaatggcgcacatgatcttgactcactgcaacctctgcctcccaggttcaagcgattctcctccctcggcctcccgagtagctggaattacagccatgcaccaccatgcctagctaattttttatttttagtagagactgggtttttccaagttggtcaggctggtctcaaactcccaaccttgggtgatctgcccacttcggcctcccaaagtgctgggattacaggcgtgagccaccgcaccctgccaatttgcgataactttttaatctttttgtatcgtgtatttaaacttttaagttcttttccctgtcaatttctgacagattgaaaaataataatctttatattatttaaaagcttcttctaaaaggtacaaaggaaaaaatagaatgcaaagtgaactaggcagcgtgtagtggctcctgcctgtaatcccagcactttgggaggccaaggtgggcagatcacatgagaccaggagtttgagaccagtctggctaacatggcgaaaccccatctctactaaaaatacaaaaattagccaagtgtggtggtgcatgtctataatcccagctacttgggaggctgaggcatgagaatcacttgaccctagaaggtggaggttgcagtgagcagagatcgagccactactccagcctgggcagaaaaaaaaaaaaaaaaaaaaaagtgaagttaaactaaatttagatctgttgagtttgaaatgatggttgtatatacctctaagatcagtaaaacctaaatcaatctagagaacaggtgttaaagatacatttttggtggggtgtggtgcctcatgcctgtaatcctgccattttgggaggccaaggcgggtggcttgcttgagctcaggagtttgagaccagctgggcaatatgaagaaaccccatctctacagaaaatacaaaaattagccaggcacagtgctacacgcttgtggtcccagctcctcagaaggctgaggtgggaggattgcttgagcgtgggaggcagaggttgcagtgagctgagattgtgccactgtactccaaactgggcaacagagggagaccctatctcaaaaaacaaaacaaaacaaaacaaaaaaacaaaaaagattttcatgctctggtaaaataagtattaaaattaggaaactatggatgaattgaatgttttggtctggtcgaagtactgtgcattaaatttttggttacattttactttgataagcagtgacggttcagtaattttgatgatagtctatacatcatgtaacttgacttatttagttgtcaacaaatatcttttttttttgagacctgagtcttgctctgttgcccaggctggagtgcagtgctgcgatcctggctcactgcaacctctgcctcccggattcagattttcctgcctccgccttctgagtagctggattacagatgtgcaccaccacgcctggctaatttttgtatttttagtagagacagggtttcagcatgttgaccaggctggtcttgaactcttgacctcagaagatctgcccacctcggcctcccaaagtgctgtgattacaggcgtcagccaccgcgcccggcctagagataccttttaaggtggttctaaagcctcagaaattatttatcctgaagagaaagattaaagttttattcattgcattatgagggaaagtttaggcagagtatcttatggttttgtttttcattaaaagatcaatgttctttcagattttaagtccatttaaaaactttgcatagtaatatatgtacatggttgaaaaaagtctaatagcccagaatgcttataataaggatcaagaattctgtttcactccttattgccactctccaaacaacttttttgtatcaatttaagggttacaggtgcagttttgttacatgaatacattgcatagtgctgcagtttgggcttttagtgcatccatcatccaaataatgtacgtgtacccattcagtaatttcttgttactcaccctcctcccagcctcccaaccttctgagtctccagtgtcgttattccacactgtgcccacatgtacacattattttgcttcaacttataagtgagaacatggcctccaggtccttccatccttccacgttgctacaaaagacatgatttcattcttcctttatggctgaatagtattcgtgtgtgtgtgtgtgtgtgtgtgtgtgtgtgtgtgtgtgtgtgtatgtgtcccagtttttctttatccagtcgtctgttgatggatatggagattgattccctatctttgctattgtgagtgttgctgtgataaaggtacgagtgcagttatctttttgatataatgatttattttcctttgggtggatacccaatagtgggattgctggattgaatagcagttttattttttatcatttttacttttttgagatggagtttcgctcttgttgcccaggttggagtgcaatgacatgatatcggctcagtgcaacctctgcccaccaggttcaagtgattctcctgcctcagcctcccgagtagctgggattacaggtgcacaccaccacgcccagcaaatttttgtatttttagtagagacagggttttaccatgttggccaggctggtcttgaactcctgacctcaggtgatgcacctgccttggcctcccaaagtgctgggcttacaggcgtgagccaccgtgcctggccagcagttttattttttagtcatttgagaactctttatatggttttccatacaggtggtactaatttacattcccgcccacagtgtgttaagtgttccccattgtctgcatcttccccaacatctgttattattattgtttctttaatagtggccattctgattggtgtaagatgatatgtcattgtggtttttatttgcatttcctcgatgattagtgatgagcatttttttcacatacctgttgactgtttgtatgtcttcttttgagaaatgtctattaatgtcctttgctaactttaaaattcttaaaaattttttattaaaattttttcttaagaccagttaagtgcagtagtgaaaggggagtaaagagtatagaacaaggaatttgatcggtaactgacagtgaaccatcaattgggataactcactaccagttatcagtagtgaggtattcagaacagccctttgcttactttttgatgggattatttgtgttccttgtaaattctggatgttagtaccctgtgagatacatagtttgaaacttttttctcctattctgtaggccatttgttcagtctgctgattcttttgctatgcagaagctttttagcttaagtctcatttgtctatttttgttttttttttttttgcttgtgcttttgaggtcttagtcatgaattctttaaattcatgaattcttagtcatgaattgtatagatcagtgtccaggagagtttttcctaggttttcttctaatggtttttatagtttcaggtctttggatgaagtctttaatccttcttgagttgatttttgtatatggtgaaagataggggtccaatttccaaaggaaactttcaaattatttcttcctgtggtattgtcgtgactatataatatacatatgttatgatttatgattgatttctgctctgataaaggaggatttggcttctttacatctgcttccccaatagattttttaaaaatcacttttaatttctctgctagttatctctgcagtttatatcagaactttccttcatgttatatagactgttgatcttgatgtaccaagcagtaacttttgtttgtttgtttgtttttttgagacggagtttcactcttgttgcccaggctggagtgcaatggcgcgatctcggcttgctgcaacctctgccgcccgggttcaagcgattctcctgtctcagcctcccgagtagctaggattacaggcaggcgccaccatgcctggctaattttgtatttttagtagagatgaggtttcaccgtgttggtcaggctggtcttgaactcccaacctcaggtgatccacctgcctcagcctcccagagtgctgggattataggtgtgagccaccacgcccggctgcaactcttctttttacctttccttttccctttatgtgcttacatctgtcatttctgacattgacattgtcaaggttgagaacagttatgcgctgtattgtactccttactactttgtttgtttatttatttatttttttgagacagtcttgctctgttgcccaggcttgagtgcagtggtgcgatcttggttcactgcaacctccgcttcctaggttcaagctattctcctacctcagccttccaagtagctgggactacaggtgcgtaccaccgtgcttggcaaatttttgtatttttagtagagacggggcttctccatgttggccaggctggtctttaactcctgacctcaactgatccacttgcctcggcctctcaaagtgctgggattacaggtgtgagccactgcacctggccggtatgactttaatacttgaaagttaatgggctggacgtggtggctcacacctgtaatcccagcacttcgggaggctgaggcgggctgatcacctgagggcgggaggccgagaccagtctggccaacatggtgaaaccccgtctctactaaaaatacaaaaattcgtggtggcgtatgcctgttatcccggctacttgggaggctgaggcagggagaattgcttgaaccccggaggcggaggttgcagtgagccgagatggtgccattgcactccagcctgggtgacagagtgaaaaaaaaaaaaaaaaagttaatgaatagtttctacattattatgatcatgtaatatttttcacagcagaggcaagtagtatgtaattacatttctttgtattgtttcttggtttttgaatctgtaactgcatttttcttgtcatattttcacgattcattttatcaatctttttctgtggtttgtcattattacttattttatgcatatcaagtccctcccaccctcccctgctttcccttagtcctatttccttcagtttgggctagaagtatttagacctgttgccttgtttttgtgctgaacttttccttactctttttgcacagtgctactactgttattagagctttatcatttcttgagttactaacttgttttaatgcagtacacccacataaatagctaagaaagaatatgtgagaaataaagttttgaatccttgcttatctgtaaaagtcctcattagcccttacagttgactggtattattttattcaagtgcaattaagctgaaaattgttttccctcagagttttgaagggattgctccagtgtcttctatgtccattgttgttggtgaggaaaagtcggatactgtgtgattcttcttcctttgtgggtgatgtgtttcatattttcatccatccctttagagccttcttttatcctcattaaactgaaatttctcaaagatgtccagatgtgttttcttctccattacaataagcaaaatactttatgtgcttcacttcttgaaagttttcatgttacggctttagtgatctttcttttttttatttttttgagacggagtcttgctctgttgcccaggctggagtgcagtggtaccatcttggcacattgcaacctctgcctcctgggttcaagctattcttcttcagcctcccaggtaactgggactacaggcacctgctaccacacctggctaagtttttgtatttttagtagagagggggtttcaccgtgtttgttagccaggatggttttgatctcctgacctcgtgatccgcccatctcggcctcccaaagtgctgggattacaggcgtgaacccccacgcccggcctctagtgatcttttctttgttttctctatagctgcttttagttggattattagacttactgaattaatcctccccaatatttttgtctgtttgtttgtttgtttttttttggtctggccatctcttctactttatttattcttggaccttttaattttatattggaagttatattttaaatgtttgagatttctccttcatttcctcccccgccaatatcttttctcattttatggattaataatcttcttgagtctctgaaaatgttaataaggtttattttttttttaaattttgttgccctccctcttacctgtcaactctattgtaatttttgttgttatcttagtctcatttatattgtaggcttttaaccaaatatctgctgaccttggatatcactcagctttaagatttagtagaagggttcacaatgagctcttggtgggaattaatggttggcaggcaggctttactttagggttaagctgttaattagtcttttgtattctgacattcaagagtccattgttttaccccaaagtgccaactcccatgctaggttcactagtttcctctctcccagactccagtttctttactttagaagagatctctttccattaattttactttgttttttaataataatttggctttaaatttttttaaactactgtttaaaatggtcttttgctgaagagagataaatgtatatgtttgatctgctatttgagccagagaatctctttcagttctcaaactggactagaccaaaaactaataattatttagatatttatttatccagtgtttcagaatgtgttaggttgtagaaatataatagcagctttaagtggtgtaggaggtgttttgcgtgtttataaaagcgagtactggctgggtgcggtggtgagcgcctgaaatcccagcactttgagaagccaaggtgggtggatcgcttgagctcaggagttggagaccagcctgggcaacatggtgaaaccctacccctaaaaaaatcccacaaaaattagctgggcttggtggtgcgaacctgtagtcctacctactcagaggctgaggtgggaggatcccttgagcccaggaggtggaggttgcattgagtcaagattgtgctgttgcactccagcctgggtgacagagctgaaaccctgtctccaaaacaaaactgagtactcattatgtgtgttaagccttttacagtatgtggaagattagaagatgtcacataaaaagttatgaatgtaatacattctggtaaaaataaagagcacaggagggcataacttaaaaagtaaaaggggctgggtgcagggggctcacgcttataatctcaatacttgggaaggccgaggtaggaggatcacttgaggccaggagtttgaggccagcctgggcaacatgtgtttcactgggtgacagagtgagcctcttatctaaaataaaaaacaaaaaatgtgaaagaccctcttttccctgttttgccccacatttcagagacaattactgtatccttgacttttgttatgggtatacctttgctatttctatgtatgtgtatgtacttatatccatttttatgataatgggatcatttaatttatatcgtgatttgattttgtcactttgtggttgatcttaggcatctttccattttagcttatacacatctatctcattcttttcaaaatttatccaaagatatgaatcacgtgcttaatttgccaaggagtgttttaggtgtaaggattcagtggtgaaccagagagaccaagctcctgcccttatggaacaatatttcaacggtgagaaacacaaaataaatgcatttctcgtaattagtctcaaatactgagaagtgctatgaagaaaataaaatgtggtactgtactgagtgtgtctgttaatggtatgagagagaacgcatgtggctaaggtggtcaggaaggtctgtatgaagtgatggcattgaaacacacgtgaatgatgtggaggcattttaggaagagcaggatttattgtgaagactcaaaacaagaatgagtgttgtattagtgcgtttactgctgataaagacatacccaaggctgggtaatttttaaagaaaaagaagtttaatagactcatagttccatgtgtttggggaggcctcacactcacagcagaaggcatgtcttacgtggtggcaggcaagagagagtgagtaccaagtgaaaggtgtttcctcttacaaaactatcatatctcgtgagatttattcactaccaggagaacagtatggggaaaccacccctatgattcaattctttcccactgtgtccattccacaacacgtgggaattatgggagctttaattcaagatgagatttgggtggggacactgccaaaccatatcaagtgtgttatactcaagggatcctcccatctcccaaaataaacgattggtgttactgtgcaatgaggggaacttaggagaccatatttgagaggcaagcaggagcccaagcagtgcccttcacaccgtggtaagaagctgggattttatccttagtgcagcaaaagcccttagaaggttataaaccagggcacccataaggctgtgaaagtaaccttgacagatatggcttagagtagagtgatggcagaggagaaaggcaatcagaagtgtttggaaagctcaggaggctgaggcaggagagaattgcttgtacctgggaggtggaggttgcagtgagctgacatcaagcccctgcactccaacctgggcaacagagtgagactccatctaaaaaaaaaaaaagcttggaaagttacagcggtaagatctgctaaaggatttgatgagatggatatgagataaagaagaattaaaattgtcttctagatttgtggcttcagtagttgagtggacagaaatgtcatttacttagattagagattgatcttagtggagaaacaggttttaaactagattgaaggccctctgattagttaaaccattcccctactgatggtcatttagttgatttccagttttattatctttgtaaggaatatccttgtacttgtgtatttgtacgtgtggacatattctggaagataaattcctagatgtaaagttctctcatcgaagaggacagtacatatgtttcaagttttgatggatattcattagttgccctccaaaagtgaggtgttggcttggattcccccaacagagtatgcctttttcctggcatcctcactaacaacatacctggtgggagagaaagtaggcagggcctacatttctgaaaatgggagtgggagttctaatagcattttttctttactaaatcactttggcactttgttcctagaatgaaaatcagcaattgtcgttttctttttggtatccctaaagtcataacatgtctctggccatagttttttccagttactaatcatatagctgttggtcagtccttctaggcttagtggtatttatggagcctttcataataattatgagaattacaatgaaaatgaaaactattaattggtttaatgtatgccaagcactatcctaagtgctttacacgtactatattaatttatttaatcctcacaacaacctaaaaagtaattactgttattatctcgatttcttgaagtgagacagaggatgtccaccaatctttgtcttttcatttatgtattttttaattaatttttttctgtcaaaatatcttttgggaagtttggcgctgttacttgaataccttttgtcagtagttgtgggtcagaatccaaacacagaataaatggcaggaaaaggcacattcagtttaggagaatgctctgcttatgggtgatagtgtttgtaatgctttgggttttggttttcagaactgcctatgttcaaatcccagcctcacacttagtagctgtttgatttggggctgatcattgatctatttttgtagctcagtcttctgagctttaaaatgggaaaacaaggttttgtaggttgtaggattgttgcgggcagtaagttacacatgtaaaagtggccagcacaagaggaagcactttatcagcatcaactaatatttttatataattggctaagagtgggcagtcctatctagcactcaaagtgtggggaaaatactggtgataggatatcacactcttactgagttatatatattaatatttaggtataaaacttagaaagtggggtggttcacgcctgaggctgaggcaggcagatcacttgaggtcaggagtttgagaccagcctggccaacatggtgaaaccctgtctctactaaaaatacaaaaattagcctggcatggtggtaggcacctgtaatcccagctactcaggaggctgaagcaggagaatcacttgaacccaggaggcggaggttgcagtgagccaagatggcgccactgcactccagcctgagtgacagagggagactgtctcaaaaacaaaacaaaacaaaacaaaacaaaacttaaaaatggttaggcactgtggctcatgcctataattctagtactttgggaggctaagacaggaggatcacttaagcacaggagttcgagaccagtctgctgggcaacatagtgagacactgtctctaactgggggggggaaagaaaagccaggtgtgcggccacgtgcctgtagtcccagctactcaggagtcgagatgggaggattacttgagcccaaaaggtcgagaatgcagtgagtcatggttgcgccactgcactccagccggtgcaacagagcaagaccctgtctcaacaaacaaaaaacccttaaaatttttttaatgctactattgttgtaatgagtcatattaagtgggattatacatgtaccaaacttttattttttcttgagtgagattatttcatggttattttaattggcatgccttacgattgagttaaattgattatatttgtcacttttttttgcaaactgcctaccagtaccctatttcgggtactttgcagcttcaaataagaaaaattttaattaaaaatgcattaaaccataaataaaatttacctcacatgactggaagtccaggtgtaattcagtggctcaattaaattatcacggacctagatggttttcattttcctgctgttttatactcagcttgttgtcgatagttgctaaattaattcacttaaataatcatttaccacctaaaatgtattaggcagtagtccataagcacgggaaatacagcagtgagcaaaacaaagttcattgccttccttcacgggcttatattttagtggggataagggagaagacagtcaaacaaataggtagaatttatagattgtcagaagatgttaagttttatggaaaaaaataaagccatggaagggacgggaagggctgggttggattgttttaagtggggccatcagagaaggcctcagtgagctgatgtttgaatagaatcttaaaagaaataagaatgcaaaggcagatatttggggaaagagcattgctgatgcggggaacagtgagtgcaaaagccccagaggcaggaatgtgcttagcatgttcatagaactgaaagggccagtgtggcaggagctgagttatggagaaaacatcataagagaagtagcgtggggagtcagattgtgcagggccttgtagaccattgtgagatcttttgacttttactctggattagatgagagtcctttgggggcttttaagtggaggactggctttatctgaccaagactctaaaactctcatgctggctgctgtgttgagactagaatgaaggagatcaaggaagaagcaggcatgttagataatattagcagggtaacagatgatttgaagcatgataggcatcagagaaatgttgaagtaattctgcatatgttgaggcagagccgaaaagatttgttgagggatgtggcatgtgagaaaaagaggattcgtagttcacaccaggttcaatgaccagtaaagatgaagtatatttgttcatgcacatctattttatttggaattaaaaacctttcctggaagcccttagcagattttttttttttttttttttttgagatggagttttgcttcttgttgcccaggctggagtgcaatggcacgatctcggctcactgcactgcatcctctgcctcctgggttcaagcgattctcctgcctcaacctccccagtagctgggattacaggcatgcaccaccatgcccggctaattttgtgtttttagtagagacagggtttctctctattggtcaggcaggtgatctgcctgcttcagcctcccaaagtgttgggattacaggcatgagccaccgcgctcggccaacagatttttttcttaaatcccatcagccgtgattggtatccatccatgtcctagatacaagtgagggtgagagagcaaggatgttccttgcagccatgataatgggaagtggactctgtaaggaacaggttgtgagtggggagtggctattggttaggtaactaatagtctgtttgtcattgcccatttttctgttaagtcgatcatcctttttaaatgatttgtaaataatttttgcatgctaagaaagtaagtatttgttatataattctagattctaaatattttggagctgtaaatgaggttttaaactctgagatcagttttctaattttgaaataaagtgaatctccattgaaatttacaagtaggggctggtgatcgcagagtccaatgcataatttatagtttttcctattctgggtgcagttgtcattttaacctgaatgccaggtagttatctttataaaactatcatgtgtgagttatagaggtagcattggggtggtggaaaaaaacaaaacaccacttttgaggtaggatctcactctgtcacccaggctggagtgcagtgatgcagtcatggctccttgcagcctcaacctccctggctcaagtaatcctccctctactcagcctccagagtagctgggactacaggtgcataccaccacacccggctaatgtttaaatttttagtagagacaagatatcactatgttgccctttcttccttcaaaaaaagctgataaactggcttattatataacaaggaattctcattttattttacttatattgtattattgttctttaatttcagtgatgtgaagcagtgttttttggaggttttgagtgtgagctttctcatcagatactgaagagtttttgagccttaactccattacttaattagctgtgtgacccagaccacttcattgtacagctccgttcttgttgtgctggggagggcattcacacaaaatacaatgaaattgtgcttcctggtggttctgatgtgactttaggcaagttcattaaacactgcgctttcaataagataatgcatgtggaatgctgagcacagtgcctttaagacactgaaggggatatgagaacagttccatagcccttcatttttacttttgattaagagttgtttactaataactaactaggtgagttataaatggggaagtagggtcattgtgaagtggctatgaaacagcatagaggatatattttaaaagctgtatttttactacctattttcaaactgcatatttcattttagtttggagaactttactgaaaaataaagaagtagtagtatgtgagtttggatcatttctgtggttaggtggtggctacactaaggcctttccaattcttggtcctgtgagaggtaggtagggttgtggggggtaggggagaacagataaatgagatacatttatatttttttgcatggtaacttataaggcattgccaagagagggaattcactgcaggcaaagaaaaatataaaacatagtgtatatagggctttgtagcatccgtggtttcaggcatttatgggagccaggcaggggtagggtatggggttgaaatgtatttcctatggataagcacaggactactttatatcacttaatccaagacccttttactggtgaggaatccagcatttaaatttatgtatgtatatgataaagctagaatttttccagatctgagactcaaagctctttgtgttttcgtttatactccagctcttttgaggagctttaaagtctagttacaaagacaggaaaaacaagaacggccacagtggctcacgcctgtaatcccagcactttgggaggctgaggccgagaccagcctggtgaatatagtgaaaccccgtatctactaaaaatacaaaaattagcccggtgtggtggtgtgtgcctgtaatcccagctactcaggaggctgaggtaggagaattgcttgaacctgggaggcagaggttgcagtgagctgtgccactgcactccagcctgtgtgccagagactctgtgtcaaaaaaaaaaaaaaaaaaaaaggccgggcatgcagtggctcatgtctgtaatcccattgctttgggaggccaaggcaggcagattacctaaggtcaggagttcaagaccagcctgttcaacatggcaaaaccctgtctctactaaaaatacaaaaactagctaggcgtggtggcaggcaccataatctcagctactcgggaggctgaggcgggagaatggcttgcacccgggaggcggaggttgcagtgagctgagatggaaccagtcagtgcacttcagcctgggtggcagagcaagactgtctcaaaaacaaaaaaacaaacaaaaaacaaacaacgacaaaaaacctaggaaaaacatacatgcaacagaatgttaaagaggagattttaaggctttttttttttttttttttttttttggagacagtctcactctgtcgcccaggctggagtgcagtggtgcaatctcggctcactgcagcctccgcctccctggttcaagcagttctctgcctcagcctcccaagtagctgggattacaggcgcctgccaccatgactggctaatttttgtagttttagtagagacggggtttcaccatcttagccaggctggtcttgaactcctgacctcgtgatccatctgcctcggcctcccaaagtgctgggattacaggcgtgagccgttgctcctggcagagattctaagttttttgagaatagtgactgtatttcttgggtcatggctctatcttatacatctggcacagtgtgtgtgtgtgtagcaggtgtctaatatttgttaaacacacatggtccttaatatcaaacggcatgggatttaagacatgaacttgggtttgagtctcagcactttcatttcttagttgtatgaccttgaccatttaatctgtttgatcttgaatgtccttatccgaaaaataggggacatactaattaacatctattgtgatgggttgtaatgagaattaaatgataatgtatacaaaatacctaacttgattggatttgtggtactcagtagctataatgaccattttaaccccaatatgagaaggattcactcatcacactgttgtatacttcgtagctattacttctttaatccccaaggacttgtttaacaaagtgttcttcagtttctacttcctagttcctttgtggaactggtaaaaatttaaaatatcttaacataatattttatttcaaatgataaacagtaaggtaaaatgtggtttttcttggacaacttatggtagaatgatgtctagaatatttagttatgtcatttaatactttttttctttacaatttaaaaaaaaatttattttattttagattcagggggtacacgtgcaggtttgttacatggctagattatgtaatgccgaggtttggcctgctagcgcagccatcatccaaagtgaccctagtacccaataggtagttttcaacctgtgtgcctcctcttctaccttctcttttggaatctctagtctattacttccatctttatgttcacatgtactcattgtttagctcccacttacaaatgagaccatgtggtatttgattttctggttctgagttacttcttttaggatagaggatgaaaaagagtgtagcctccagctccatccatgttgctgcgaaggacatgattccattcttttttatggctgtatatttttacctttttttgcgagggggagaggatttaaatatggaccagcataatgaagaaaatgtctgtaatcccactattcacataacccctgctagtttaaaaaaagttcgtgtaggccgagcatggtggctcacacctgtaatcccagcactttgggagtccaaggctggaggatcacttgagcttaagagtttaagaccagcctgagtaacatagtgaaacctcatgtctacaaaaaaataaaacttagccaggtatggtggtgcatgcctgtagtcccagctacttgggaggattgcttgaggccaagagttcgaggctgcagtaagctgtgattgtgccactgcactccaccaggtatttaaaaaaaaaaaaagtaaataattagaaaatttaaatagtgtaaactagaggcctctcctatcagtttgctagagctaccataacaaaataccacaaactgagtgacgtaagtgacagtattttttttttttttttttttgagacggagtctcactctgtcaccaggctgcacgatctctgctcactgcagtctcggcctcccaggttcaagtgattctcctacctcagcctcccgagtagctgggacttccagtctccagaattgagaaatttaatttcttttaatttaaaaaaattaagagtgacagttggctgggcgcagtggctcatgcctgtaatcccagcactttgggaggctgaggcgggcagatcacgaggccaggaggtcgagactatccttgctaacacggtgaaaccccatctctactaaaaatacaaaaagttggtcgggcgcggtggctcatgcctataatcccagcactttgggagtccgaggtaggcggataacctgaggttgggagtttgagaccagtatgaccaacacggagaaaccctgtctctactaaaaatacaaaattagctgtgcatggtggtgcatgcctgtaatcccagctacttgggaggctgaggcaggagaatcgcttgaacccgggaggcagagattgcagtaacccaagatcacgccattgcactccagcctgagcaacaggagcaaaactccatcccaggaaaaaaaaaaaagtctaagtagtccccaaaacataaaatttgagcctaaaataagaactgttttaaaattttaatatattgtgttttttcgccatacaatcccaggtattcttcaggttagaactcagtttcacaaaaaagggtgtgcttgaaaagcttaccaaaatctcctgattagatacttttttcgtttgtttctgtttttttgagacagtctcgctctgtcgcccaggctggagtgcggtgccacaatctcggcttacgcaacctccgcctcccgggttcaagcgattcttctgcctcagcctcccgagtagctgggactactggcacacaccaccatgcccggctaatttttgtatttttagtagagacggggtttcaccatgtcgacaagtctggtcttgaactcctgacctcaggaggtccacccacctcggcattccaaagtgttgggattacaggcgtgatccaccacgcctggccagagcatacttatttatttagcaggtgtggatatgtgtatttaaacagacttacttgtaaatagatgtataaatgtatacccataatgaatgaaattaatgaaattatatatatttatatattcattataagaggttacaatttttttattttatttttatttatttattttttttttttgaagaggttacattttttccccccagcctagaaagcttcactgcataacatgattatgtgggaatttcagagttggatcactttgcattactgtaaatgatagagctttaaagtattttttattctaaaggtatatgtgcttttcataaattcaaattctaagaaaaggtatacatcacaagttcagttttactccccagaggttatcactggaagctttttttgtatatttttctagatgtttttggtttgtagataagacgtgtatgtatgtagaaaaaaatacagacataggcatatatattctttgaaaacaaatggaattaggccgggcgcggtggctcacgcctgtaatcccagcactttgggaggccgaggcgggcggatcacgaggtcaggagatcgagaccatcctggctaacacggtgaaacccggtctctactaaaaaatacaaaaaattagccgggtatggtggtgggcgcctgtagtcccagctacttgggaggctgaggcaggagaatggcgtgaacccgggaggcagagcttgcagcgagccgagatggcaccactgcactccagcctgggccacagagcgagactccgtctcaaaaaaaaaaaaaaaaaaatggaattatactataaatactgttttgtcacttttttttttggcatactagtatatgttatacatcttttcataggtatattgtgattaatgtaggtgcagttcagtaatgattgaaatgaagttttttcattatattctatttttgaaaaattaccaataactacatatataactgaaatcacatcatgtaactgtcagtataaaggaatggctcagataaaaccaaatagaagttgtatatttaatatttttaataattttaatatttaattaaaaagttaaaacttgtactacatggctgtttattagggtaaggaagtatgatctctttaatgtacatggtatttaaaaaatatcttattctggtgtgtcttcttgattgtaaaaccccacttaacattttgggctcctatttatatctttttactttaaagtaacactattctgtggttattcttatggcatattaaagtgatattttaaggaatacttaacaaaattctatataaaatgtatctactctaagttagaaatcttggtgcccttactggtcttgtgatcttggaagtcacttaagatcccgagctctgtattaagacagtgctggttcaagttctggatctaccattgagtaattgaccatgactttctttatacttcagtttcctcaactgttgaataggaataatggttgttgtgatgagtccataaaaaatacagtcttactgactttatggtggccgaaatttcaagagtaacacagtaacagttaagtcatactgggactcaggctaatcttttctccgttgccctaggcattgatgtccacctggcaaatgagggtgagaagcggtgagggattgcatgggaggtttggggacaaggcctgggagtagtacagaggcatctttcacttttgcccacatttcattgtccagaccagtcatgtgaaagggaagctgggaaatgtagtttagccatatgccaggaggaaaaggaaacgctttggtaaatagccagtttttgccaccagtgctaagcacagttcctggaagatggttttcaagtcattaagcaagtcacttttcacctctccaggtccgtgtttctttctgtaaagtgggaagggggatgataatgaaaacttctatgaagcactgttttgggagaactatatgttataaccatcttaactcacttaattcttacaaaagtcctctgaagtaaagactactattgtccctttttttttttttttcttttttaacagctgaggaagctaaggctcagagtgagtcatggacacaggatttgaacccaggcagtcttttctgtagggtctgtgcttttatttatttttatttttattaattttttttttttgacggagtctcattctgtcactcgggctggagtgcagtggtatgatctcagctcactgcaacctcgcctctcaggttcaagcacttctcctgcctcagcctcccaagtagctggtattataggtgagtgctaccacgccaggctaatttttgtatttttagtagagtcggggtttcactgtgtttgccaggctggtcttgaactcctgacctcaggtgattcacccgcctcagcctcccaaagtgctgggattacaggcatgagccactgcacctggcctcaggcataatgtgatatcgtttataaatattagagaatgtagttctaaaaagtgaaggcttaagaaaaacctaataccaccatcatacttaaaaaaaaattgacagttaaatccataatatcatcatattctatgttcaggtaaacacgtctcaattttttttttttttttttttttttttttttttttttttgagacggagtctcgctctgtcgcccaggctggagtgcagtggcgggatctcggctcactgcaagctccgcctcccgggttcacgccattctcctgcctcagcctcccaaggagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaacacgtctcaatttttaaaagtatttgaataaggcttacttattgcgattaagtgtcttaatctgtaggataccaccttcctttttattctcacaatttatttgttaaagaaatgggttatttgccctgtagagttcctgtagtcaggattttgctgattcctgagattcaataccaggtttatccccgatgtttctctattttctgtatttccaaatgagtagttagaaccagaggcttggtcagagtcaggttcagtcttattttataagactgcttcttatattgtggtgcattctttcatcaggaggcacaaaatatggttgtctctttttgtgacattagcaactgttggtgactaatgcctagatctgttgattcattaagagttgtaaaatgataatgttctagttgtgttactccttcattttattatctggaatactgttttataaaaagaaaagtttccatcacctcttacttggttgcccagtgtaactgttcatatgggaaaggcagaataaatgtttgcttgtttacctttctttaccagtttccagtgtaatcagtaggttcactgtattttccagctgtgattaataaatttttaaaattattatttttaatgtatctgttactgtataggacagtatctggaaatacccaaagacaagatctctaaaggagtcatcggctagtggtggatcagtgcagcgtggtggtggtggtggtggtggtggtggtggtggtggtggtggtggtggtggtggtggtggtggtgttatgcacatgggggataatatagcagaggcatttagcttgaaatcaggaaagagctctggagttatccttgagctgcattttgaaggttgagtagcagtttgctattggaggaggtagaggttacttttcaggcagagggagcagcatgtgcaaaggctctgagatgtgagagtttgttactgaagaaattcagtagggctggaagctcagtgagcttggtgcgagagagtcaagagatgaggctttagaggtagtatgggttttaagtcattccaaggaatagttttgatttaactctgaaggccatggagagacattgaaaggttttatccaagtgaatgatgtaaggaacaaactgtggaactcttggggcagcactgaggagagtgactcatgatgccccttttctgaactgcttatacagatttctcattcttggcattactcctgattcctccttcatctacatgcacacgcgcctacacacacgcacacacacacagacacacatgtctgcctctcggatctccttctagagtcttagttcttgttttttttttcagaatttgggcaactaacaaggctagaaaggaggccatctaaaaaagtgattggtgttgaaaagttgctgctcctgtcctagcagcacaactcttcacgtcatagtaataggagtaatgacgatgatgagtgtggacaactaatgagcacttaactgtagtaccaggcactattctcagaattcattagtgtgacaaccctctaaggtagggtctgttatccccattatacagatggggcagaaacggcagggagaagttaagtgacttgcttaaggtaataaatgtagtaagaagcagaggtgggattgaacctaaacagtctgcatctagagttcatgctcataacattctatttattgcctttctggttttatgacccccttcttatctaagtgtatgctctgtgccccgcatatacaaactagttcccataacatgtgtaatataatccctcctttcccagggtttcccggcttcctgtccttccccttagctttctatcatcagtttttcctaggatttctggttcagcctatgtcaaagtgagagtcaccaacatagttgatgataaatactgtttgattacaggaatgtaggaagatgtgcaagcattctactaaaaatgcttttcccacagataatgtaaactaaggttgcttaggttttgtaagactgccattcaactataaataggccttatgtatgtttactaaatcagaaaaaatttaatgtagctaaattttaaataatcaacaacagaaaataaaaatattttgccccaccatcttaaggttacaagacttagaggtatattttatttacatgcatgcatacacacacacacacacaaattatatatagatgtgtggaaaatatagaaaagtagaaaaatgtatacaaatatttgaaatacattatgtggaatcatgtttgtatttttcttagcttaggaaagaaagccattaaaagagttacatgtcaataaccatgatactataggattttagtagttgcagagtattacattacttaaataaatgattcatggaatagtctttttttattggacaaggaattttcccctccacctcaatctttgagagttagaaacaatgcagagatgagtgtctttatagttaaacctttgtacattttataatttactcatgataaattttcaagttgaattcctaggccaaagagtatacagattttaaagactttcaatgttggcagatatcactttaggataattataccaatttatactcttaccagtaatatatgagtgtatatatttacctattccttgccagttctggaaattgtgaatttaacagaatcttccaaaaagcattgaaaattggcctgggaatgtaaatatccttttcttccccattcagcttactaatgaatctatcataatctcagctgtctgaatctaaaagagaaccagtaaaattgagatgacaagtttattgcaaaataaatgacctgaaagccacaggcattgggtggggtgggggaagggcaggtaatggtgactgaggtgactctgtgtttgggtttttgaaaagatggtagatttgaaggataaggagttcagagaagtagaaaggcaaataggggccgttataaataaggacagtggcatgagccaacagggttatctctcatgtttatagaacatggctagatctggtttccctataagttgatttcttactgttattctgagttgaatgcgtatcttttgtctcaatgaagcctgaatggcttttgatgtctctgatctggaaaggttgtttatgtatctcagaataagtcattttgctaaaaaaggctactcctgagggagagcagtggaaaaaagagttggaaaagtggattgtagctagttgaaaaaaggatttgaatgtcaagctttaggaattaggttcttatttggtatgttacgggcaaccatatggacttttgagcaggtgaaaaatacagtattaatgggtagggatagcttgggagggaaggagacatggacattgagcttcagaaaaaccagttagtaaaatatttcagatgatacattggtaatagaaaaggatccgttgaaatgtgaggcattcacttggaaagaactggcagaatgtggtaattaactgctataaggaccccaaaataaaaggaataatcaaacatcactcaaagcttttagcacagtttttgataacagtcagtgtcagaaggagaagacaactttgttcctaaaagttatattgtaaaataaatgtagcttatacatttttgaaagtgaaatctcaggattcatggtatctttacttctacttgccaaattattaaaatggtgttatatttcttaagatattttaaagcctctattgtagaacagaaatagtagaaaatggaactaatgtttattaacaattactatggaagagggaatagaaatgtgttgctcttgaacagatttattcagctttggcactgttgacattttggactagctaattccttgtcatgggcagtatctcctgtgtgtaggatgttaagcagcattcctggcctccacccgctagatatagtagcacacccgcacccctccccccctccctgcccccgtgacaaccaaaaatgtctttagacattgccagatgtcccttggggagcaaaaattactccctctccccagttaagaaccattgttctagagtacagaatcaatcccactaaataaatgttattggcgtgtttagaacagtgcctagcacatagctggcactcaaatatttgttgaataaatgagtagtcagattttcattgtgaattaaaaacagaacaaaacttgatgactgaccactcaagttgcttttacaaaagaaatgggatgtccattgaacatctgttttagatctgatttcccaatctggattattaaaatgaggaggctattttttcccagtatataaatgattctaatactttttgctgtaaaacttttggagtctctctgctaaattatgttccagtttcgtagcttgggattcaagtcataaatatactaggtctgtcttacctttcggtgcttttatttgttcccttttgaacatggctgaattttacttttctgtccacctgcccgccattcgtgctacccctccttcctttttccactctcatctttttcccattttccagtctgtaaatcctacctatccttttattttttaaattacaagatctcattctgttacttaggcaggagtgcggtggcacaatcatagttgactgcagcttcgaatttctgggcccaaatgaccctcccatctcagcctcccaagtagctgggaatacaggtgcgcaatactgtgcccggctagtttttttttttttttcttttgagacagagtttcgctcttgttgcccaggctggagtgcaatggtgcgatctcggctcactgcaacctctgcctcccgggttcaagcgactctcctgtctccgcctctcgagtagctgtgactatagtcgcatgcccccatgctcagctaatttttgtgtttttagtagaggtggggtttcatcatagtggtcaggttggccttgaactcctgacctcaggtgatctgcctgcctcggcctcccaaagtgctgggattataggtgtgagccactgtgcccagcctagttttttttgttttgttttttgttttgttttgtttttttttttggagatggagtctcgctctgttgcccatcctggagtgaagtagtgtagtggtgtgatctcagctcactgcaacttctgcctcctgggttcaagtgattctcctgcctcagcctcccaagtagctgggactacaggcacatgctgccacccctggctaagtttttatattttagtagagatggggtttcaccatgttacccagctggtctcgaattcctgagctcaggcaatccgcctgcctcggcctcccaaagtgttaggattacaggtgtgagccaccatgcccagccattcccggctagtttttgtagatactggggtctcgctgtgttgcctaggctggtctcgaacccatgggctcaagtgatcctcccattacagcctcctaaagtgctgggattacaggcatgggccactgtgccctgccctgtcctcctttttgaagtctctctctctctgtcttttatacttattttttctctcttgtcatgtctttgtccttgtcttttttgatggagtcttactctgtcacacaggctggattgcagtggcacagttctagctcactgcagccttgaactcctggggtcaagtgatcctctagctcaagtgatcctcctacttcagcctctgagtagctggggctctatgtgtgcaccaccacgcctggctcctttgtccatttttgtttgtttgttttttggagacagagtcttactctgtcgcctaggctggagtgcagtggcatgatctcggctcactgcaacctccaccttctgggttcaggcgattctcctgcctcagcctcctgagtagctgggattacaggtgcccaccaccacgcctggcttatttttgtatatttagtagagatggggtttcaccatgttgaccaggctggtcttgaactccagacctgtgttctgcctgccttggactcccgaagtgctgggaatacaggcatgagccactgcaccctggccttaactacgtattttttatatctgcacagtgttttggaaaaagtggttcaactgaaagaatgaaaagatgggggcagaatttgctttttaaaaaaataataataatttaaaaaaagggcattgaaaaaagtttcagtggtgttgggagggccttggaacaaggaatgaatggaagatgagggagtggagggaggccatgtatggactctttctacagaccaggctgttgaaggagagagggctaacaggaaatgaagtgcgggggaagttttttgaagatgggagaaagaggacaacttttatatatttcatttcatttgattccttataaatttgtaaggaagatagagcttgtattatttcagtgaagttgaaaatagagtacagaaaaattaagatacagcacccccaaaactgagaacttctgacataatacactgttggaaatacttacttcagagtgaagaaaatattggaagttaggcttgttaattgctctgcatggttcataattactctttcttattaactatttaaggaacatgagaccaggaagttaaatacctgggtatatgcagatatatatctagaattggtaccaaagtaaatacaggcataccttggagatactgtaggttccattatagactaccacaataaagtgagtatcaccataaagcaaggcacacaaatattttggtttaccagtgcatgtaaatattatgtttatattctactgcagtctattaaatgttcagtagcgttatatttaaaaaaccaatgtgcatactttaatttaaaaatactttattgctaaaaaatgctactgatcatctgagctttcagtaaattgtaagattttttgctgatagaggatgttggtggctgctgactgatcccagcagtgattgctgaaggttggggtgcctctggtagtttcttacaataagacaacaatgaagtttgctacattgattgcctgtttctttcatgaaagatttctctgtagcacgtgatgctgtttgatagcattttttacccaaaagtagaacttttttcaaaattggagtcagctcaaacactgctttaacaactaaggttatatagtattctgaatcctttgttgttattcaacaatttcacagcctcttcaccaggagtagattccatctttaagaaaccactttcttggctcatctgtaaggaacaactcctaatctgttcaagttttatcatgagattgcagcaatccagtcacatcttcaggctccacttctaattctcttgctgtttccactacatctgcaatgacttcctccacttgagtcttgaacccctcaaagttatccatgagagttggaatcaacttcttccagacacctgttcatgttgatattttgacttcctctcatgaattatgaatgttcttaatgacatctacggtggtgaatcctttccagaaggttttcagtttactttgcccaaatctactacaggaatcacttttttttttttttttttttgagacggagtctcgctttgtcgccctggctggagtgcagtggtgcgatcttggtttagtgcaacctctgcctcctggttcaagcgattctcctgactcagctcccccgagtatctgggactacaggtgtgtgccaccacgcccggcttatttttgtatttttagtagaaatagggttttgccatgttggccagggtcttcttgaactcctggcttcaagtgatccgcctgccttggcatcccagagtgctgggattacaggcatgagccaccgtacctggccgaaatgtatttcttaaacagtaagacttaaaaattgaaattactcattgatacgtgggctgcaggatagatgtatcgtactggcaggcatgaaagtaacattcttctttctgaacatatccatcaaagccctcgaatgacctggtccattgttagtgagtgctaatattttgaaaggaatgttttttccttagcagtaggtcttgacagtggactgaaaatattcagtaagccaacctctaaacagatgtgctgtcatccaggagactgttgttccatatgtagacagcaagcagattagatatagcataattcttaagagctctaggactttttgagtggcaaatgagcattagcttcaacgtcaagttaccagctgcattagcccctaacaagagagtcagtttttatttatttatttattatttttaaaagagacaagagtctcgccttgttgcccaggctggccttgaactcctgggctcaagcgattctcctaccttggcctctcaaagtgctgggataacaggtgtggccccagcctgacctttgaagcaaggcattgattttccctctctagctgtgaaagtcctagatggcatcttcttctaatggaaggctcttttgtctacataaaacaccttgtttagtatagccacctccagcaatgatcttagttagatattctagataacttgctacagcttccatgtcagcacttgctgcttcactttccacttttatgttatgacgagagcatttttcctcatgaaccaatctctacttgcttccagtttttcttctgcagttttctcacctctctcagccttcatagaattgaagaaggttagagccttgctgtggattaggctttttgcttaagggaatgttatggctggtttaatcttccatatggaccactaaaactttcttcatattagcaacaagattgtttcatgttcactgacatagtgcttttaattttattcaagaatttttcatttacattcacaattggctgagtggtacaagaggtctagccttaggcctttctcactttttgatatgccttccccactaagattaatcatttgtagcttttcagttaaagtgagaggcacatgacttttcctttccctgaattgtttgaggccattgtaggattagggttaactaattggcctaatttcaatatggttgtgtgttggggaaacgggaggtctgaaaagagggagaaagagagatagggaatggctaattggtggagcagtcagaacacacattatatgttagccatcttatgtgggcgtggttcatggtgttccaaaacaattacaatagtaacatcaaagatagcatggtagctcactcctggaatcccagcactttgggaggccaaggcaggaggatcgcttgagtttgagactagcctgagcaacatggtgacaccccatctctataaaaaataaatcagccaggtgtggtggtacatgcctgttgtcccacctaccgatgaggctgagcacttgagtccggaaggttgaggctgcagtgagctgtgattgtgccactgcactccagcctgggtgacagaacaagaccctttctcaaccaaaggaaaaaatatatatatatcactgatcgtagatcactatcacagatataataataatgaaaaagttcaaaatactttgaggattactaaaacgtaacacagagacacaaagtgagtgcatgctgctggaaaatggtgtcagtagatttgttcaggctgggtactatggctcacacctgtaatcccagcacttgggaggctgaggcgggtggatcacctgaggtcaggagtttgagaccagcctggccagcatggtgaaaccctgtctctactaaaaatacaaaaattagctgggcgtggttgtgggcgcctgtaatcccagctacttgggagactgaggcagaagaattgcttgaacctgggagatagaggtttcattgagccaagatcatcccactgcaccccagcctgggcgacagagcaagactccgtctcaaaaaaaaaaagacttgttcagtgcaaggttgacaaaagcctttgctattttaaaaaaaactcgctgggtgtggtggcttacgcctgtaatcccagcactttgggaggccgaggtgggcagatcacctgaggtcaggagtttgagaccagcctggccagcatggtgaaaccctgtctctactaaaaataaaaaatcagctgggtgtggtggcacgtgcctgtagtctcagctactcatgaggctgaggcaggagaaccacttgaacctgggaggcggaggttgcagtaagccgagattgtgccactgcagtccagtttgggcagcagagtgagactgtgtccccaaacaaacaaacaacttattatctgtgacgtgaaataaaatgaggtatgtctgtaagcaaaatggatattcctcttaatgtttgacattattttttaatcgaggagttctgaaaaattgattttgcatggatttttttccttgtgtttttctcttcaatttttttttttttttttgagagacagagtctccctgtgtcactaaggctagagtacaatgctgcgatctcggctcactgcaagctccgcctctcgggttcaagccaccccaagtagctgggattacaggagtgtgccaccatgcctggctaatttttgtatttttagtagggacagagtttcaccatattggccaggctggtctggaactcctgaccttaagtgatccacccaccttggcttcccaaagtgctgggattacaggcatgagccagcacacccggcctgattgttcagtttacactcctactagtgtcgattttcccataacctgactagcagagtgtgttatcactctttgctaatttggtatctgaaatgatactccttgctttcatttccatttctaaaattgtttagttgaatatctcatgtgttcagagactttcactctttcagttgttggactgtatttgttatttttctattgagaatttgtttttctcattcactcattttaaaaattattatttttaaaatttcttttcaatttttattaattattattattattattactattttttgagacagagtcttgctctcttgcccagtctggagtgcaatggtgcaatctcgggtcactgcaacctccacctgccaggttcaagtgattcttgtgcctcagcctcctgagtagctggtactacaggcatgtgccaccatgcctggctaatttttgtatttttagtagagatctcggggtttcaccatattggtcaggctggtcttgaactcctggcctcaagtgatctgcccgctttggcctcccaaagtgctgggattataggcttgagctaccaggcctgaccagtagttttcatttttcatatcattgttcgatttccctgattacttggtaaagttgagcactttatcatattctataggttgattaattgtgtctgaatttcttattcaaaaatgaatttgttgttcatatcctttgtccctttttaaaaaaaattaggtttgtgtctcaggatactttattcttcctttatgttcataagtagagttttatattacttattaaagttattcctagtaactttgttgttgatatctctttctattacagtagaataattatttctactgtatgctgtatagaaaagttattgatgtttatatgttactgtgttgatctgacaatcttaaagaactcttttaacatttcagttgataaacttgtattttctaagtagacattagtgatattttctgctaattatgacactttagcctgttcctttatggtattaaagtgtcttatttcttatcacttagcttaatgacacaacatccagtattaagtggctttgttttaaagtttgattccctgtgaaattttattattttgttcagtgggagacagaactgtaacttgcttttcagaattgttaggctgttatctcaatatttgttattgaatccatatttttgtcctgagttatagaaccatctactctttcaacaaaacatatattgagtgcttatgtttcatctggtgctgttaggtgttgggggtgcagcagtgaatagaacaaatttctagtcttcatggagtatacagctaaagagacagtaataaacaaataatatttttttgatccatagtcatttggatttacagatgcggaacccgtggacatagaagtcttactgcatttatatctgttttttttctgcatttgttgagatgatcatttttccttgatttgtaaatatgacaaccatattaacagattttcccttttgatttctttatgaattttctagctttcttcctatgtcattgatttctagtttcatacaattgttgttagaaagatacttgaaatgatttcattcttcttgaatttgttaaaacttgttttgtggcctaacatatgatctatcctggagaatattctgtgtctgcttaagaagaatgtatattcagctgctgttggctagaatgttctgtatgtgtctgttaggtccatttagtctgtaatgttcaagtctgtgtttccttattaatttttgtctggattatttatccgttgtcgaaagtggggtatttaagttccccactattacggtattgctatttccccctttagttctattgatagtgctttatatatttaggtgctccaaattggggcatgtatatatatttataaatgttacattctcctgatgaattgacctctgatctcttttaacactttttgactcaaagtctattttattttatgtaaggatcctctgctctctttggttaacatgtgtgtggaatatctttttccatctcttcactttcagcctcagtcctttaaagctaaagagagtctcttgtaggcagcatataggtggatcttgtttttaaaaatccgcttggctgggtgcagtggctcacgcttgtattcctagcactttgggaggctgaggtgggtagatcacctgaggtcaggagtttgagaccagcctgaccaacatggtgaaaccccatctttactaaaaatacaaaaattagctgggtgtggtggtgggcgcctgtaatcccagttactcaggaggctgaggcaggtgaatcgcttgaacccaggaggtggaggttgcggtgagctgagatcacaccatcgcagtccagtctgggcgacagagtgagactccgtcttaaacaatcaaaaatccattcaatctgtgtcttattggagagcttaattcttttcatttaaaataattattgataggtaaggagttactactgccattttgtcagtttttctgactcttgtagtttctttgttccagtcttcctctctagccgtcttcctttgtgatttgacgattttttggtagtgatatgcttttgattttctgtttcatgtatcttgtaggcagcatatcattggatcttgtttttaaaaatccactcggccaggcacggtggctcacacctgtaataccagcacttagggaggccaaggcaggtggatcacctgaggtcaggaattcgagaccagcatggccaatatggtgaaattccatgtctactaaaaatacaaaaattagccaggtgtggtggcatgtgtctgtaatcctagctactcaggtggctgaggtgggagaactgcttgaacctgggaggtggggtttccagtgagctgagatcatgccactgcactccagcctgggtgacagagcgagactccatctcaaaaaaaataaaatgaaatgaaaaaattaaaaaaaaaatcactcagccaatctgtgtcttctggagtattaaatttatttccatttaaaataattattgataggcaaggagatgctatcgccattttgtcaatttttctgactcttgtaagtttgtttgtttcagtcttcctctcttgctgtcttcctttgtgatttgatgatttttttgatagtgatatgcgttggttcttttctggtttatgtatctactacagccttttttttgtggttaccatgaagcttacataaaacatcttatagtgttaatagtctattttaagctgacaacctcaacagtataccacaactttacatttaacgtctcctttcacattttgtattattgatttcataatgtatatcttttatatatcatgtatccattaccaaattgttgtatgtatagttaatatttaatacttttgtctctttacatttatactagacttaaatctgatttaggtaccaccattacagtattggagtattctgaatttgaatatattgttatctttatagtgagttttattctttaatatgtttttatgtttttagagttcttttgtttcaatttgaagaactttctttagcatttcttgtaaggcaggtctaatggtggtgacctcccacatttttttctgtaaggggtcacatagtaaatattttaggctttgctggcaatatgctgtctgttgtaactgctgatatctgctattgtagcatgaaagcagatgtagactgtatgtaaacaaatatacatggctatgttccgataaaattattacaaagaccaagtacaggactggatttggcctctggaccgtagtttgctgaccagtgatttagacttctaacatggtagattacattgattgattttttgaatattgaacaagtgtagcattcctgggataaaccctacatggtgtggtatattactcttcttatgttcctgagtttgatttgctaatatattcttgatgatttttgtgtttatgttcacttaggaaattggtctttagttttgcttctttgtactgtctttgcctgattttggctttaggataatgctgacctcattaaatgagtggagaaatgttgttccctcctttttctggaagggattctgtagagttggtgttacatcatcttaaagtgttggttagaaattagttagtgaaagcacctgggcctggagattgttatttcagaaaatttcatactataaattcaatttctttaatagttacagagctgttcaggttacatatttcatcttgggtgagttttggtagtttgtcatttcctatgaattggtccatttcatttaaagatatcaaacttatgtgtgtggagttgttcatactgctcttttattgtcttctttttttttttttgagacggagtctccctccgttgtccaggctggagtgcagttgtgtgatctcggctcactgcaagctctgcctccagggttcacgccattctcctgcctcagcctcctgagtagctgagactacaggtgcccactaccacgcccagctaatttttttgtatttttagtagagacggggtttcaccgtgttagccaggatggtctcgatctcctgacctcatgatctgcccgctgggattacaggcatgagccaccgcacccaaccttattgtcattttaatgtctgtggagtctatagtgaaatcccctttcattcctgttttagttcattttctattgctatagcaaaatacccgagagttggtagtttataaaggaaaaagatttatttggtttatggttctggaggctgagaaatctaagatgggttgccgcatgtggtgagggctttgtgctgtgtcataacatggcagagaagtgcaaggggaagcacatgtttgcaaagagaggccaaacatgagaggcatcctcactttataacaacctactcttgtgggttcacttctccaagagtgagaactcctttcagaacgacattaatccctcttaacaacctaatcacctcttaaaggtaccacctctcaacactgctacattgcagaccaagcttcaacatgagatttggtgaggacaaatgatattcaaaccatagtagtcatttttttgtgtgtgttagttttgctggaatcttgtcaattttattgatctttacaaacagtcagattttgatttgagtttttaaaaagttgtggtagaatatacacaaaatataatttgccatcttgtttttttttttgtttttgtttttttttgagacagggcctcactctgttgcccaggctggagtgtggtggcgtgatcttggttcactgcagtctctgcttcccaggttcaagtgattctcctgcctcagcctcccaagtaactgggattacaggcacgtgccaccatgcccggccaacttttgtatttttagtggagacaggattttgccatgttggccaggctggtctcgaactcctgacctcaagtgatctgcctgccttggccttccaaagtgctgggattacaggtgtgagccactgctcctggcccttaactattttttttttttaaccttccacagtccttttattttggaataggctgtaaacaatcaaaccacgagaacatgattgtacaacagtaaaatgttctcctgtattaaactgaagatatctgtttaataaaaaaaagaaaaagaaaatgtaggaaaggtacttagagctgttactttctaagtacacaacaccctagacaattcaaggcatcttaatctccatcaagaaaaacaagaaaaaataatttttgtcacgctgttaaatccatcattatggatgaaactggtgcatattggtcaaacggatccaacaaacactgatgtccaagctggcatattggcaactaatacgtaactggtggtcaatagagagtttaaaagatcttccctttcttcttgttcttttccaaggttctcgaagagttctgttctaaaatatgttgttgagcttcccagtttgccttctcatcctcaaactgacgacgtttttcctctaattctttgtgctgtgcttccaaattctttttcattagctcacggcgccactggagctcagcttcagagtcctttagtttttgaactttttatttgaccttcatctctaacacctgctccatctccatctctatcttcttcattttagctgcatactcccttctttcttcttccatttgtgccagagggctcttagtcagctgccctttattcttgttgttatcaactccattataagtcacagctgccagttttctgcttctgtagttctcatagtggacattattagtaacatctttcaagtcctgagtgtgtgtttttatcagcatatttcttagaattgtaaaatcacaatgttcaccattttcaacttcagcagcaccccaaggatactgccttcctttgacccttttgccattaacttcaatgatagtattactagcttaccacagcaagaggtaaacagtcctttacctttttagcaagtttattttcttcttcatcatctatttctggaaaatcatatatcttaattttatgttcttggatttctttcattatctgttttttaaactgttggcattcctctggtataagtgtgtctgctttggcaataagttggatgataatcactttttcatgcgaacgcttcataaactcaatatccaatggtttaagttcatgtcctgaaggagcaatgaagtataaacaacactgcaccctgctattaggcatctgacgtctgttcactcgtgattctgcatttaggtagtcctcagatttactatcaatgtaatcgataagaggctgccagcaattactattatccactacatctccaaatcctggggtgtcagctattgtgagcagcaactgaacaccaccttctttgattaaaactttggattgtccacctgtatagtctttttaattctatgagaaggacctggatactctggagcatacaaatctgtaaggaataatgagttgattaatgtcgactttcccaatccaggttcgcctctctgggtaaggtggctcacacctgtaatcccagaactttgggaggccgaggtgggtagattgtttgagctcaggagttccagaccagcctgcgaaataaggcgagaccctgtctcactttgtatgctggtgccagccgggggtgcccctggtaggtgctccctggggtgtctgcttcagggcttctgcgaaggtgcaggtcagggctcctccagctgggaaacttggaatagttggcagctgctttgaatgttggttccttcttctctgatgaccgtgctgtcaacatcaaaacacactgcatctgctgagtagaaaagcttcctcagctctgagtgggagaccatccttggaagaattttcctcgtttctccagtgctagatttctaggagaccacactcttctcttcctgttccttctctggataaaaatgcagcacagagttctgactacagatttcttcaagaaagacctgtggattccgcaagagcaagagcccaggctcaggtgaggcaagggtgcggccggggctgcaactggcgctggccattgaggagcttctgcgcgaccttgcgatcgtgcccgccaggcgccggcccgttggctcgcagcgccagctcgcgccgcgtctggcccttgctgcgcccggctctgcaggccgggaagttgtaaagctcctccatagctgatgggcggcggcggccgggccgaagcctgcggacacggaagggctgcagctcagcggctggttacatcccgcccggccgtctgtggccacccaaccccttaactatttttaagtgtacattttagtgatgtgagatacattcataatgtagacactatccattttcatagctttttaaaaaatcttgttaaactcatactttatagccattaaacaataactcccagtttctcccttctctcagcctctggcaaccaccgttccactttccgtctctgattttagctactcttagtaccttatataagtggaatcatccactatttttttttctttgtgactggtttaattcacttaggagattgttgtcaaggttcatttatgttgtagtatcgcatatgtcagaaattccttcctttttaaggctgcatagtattccaccatagacatactgccaatgtggtatgtctgtaccacattttacttaactgttaattatgttttatttattgtgaataatgctgctgtgaacatgggtgtataaatatctctttggagactctgcttctgattctttttggtgtatacccagaggtggaatttgtggatcatatggcaattctatttttaactgcttgagaaactgccgtactgttttccagggcccatatcattttatgttccctacacctgtgcactagtgtttcagtttctccacgtccttgccaacatttgttattcttttttttatttttcacagtagccatcctaatgggtgtgaggtggtatatcttagttttgatttttcatttttctaatagtcatcgtgagcatcttttcatgtttttttggtcatttgtataacttctttggaaaatgtctgtggaagttctttgctcatttttgagttgggttgtttttgtcaggtgttcgtcccacctcatcctcctgagtacccaggactacaggcacatgccactatgccccactaatagaatctattttagacctaattatattctgtctacctgaaagacaattgaaataaaatgacataaagagaaagataaaacatgccaacactaatcaaattaagctggagtggctatgttaatatcagacaaagcacacttcaaaacaaaacactgggccgggaggctaatgcctgtaatcccagccctatgggaagccaaggtgggaggatcgcttgagaccaggaattcaagacctgcctgagcaatatagcgagactccatctcaaaagaagaaaagaaaaaaggaggaagtttttagttaactgtttgtttgtttgtttgtttgtttgagacagggtctcactctgccgcccaggctggagtgcagcggtgcgatttctgctcactgcaacctccacctccctagttggagcaattctgcctcagcctccagagtagctgggattacaggcgcctgctaccattcctggctgatttttgtatttttagcagagacagggtttcaccatcttggccaggctggtctcgaactcgacctcaggtgatccgcctgcctcggcttcccaaagtgctgggattataggcgtgagccactgcacccagcctactgttgcttttgaaggatacttttttttgctgcatgttttgttcagtgtttagaagggtttttcctttaattttctccttagtactttaaatatgttttttactgtcttctggcttacatagtttcagacaagaagcctgcagtcatttttactttattccccctttaagcaatgtgtattttcttttgctgcttttaatattttctctttattaatctttttcagcaatttgactataaagtaccttactggtacgtgtgtgtgtgtgtgtgtgtgtgtgtgtgtgtgtgtctgtctgtttcagattttgttgtgcttggatctgtgggcttataataatacagcttttaaaatttacagctaattatttcactaaacaatttttttgtccctatccctttaaccccaacctcacacatattagttaggtaggttgctattattccacagggcactgtagctgtgttgtcatttttcatactgttctttattttgaatagatttttttttgttatgtctttagggataatgatcttcttttgtcatttctaatcacatgttaacttttcaatgtgaaatttgcatttttttctttttttcttttctttttttttttggagacggagtctcgctctgtcacccaggctggagtgcagtggtgtaatctcggctcactgcagtctccacctcctgggttcacaccattctcctgcctcagcctcccaaatagctaggactacaggcacctgccaccacgcgcccggctaattttttgtatttttagtagagatggggtttcaccatgttagccaggatggtctcgatctcctgaccttgtgatctgcccgcctcagcctcccaaagtgctgggattagaggcgtgagccaccacacccggcctgaaatttacatttgatgttatcttttgatgttacctttgagttccatgttatttttaatatcttctgtttctctcatattcatgttttctttacattcttgcgcatatgaggcatacttataatagctggattattggattatgcccagtagttaagttgggaatcattattgttcagttgagacttatttatttttttcatacagagtcactctcaggataagttgagacttatttgtcagctcttttagggatggtctagaatagcatttgttctgtggctcatttagccctgctcctaaaggtgtgtctcactctggtctctgctgaatgtgttacatagtcattgaggtcttgccactctggctaaagacaatacagttggctagagacaatacagttgattcgcagctttctgtgagctctgggaattgttcttctgtaattgctctctccctggaagttgttcttgttcagtcttctgggatttcacatcacacatgtgcagattggtattcagttgaaactcaagggtatccctctgcagatttctggagctctttctctgaatacctctcttctcttgggtagtctgtcccacaaattctagtcttcttgagccacctgaacctatgatttctgtcttctcatttcagctctcattttgggttcctatctctgtgtggtagtttctaaattaatgccaagcagaaagcctgtgccatggtaggggtcaccctgtttctttccctttgttcccttcgccatacctgttgcccagtgtcttataataaggttgtttcttatatttgtctggtttcctagttgtttgggctggagggtaattttgacctgtcttactcccatgtggctttatgtagaagtctcctatgttactttaggaactcaagttggtttcagattctgagattaatatggaacataaagttttggtagaaaattttctcaaataaagttagttgtattcttttacttcacatttcttggtaataaagtgaagtgaagaacactgaaatgaaagggttaagagacaggaaaaagaggggaacgaagaaaacccaaagaagggttaaaataaataatcttcatgttgtcatttgtaattagacttcaaactttccttaaaaactgaaactggaaatatctgactcaatatggaaatataaaacatgtatctattttgctgtttaaatatgaaagttggcaactgatagggttttgaagagtatgaccattatctttgcattcagaatatagtgtttgattagtcagaaaagtcacatggcagaagccaatgagcagcaataaggacaccgatgaaataaaagaattcgaaaatgacatgatgtcaataagttggtccattgcccagaaggaaaggaattctgatgaattgatcaacgtaaaaagcatgtcttcctagtgccaaaaccaagaatagaaatcagaagaaaaatttgaaaagcaaaaattaaaatcaaaattattttttaaggagtaagtagggcaatgcagataactgatatgttgatagagattataaactagacagaacgagcttgaaataaagccagttgtgccaaaacaaacaacagcatagacagtgatggtcaagatagtggagaaaaaactcaaagtagagcaaaacatgggtctgagagattaagttaaaaagtcagctaaaccatacggtttccaatttctttaaaagtggatgtttatgattatgaaaaatcacaaaagaaagatgaaaagtaaactctacctccataatggcatgtgaattattttgtcattctctattttctttgaagcagccatgttgggattgtttcgaggatttctagtctcccagtccccagttcttgtattggtctacaggtttctaaacaaaaagtgatcctattaaaaaaaaattcttagacctcatgccttcttaccccctaccgctgactctgccccagccaccgtatatccttcttgtccctctaacccccctcacttgctctcatctcaagaattttgcatttgctgttacttctactgcaatgcttttctcccagatatctgtatggtttgcttcatcttcagttctgtgctaaagtggctccttacaaaattttattttaaaacatttattttataaatctgttatttaaaatagctagtccctttttctttgctttcttttgttggatgttgtatgtgtaatacttgtttactgttgtctcttctcactagaatgtagttttgtgacaggagggattttgttttatttatttctgtatccactgtgtttgaacagagtcagacacaaaggaagattgatagagtaatctagtaatgcttgctcaatgtgttgtccaaatacttgtttaaaatgcttcaaactataatgtttcatctatcagtttccgacagtgggatgttaatatctctctaatgattagttaccaatttctctttgttctgtaaatgtttgctttatgtaatctgaagttctcttatgttatccaagtaaattaatttttttatcattatgacagtttaagccatttatgtttactgtgaaaattcatatttatatttatctttttatgttattttctatgtaccatttgttttcattccttttctgcctgctgttggattgatcaaattttcttatcccttctttccactttattttaatgttttctatcaaatttaaaaacaactacttaataaattctttttttttgagacggagtttctctcttgttgcccaggctggagtgcaatggtgtgatctcagctcaccgcaacctctgcctcccgggttcacgccattctcctgcctcagcctcccgagtagctgggactacaggcgcccactaccacgcccggctaatttttttgtatatttttagtagagacggggtttcaccgtgttagccaggatggtctcgatctcctgacctcgtgatccacccacctcagcctcccaaagtgctgggattacaggcgtgagccaccgtgcccagcctaaaaacaactacttaataaattctaaagatgttctttctttttgtccatgaacaataagatccaccttagagtgttttctccctaattcaccctttttcatctttcaggttttgtagtctttttatttagttctgccttctttcccctttccccctgtgaagtttgaagtgatgctattttgactgcttgacttgttatgtaacattaacaaatttctaatgttgaatcatcctggcattctgattatattcaataggattgttctcagtttttattttcattcatagtttttgacaatgtttgttggaattctgagtcaggtacttccttttttttatttttggttaagaccgactttttgatagtttttagtagtttaattataaaaccatttaggctttgattacttcaatttttttttctttttgagatagaatttcgcccttgttgcccaggctggagtgcagtggtgcaatctcggctcaccgcaacttctgcctcccaggttcaagcaattctcctgccttagcctctcgagtagctgggattacaggcatgtgccaccatgcccagctaatttttctttttgtttttgtattttttttagtagtgacggggtttctccatgttggtcaggctggtctcgaactccctacctcaggtgatctgcctgcctcggcctctcagagtgctgggattacaggtgtgagccactacgcccggctggtcaccttaatttttaatatattattatgttatagctccttcatggtttaggttggttaactttttttttttgagacagagtttcactcttgttgcccaggctggagtgcaatggtgtgatctcggctcactgcacctcctgcccactgggttcaagcgattctcctgcctcagcctcctgagtagctgggattacagatgtgcatcaacacgtccagctaatttttgtatttttagtagagacgaggtttcgccacgtaggccaggctggtcttgaactcctgacctcaggtgatccacccacctcggcctcccaaagtactaggattacaggcgtgagttactgtgcctggcctaggttggttaacttttttatgagaacaagacttaaatggatttcttattgtttaaaacatagttctttgttttattcttttttcatattattcttttatttcatattgtccccccccccccaccccccttttttttgtttgtgtgtttgagacagtctcactctgtcgcccaggctggagtgcagtggcatgatatcagctcactgcaacctccatctgtcaggttcaagcgattcttgtgcctcagcctcccaagtagctgggattacaggcacacgccacaacacctggctaatttttgtatttttagtagagacggagtttcaccatgttggccaggctgttcgtgacctcctgacctcaggtgatatatctgcctcagcctcccaaagtgctgggattacagatgtgagccaccacagccagctgtttttcactttttaaatgttttatgtttttcaattaaatactgagttgatttgtattttttctttctatttcctccctccctcccttctttgttttttttctttagctggaattactggcacgccaccatgtttgcctaatttttgaattttttttttggtagagatggggtttcgccatgatggccaggctggtcttgaactcttgcactcaaatgatccatctaactcgaccctccaaagtgctggggttacaggtgtgagccaccttacccagcctttttcttttaaagagtttaaaatactgcgaaataatttaaaacactgacattatctgagtactgctttgtcagtttccaagtttttatgtgtaatatcttgttgctcttatgtgttattaatttttcttttactcatttctataccgtatttagtacaattcaaagaatttaaaggcattagttttttttttttttttcaattgctttctgtcaggaatttcaccttgctgtgactcttacctttattttactttcctgaagtgtttataaattaaattttattatgcttgtaaggtggacatgattataatcgtgcttaatttttaaaattttgttttttagtcatctgcatcacagtcaccaaaagcaccttttacaaagcttttaaaaatacatatatctggtcatttcacatcaactttattaaatatagaagttaaacctggtatgtgaactttgtgaagaacccattatgtagttaaaagccactactgtagacagagggagacttcagaaggttacctaaaaaaggggcaaaaccagagtgaggaatacttaagtgaattatgaggacacaattatattcatgtgggtctgtcctcacatttagagtataaggaagtgctggatttaagggagaaaatgactgtaaactctgatattttctacttgatatggtaaaatgctggaaaaatgccctaattacttattttgtataccttcaaattgtgccttatgttgaatataagtctaagccttaaaatttaacatttaactctatgtacttattatttttttttttttctgtagacctcgaagtagggggaaaactgcagtggaagatgaggacagcatggatgggctggagacaacagaaacagaaacgattgtggaaacaggtatcagaactcaagaatttataagaatgtataatgatgctttgcatatgtttgtacactgcatgtagcatttgtataacaatattctgtgttaagcatttgtttttatactgaactctaagtttcccatctgccttgttttgataactaatgacaaagtgaaaaaactgagccctctatctctcttttttccctaagccctggtttagtataattattttatatctgaagataaatgttttatcaaggaaataaagactgggagaaacagtaatccaggctgttagtataatcgctcatagtatattctggcctatgaaccatctagtgtttgtttaaagcttattttgttaatatgtgttctgaaaaaagtagtatgtttcgttatggaattaatattgtgaaaggctaggccaaactagaccaaatagtttctggtctgttggacttttaggtgcccttaaataagctgctgtatgttgtgcatctgcaaaaggtagctagagttggttgcccaaagcagtttccaaaattttcaggtcagtggtaagttatcaaagggactaggattcatattgtattgagaggatacctgtaggagatagtctctcattggtaaagttttcaatagttgttagataaagtttagacacagtgataggctttttctctgaagttgaatatcatcttgatgcttacagaatatcatgcagttaagagatgagaaaaattaaaaattgttatagattttaaaatacatttttccagaaatccttacagttgtcagatgtgttgctattatataggtataattcttggaaagccttcaaataatctatagtttctttccaataaggtctagttagagtattactcttggaagctcagaatactaaatttcacccttttgtgcacattcatgaattactgtattactttaaactgttaattctttttcatatggtttttttttctgtactatatattgttacttttactactgaaaagtctttttgaagctttagtgtttttgtttgtttgtttgtttgtttttaagacaagagtcttgctctgttgcctgggctggagtgcagtggcgtgatctcagctcactgcaagctctgcctcctggattcacaggttcatgccattctcctgcgtcagcctccttaatagctgagactacaggcgcccgccaccacacccagctaattttttgtatctttagtagagacggggtttcaccgtgttagccaggatggtctcaatctcctgacctcataatccgctcacctcagcctcccaaagtgctgggattacaggcgtgagccactgtgcctggcctattgttgttatttttgagacagagtcttgctctctctcccaggctggactacagtggtgtgatctcggctcactgcaacctccacccgccgggctcatgcagttctccctgcctcagcctcccaagtagctgggattatagacatgcgccaccatgcctggataactcgtatttttagtagagacagggttttgccatgttgacgaggctggtctcgaactcctgacctcaggtgatccacccacctcccaaagtgctgggattacaggtgtgagccaccgtgtctggctctaattattattattgctattattattattattattattattattattattattctttttgagttggagtctcactcttgtctcccaggctggagtgcagtggtgcgatctcagctcactgcaatctctgtctcccgggttccagtgattctcctgcctcagtctccctcctggtctgggactataggtggatgccaccacgcctcgctaatttttgtattttttagtagagatggggtttcaccatattggccaggctggtcttgaactcctgacctcgtgatccacctgccttgccctcccaaagtgctgagattacaggcgtgagtcaccgcgccgtgcctgattattattttttttaattttgtttttttgagacagagtttcgtcctttgttccccaggctggagtgcagtggcgtgatcttggctcactgcaacctccgcctcccaggttcaagtgattctcctgtctcagccttctgagtagctgggattacagccacccgccaccacgcccggctaatttttgtatttttagtagacacagggttctcccagtgtttgccaggctggcctcgaactcctgatctcacgtgatccgcccaccttggcctcccaaaatgctaggattacaggcgtgagccactatgcccggccctttgattattgaagatgattatttcaccaccttttcttttctcctgaaacttccaacaccccttctcatttttgattctttagtgatgatcttgcttatttcagtgaaaaaataaaaaatagagaacaattagaaaagaagttccatattcatctaccatcaaatctattttcttgcttgcatccctacccgtatgttgtttctgtcctggtaaaatgggataaagactgcggataaagccagctcctctgcttgtgtcttccattgtgtcccctctcatgtattacggactttggttctgcagttgtccttgcttttctgcatcaataacttttccatctcattgatttcattagcataaggggggtgctgcagaatcaccccctttcaacacaaatagcctctcttgatccaacatccccttttaggtactatacagcttctttgctccatcatagcaaaaatccttgagttatttatacctatgattactacttatttttcaccattttctcatgaacccactctaatgaagctttcttcctcccattctactaaaattattcttgtcaatgtaatgatctcatattgcccagaccagcttttagtcttcatcctccttaacctttcaggatcatttcacacagctaaccactctcaggagtgaaacttttttttaaaacttgactttcaggtcactgcattgtcttggtttttttttgtttgtttgtttgtttttttgttttttcctactccttcactggttttttctcattctcttcgctcatcttcttatgtattaggtggtcttattcagtttaatggcttattatctatttttgtgctattattatgttatctaaatgctaatgactctaaaattacgtcaccagctctttcttgctttgaacacaacctgtatctttcagcttgtttcttaacatctcttcttagatgtctgaagaggatctcatatttagtgtgtcctctctggaaatttttgttgttatcctgaaaccctctcttccagtgttaccacctctggtatattgccactgtatattgttcaggcttaaaaagatggagtctttcttgatttcacattttcacattttacattttatacattcacattttagacattcacatttcacattttcacattttagacatccagcccactggagggctttacctacccagtatatcctggattcaattactttgacccctccactgctattattccagaacttcacactaccattccactggactgctgcaatagcttcctaactggtctttttccttttcattccattctactcttgtcccacacatagtagccagagtgatccttccaaattcaaagtgagagccttttacttccctctgtcaaccatccaaagactccagtgatatttagaataaaattcaaagttcatgcagtaccattgttttcaggctccattgatctgactttggctacttgtataaccgtatcttatgttcccttgttcactgggctccatccttactggcctcctggcttttccaggagcccaccaaacatactcctttctcaggcatttgcactttttgtcttctttgcttggaaaaattttttctcagatattcatacagcttattcccttacttcagtcaagtctctactcagttacagttttcccagagacctttcctgacaaacttgtctaaaaagtaacacttgtcactttgtcttctcctgctttatttttctcctagtacgtaacagataggacatttaatttcatattggcttattgtatgctttccacactagaatgtaagctttatgaagtcaggggatttgtcttgttaccttatttatccccagtgccaagaatacttctagggatataggaggaattggattcactaagtgaagcagtattgtgttcttgaattttctttatgttttctaagctacctaccattcttggaacattacaacattacaacaaaactaaattcctggcatttttttttccttactggagagtagtaagccccacgaatggactgtcttctcatgctgtctcctatgagaggtcaaggcaaatacagtttagataaatgttttaataggagcagaaaactattttttttaacctggctttactaaagttaataaagccaagtgtatattagtctttgttttgtctttgtccttggaaagtccattgtccacttcttttagggaacatagtgaacatagggcaaggagaacagtgaaagaaagaataactgttataaccactaaacctgcaaatccagacagagtttgttccataaatttctagttcatttaaaagcacattcaagtttgctgcaaggttttaacatatgtatgtctcaagaccccagggtttatttgaaggttctcttgttcctgtaaatcctgtgccttgacatgcttacttaatgttttgtagtaatataagggtattacgctgggcgtggtggctcacacctataaccctagacctttgggaggcctaggtgggtggattgcttgagctcaggagttggagaccagcctgggcaacatggcaaaaacccgtctctacaaaaaaatacaaaaattagttgggtgtgatggtgtgcacctgtagtcctagctactcaggaggctgaggtgggaggatcgcttgagcccgggagacaccagttgcagtgacctgtaatcagtcgcaccactgttcaccagtctgggtaacagagtgagatcctgtctcagaaaaaagaaaagaatgctaatgagtctcctaccatggtgggtggatgggaatgagtaatctaggagtagccattgggaaagtaataagaaacctcatttggtaatattttatgttaagaaaatttcatctttatctcagctcactgcaacctctgcctcccgggttcaagcaattctctgcctcagcctcccgagtagctgggattataggtgcctgccaccatgcctggctaatttttttgtatttttagtgcagactgggtttcaccatctttgccaggctggtcttgaactcctgacctcgtgatccacctgccttggcatcccaaagtggtgggattacgggcatgagccaccacacccagctgagaaaatttgatcttttgttggtggtggctgttaccagtctctgcgcattttttttatatgaataaaatcaacttgagtgaagtgctagttacttgaagagaagagaaactttttttttcttgagaatcacataatcaggtctttgcaaacttgttttcattaactataattagctaattataattcagttagttataattaaacatttttctcctagtgttcaagttgtcatagtttggctcatgggagccccttgtcagctggcttctgagtccttttaaataacatctcaaaacctttcagagctctgtgctctttggcaaaagttttatttttcaggcccatttaaaattctccctgccacaaggtatgaaatcagctattctctaaggacttctagttttttagtggagaatagtattagggacaaaaatttaggctcaagggatatcgggggaaattcagccagatattgggcaaaattcacccccgataattcacgtaggttcttttctattttccctaagcttcggctggtttgagaaatagagggacagagtacaaaggagagaaattttaaagctgggcatccgggggagacatcacatgttggtaggttccgtgatgccccacaggccgcaaaaccagcaagtttttattagtgattttcaaaggggagggagtatatgaatagggtgtgggtcacagagatcacgtgcttcacaaggtaatagaatatcacaaggcaaatgaaggcagggcgagatcacaggaccacaggaccagggcgaaattaaaattggtaatgaagtttcgggcacgcattgtaattgataacatcttatcaggagacagtttgagagcagacaactggtctgaccaaaaatttattaggcggggatatcctcttcctaataagcctgggagcgctacgggagactgggacttatttcatccctacagctcgaccataaaagacagccgcacccaagggggccattttagaggcccaccctcagggatgcatttgctttcttagggatgttccttgctgagaaaaagaattcagcgatatttcttccatttgcttttgaaagaagagaaatgtggctctgttctgcccggctcaccagcggtcagagttcaaggttgtctctcttgttccctgaacattgctgttatcctgttcttttttcaaggtgctcagatttcatatagttcaaacacacatgctctgcaaacaatttgtgcagttaatgcaatcatcacagggtcctgaggcgacatacatcctcctcagcttatgaaaatgacgggattaagagattaaagtaaagacaggcataggaaatcacaagggtattgattggggaagtgataagtgcccatgaaatcttcacaatttatgttcagagattacagtaaagacaggcgtaagaaattataaaagtattattttggggctctaataaatgtctgtgaaatcttcacaatttatttcttccaccatggcttcagccggtccctcagtttggggtccctgacttcccacaacaaagggatgcatattacaattgttactgttgagaattagttatgtgagtccactttagtcatatactagtacagtcatgcactgcataatgacagcagatcacatatatgacagtagtcccataaaattataatggagcggagaaatttctgtcacctcaatatgtcatagctgtcatgatgtcatagctgtcgtgatgtcatagcacagcgcaacatagtgcattactcacatgtttgtggtgatgctggtgtaaacaaacccagtgtactcccaattacatgtactatacaaaagtacactacatacactcttgcacagtacataactcttgataataagtgactgtgttactggtttatatatttactatactatactttttatcattattttggagtgtaccccttttcttaagcaaaaaagctgtaaaacagcctcaggcagaaccttcaggagctatatcagaagaaggcattgttatcatacgaaatgacagctccttgtgtgttattgtcgctgaagaccttccagcagggcaaaatgtggaggtggaaagacagtgatagtgacgatcccgacttcgtgtaggcctgggctaagtttaaaacaaaaacagagaaacaaaaaagaaaaaccctaaaaccaaaaaacttacagaataagggtagaaaggaagattttttttgtatagctgtacagtgtgtgttttaagctgtgttattacaaaagtgtcaaaaagtttaaaaaaagtttataaagtaaaaatgttacagtaagctaaggttaatttattactgagcaaagaaaaataatattttaaaaatttggtgtagcctaagtgtacagtgtttataaagcctactttagtgcatagtaatgtttgaggcctttacattcactcagtgattcacccagagcaacttctagtcccacaagcaccattcatggtaagtgctctatgtaggtgtaccattttttgtgtttttacactgtattcttaccattgtttctatgtttacatatatttagatacacaaatacttgactgttgtgttatagttgcgtacagtaacatgctgtacaggtttgtagcctagagtactaggctgtaccaaatagcctaggtttttagtaggctataccatctaggtttgtgtaacagtgacaaaattgcctaatgatgaatatttcagaacatatccctgttctgagaggactgtaattacatagatctatacacacacttacaaatgtgagttcacatcgatacattcagttacttctagcataagtttttaaaaatagactttattttatttatttattttttttgagacagagtttcactcttcttgcccaagctggagtgcaatggtgcaatctcggctcactgcaacttctgcctcctgggttcaagcgattctcctgcctcagcctcccgagtagctgggactacaggcatgtgccaccacgcccagctgattttgtatttttagtagagacagggttttccatgttggtcaggctggtcttgaactcctgacctcaggtgatccgcccacctcagcttcccaaagtgttgcgattataggcatgaaccactgcacctggccaaaaatagcctttatttttcagagcaattttaggtttgtagcaaaattgtgaggaaggtactgaaatctcccataaatccccttccccgacacgtgcatagcctttttcagtatcaacatcctatactagagtggtacatttgtcacaattttttaagcctacattgacacattatccacagtttatagttcacataagggttcactcttggtttacattctatgggtttggacaaaggtataatgacaggtatctgtcattatagtatcatagtcactgccctaaaaattaataggtgttccacctattaatccctccctccttgctccctccctccttgctaacctatggcaaccactattctttttactgtctccatagttttgccttttccagagtgtcaaatagtttgaatcatataggatatgtagtcttttcagactggcttctttcacttaataatatgcatttatgtttcctccacatccttttctgtttttttcttttctcttttcttttctttctttatggagtcttgctctgtattcccaggctggagtgcaatggtgtgatcttggcccactgcagtctccgcctcccggtttcaagtgattctcccgtctcagcctcccgagtagctggtattacaggcatgcaccaccacacctggctattttgtatttttagtagagacggggtttctccatgttgatcaggctggtctcgaactcctgatctcaggtgatccacccgcctcagcctcccaaaatgctgggattacaggcgtgagtcaccgcgcccagccctcctccgtgtcttttcatgtcttgatagtgcatttcttcttagtgctgaataatattgtattgtttggatggaccagagtttatccatttgcctactgatggaatttctatttgcaccctggttttggcagttaagaaagcttctgtcaacatctatgtgcaatttttgttgtggatgtaagttttcaactcatttggataaataccaagcagcatgatttctggattgtatggcaagagtatgtttagttttgtaaggaaccaccaagctgtcttccaaagtggctgtgccattttgcattctcactagaaatgaataaaagtttctgttgctctgtgtacttactgacatttggtggtgttggtgttccagattttgaccattctaataggtgtgtagtgatgccctgttgttttaattttcatttccctgataacatataatgtggaacatctgttcatatgcttatctgcccatctgtttatgtttattggtgaggtgtctgtattccctatgctttttttctttctttctttctttttttttttttttttttttttttaagacagagttttgcttttgttgcccaggctggagtacaatggcacaatctcggctcactgcagcctccacctcccgggttcaggcgattctcttacctcagcctcctcagtagctgggattacaggcacctgccaccatgcctggctactttttttgtatttttagaagatacggggtttcaccatgttggtcagactgatctcgaactcctgacctcaggtgatccacctgcctcggcctcccaaagtgctaggattacagatgtgagccaccatgcctggccttccctatgctttatctcctgaaagagagtatagagaaatggtataatttcttccttaaatgtttggtagaattcagcaatgaaccaaactgggtgtgttcaatattcgaagtttattaatttttgattcaatttgttttaataggtatagacgtattcagattatttcttcttgtgtaagcttgagcatattgtgtcttttaagtaattggtccatttcatctaggttatcaaatttgtgggcatacagttgttaatagtatttcttgaatatttaagattccatgggatctgtagtgatgtcccatttttcatttttgatattactgagtgtagattttccctcctttctgaaacagttggccctttaatagcttggggttgaaccatgtgcatgcactgataaatggatttttttcagtaaatatattggaaatttttcgtggagattcgtgacaatttgaaaaaatgcgtagatggactgtgtagcctagaaatatttaaaaaattaagaaaaaggtatgcatgaatgcataaagtatatgtagatacttgtctgttttattgtttactaccataaaatatacacaaatctattactgaaagttaaaatttatcaaaacttaagcacacacttaaagactgtatgtggtaccattggcaattgagagaaatgtaaacaaatgtaaagatgtagtattaaataataactgaataaaatttactgtagtacatactgtacaactgtaataattatgtggccacctcctgttgttattgcagtgaactcaagtgttgcaaatatctgattaaaacaccatgggataccaatcatctttgagcagttcatctctccagtaaattgggtatcttggtaaaaagtgatctggcgcttctcatgtatctttcaccatgttcagtgcagtgctataaattgtgcataacaccacgggacccatatgaagtgccactaatgatgcttaaagtgctccctacaagaagcaaagtcatgacatacaagaaaaagttgaactgcttgatgtgtaccatagatggaagtctgtagctgaggttgcccactatttcaggtagacagtcttgtaaacaggtgacataaacttatggtatcagtaaatacagtatggtcttgtaaatgtattttctcttccttatgattttcttttcttttctttccttttccttttccttgtctccctggctggagtgcagtggcacgatcttggctcactgcagcctctgccttccgggttcaagcgattctcctgcctcagcctcctgagctgggattataggcacatgccaccacgcccagctaagtttttgtatctttagtagagacggggtttcaccgtgttagccaggatggtctcttatctcctgacctcctgatccgcccgcctcggcctcccagagtgctgggattacaggtgtgagccactgtgcctggccatgattttcttaataacattttcttttctctagcttactttattgtaagaatacggtatataatacaacacagaaatatttgttaatctactgtttatgttattggtaaggcttcctgtcaacagtaggctattagtagttaagttttcaaggagtcaaaagttacacagatttttgactgtgtggtgggggggttggagcccctaaccctctcattgttcaagggtcaactgtatatgtgttaaatgccataacttttcctctaagcactgctttcactgcatctcacaaattttctttttattttcatttagtttaaaatatttttcaatttctcttgagatttcttctttgacctatgtgttatttagaagtgtattgtttaatgtctcagtattttgggattttaagctatctttctgttaccgaattctagttgaattctgacgtgatctgagagcagacattgtatgatttctatttttaaaaatctgttaaggtatgttttatggctcagaatgtggtctaccttgtaagtgtcccatgtggatgagaagcatgtgtattctgctattgttgatgaagtagtctttagatgtcagttatttccagttgattaacggtgtcagattcaactatgtctttgttgattttctgcacgccagatctatttctgagaggggtgttaaactttccaacgataatagtgggttcatctcttactccttgagattgtatcatttttttgcttcacatattttgatgttctgtttagacacactgatgtcttgggaattaacccctttatcattataaaatgcctttctttattcctgataactttgacatctgagctgtctgaaattaatatagctactcctgctttcttttgattatttttagcctggaatatctttctccatccatttatttcttatccgtatgtatctttatattatagttaaagtggggtttttttgtagacaatatgtacttgggttttctttttaaaaaatctattctaggccatgtgcggtggctcatacctggaatcacagcactttaggaggctgaggcaggtggatcgcctgaggtcaggagtttgagtccagcctgaccaacgtggtgaaaccccacctctattaaaaatacaaaaattaaccgagcatggtggcgggtactgtcccagctactcaggaggctgaggcacaaaaatcacttgaatccaggaggtggaggttgcagtgagctgagatcgtgccattgcactccagcctgggcgacagagcaagactctgtctcaaaacaaacaaacaaacaaacacaacctattataacaatttctgtcttttaattggtatatttagaccattgttactcaaagtgattcttctttatttttagagacagaatctcactgtatcacccaggttggagtgcagtggtgccatcatatttcactgtaaccttgaactcttgggctcaagccatcctcgcacctcagcttcgcaagtagctgggactacctgtgctcagcctcccaagtagctgggactactggtgcacaccaccactcctggctaattaaaaaaaaaatagtttttttggagggacgggttctcgctgtgttgcccaggctggtcttgaaatgctggcctcagcctcctaaagtggtgggattactgggatgagccaccatgcccagctttagagtgattgttgatataatggaatggatatctaccatatctgttaactgttttctatttattgtccttgttctttgttcatatttttgtcttccactctttttgtgctttttgtggtttcattttattttattgtattataattttttgagacagagtctcactctgttgcccaggctggagtgcagtggcatcatcttggctcattgcaagctccgcctcctgggttcacgccattctcctgcctcagcctcccgagtagctgggactacaggcgcatgctttcctgcccagctaatttttaatatttttagtagagacggtgtttcactgtgttagccaggatggtctcgatctcctgaccttgtgatctgcccgcctcggcctcccaaagtgctgggattacaggcgtgagccaccatgcccagcctgccttttgtggttttaattgagcaatttgtatgattctgttttctcttctttcttagcacagttctctctttttttttttgagttgttgccttagagtttgtaatatatgtttacaacaaacccaagtctactttctaataacactgtgcagtagtgtcccactttaactgtggttttgcttttcacagttttggttacctccagttaaccgtggtctgaaaatactaaatgggaaattccagaaataaacaattcataaattttaagttgtacgctgttttcagtagcataatgaaatcttgtgcttttcagcctgagatgtgaatcatctcttggtccagcacatccatactgtatatgctacctgcctgttagtcacttagtagccatcttagtatgattgaaaaagcatactggatatattgggtttgctgttatttggtttcaggcatccgctggggtcttggaatatattccccatggataagatggcaccactgtaattttcacttgtaatgtgagtactttataagaacaaaataatcctaattccttcctcgcatcccttgtattgttgctgtcagtcatttcagttatacataagcatatgtatttatacataagcaatcataattgaatacattgttgcagatattattttgaacaaacttatctattagatcagttaataagaaaaaagtttttttttaaaattttatcttcacttgccccttctgagatgctcttcctttcttgatataggtctaagtttttgacctgtaccgttcttgttctctctgaaggacttttaacatttcttgcaaggtaggtcatctgacaacaaattcttaaatttttgtttgcctgagaaagccttcacttttgaaggataattttgcagggtacagaattctaggttgatgttttctttctctcaacatgttacatatttcattccctcttttcttgcttgcatggtttctgagttgatgtaattgttaccttaggtatttttttccctctgacctcttttaggttttttcagtattctgtggtttttaatatgatgtgaccaggtgtagtttgtttgggcatttatcctttttgatgttctttgtcatttggtttctgagattaatttgaggaatatttcttcttcttcctctcttttgtctctttttggtatttccattacatgttacctttttgtagttttctgtattaaacattctgttctttttttttttttttttcccagtctttttctctttgcttttcaggtttggaagtttcttttgaaatatcttcaagcaatgagattgtttcctcagctgtgtgaggtctactaatagacccactaaaagcattcatcatttctgttagttttaaaaaaatctctatcattttaatctctagaatttcgagttctctgcttacattgcccacgtcttcttgcatgctgtctactttatccattagaaccgttagcatattaatcatagttgctttcaattcctcatctgatcatttcaaattccttcctgcatccaagtctagttctgatgttgctctatactgtgttttttgctttttagtataccttgtaattttttttctcgatagccaggtgtagtacactgggtaaagacaacagctgtaaataggcctgtagtaatgtggtgggccttgtaggaggagggggaagtctgaattttttactcttcctccccaccctgccctttcactgcttttaggtggggcagaatggcctagaatgggctaaagttagatagttctcttaggctagaactggctggagtttatttctcttctcgtaggttaggctctagttaaatagtttctcctgaaggcaggccttgttaagagaaatggttccttttcccctcctgctgttgaaagcaagaagatatttttctgtgaagttcactgtgagaaactggtagagctcctagaggtaaaacacaaaaccgtggggccccacgatgactgggtccctctgtagtttgtatcttccagactcgtccacactgaacctccaacgttttgtcaattatggttcaggtttttgtacccatggagctttttacccatgggtttctgctcaggtaagttgtgattcatgtctattcctccagttctgagggtacctgtttgccctgtgactttattgaccttatggttctagcaagagttgttgatttttcagtttagctttttacatgtattaactatagttatatcccttttctaatttggtaagccagttctaactatagtggaatggattataattgttaacaataactaagttaatacctatccattattataaatatgtctcataaataataattcttattaaaatagtaaaactatcggatttaatatcaagattaccatttgtgactaacctttgagggatttccactaatgatgtctatcatactgccttgagttatgtatcaaaatcttagattatcttctggtctaattatttgttaatttttagctgttgcttatgtaatgactattggttcttatttagtggtggttttcagatgttagtatttaattgacatagacaagataggggtcttttgctttgtcagtacacttgatgagacaggtggaattggagttccaaagccatacacgtgttactttacttcagcgccttttggttatttgcatatggtttaagtatacagctttgtataaaccctacatatgcctttatttacaagaatagaaactttagtgatattattattttaaaaagtggacaccccaaattattgtttgtacattttgagtctagctgctaattcacaacagattatggtgacatttggcacaaagaaaaagcctggattcttattacattaattggcctaacaatttaactttacctgtcctttcttatctttttttgatatgaaagtttgtaattgacacttctctttttgaagtatcaggtttttctttggataaaattttccctaactttagtatattatttaaaattatatactgtggtggtagatattggtgttgtctgtcaaatagttctggcactctcccttctggatatgtggtggaattacacagctccaagcctgcttgacaggcccatgtgactgtgtccagtgaattgtgggtggaaatcatatgggtcacttctggactggagcaaaaccctctgagcttttttcttttgtagttactgtcagtgtttgaaatactgactgcttcgatggtttagttgaagagatggtgaagcaaagacacctatatgtctttgataagccatacataattttcaaactgaagtttaaaatgaaaaattcagcttcttattgccacgtaacaaatcatttcagaacacagtggcttaaaaagcaaacatatttcatgatcttgtgggttaggaatttaggtcaggcttggctgggcagttctgctctgctggcatccaccagagtcatttattgctattcaggtgacacctgggctggtctagagggtccaagacagtttcattggttcatttttgtttttaaggcctaaataaagttaaatttcagaagaagatcaatattggtagaaataattgttataaagatgtatgttgtaatttgttggtttattttagtttcttttattaattgcaaaaaattccattaacatttaaaagttatgtaggaaaactaaaggaaatactgataacaactaaataaaacacctagagaacagttgacttccaacagttactattttttttcatttattagcagtctatcctgcttaaacaattactatttaaattaatgcccgcatattttttggcttttgacaagtattggactcttaagctttttgaatttgcattaaaaaatcacattaaatattataacagtaatgtatatttgtagaaatttatggaactgtgggtaattataaagagagtaagtcacctgtaaaagtgttaactctcagagaaaattagtgctttttttgtgtatttacttttagttgcttacattgttctgtgaaagcagcaactatattcatattattaatcagtgtcaatattttaagtagtttagtgaataaagatagtgttaataaataatttgctttttctaatatagtgctaatgttttagctttacagtacaattttgatgacattggatacactagattcaatgagatatatccagaaaacataactgtcaggaggcagacttctttcaaaagaagggagggacatggttacacaatttcttagctatgttttcttctgtagttttagtaggaagcaagcatgaaaagtattgccattctctggagttaagggaagtcagttattctatttaatagctgattaggctgggcatggtgatggtggctcatgcctgtaattctagcactttgggaggctgaggtgggaggataactggagcccaggagttcgagaccagcctgggcaacatagttaatccctgtctctaccaaaaaaaaaaaaaaaaaaatccaggcgtgatcgcatgtgccttgtagtcctggctagtggggaagctgaggtgggaggataccttcagcccaggagtttgaggttctgatgagctatgattgtgccactgtactctagcctgggtgacagagcatgagcccatctcttaaaaaaaaaagttgattaaagcatagagggagaaggcatattttttggataactagtcgataatgaatgtcagtgtttacttgcatagttagtaaatatgagttcattttaaatatattatttttctctgtgctttttataaatctttgtatctatatatgagatttatctgcttgctttatattatataatattaattaagcaactatcgaacatcattcaggttttgtggtagctctggtttataaaaacagatacagtgcctgttttcatagagcatatagtcaaattggggctgtggtctcctgtgaatggcacatacagaacaggggttcttaactttttcagtgccatagtcccctttggtactatgatgtaatccatggactctttttcaaataatgtttttaaatgaataaaataaaaatacaccaaaataggattacaaagataaacaattgcattgaaataaaaataagccaaacttgtaatcttataacatctttttaattcacttaaattataaaatctagcagtgaatttaataactactgtaattttgaagtagtgatgagggtgaatgatattttgggatatctgcaacaactgcatgtgataagaaaatatccgtgatttctgttggtgacaaacacttaggtatccaccaataccactgtgcttgttgcttacattcttaatattttcttagaattctaaattttggaagtgaataaaaattagaggttagtaaaaataaagaagtaatttctccctctaaaatcctataacccttgagtgagtaaactttaaaaatccattgaaaaagtaggacgctttgaaagaatatactaatgtattgataagggagtccaaaattgacctctaaaatatttttgacatagcctgttatgctatcagtgttggtaagtttgttcagtatatttgtaggctacacacagtcctttcaaagaagtatttaacctttgagggaaatacttttgtaattgttcaaaatcaaaatgctttatttctgtgaacttggctgtgagataaatgttctgtccacttcataattttattcagcagtgcttaaaaaagagtatttttagttatctcatagtgtttatattcagtaagtgatccctcagtaacatggtcctagtaagactgttaacatttctctttaatattgatgtatttataaaacttacatgctacactttgatgctctgccaggcggtggaagtagtgaaaagagcacatcaggctttagagttacacaacccgattttgtatcccagctttgtttcctattagctttgtgatcttgagcttgtaattaactttcagattttagtttccttatcttttgaatgaagaaaatatgttagatgttattctttttttaaaagagaaaacttgagagagaactattaggcacactttgatttatccttttagttttagctgggcttctaatacctttctgaagcctttctgagctgtattccccacctcttccccttaactcccatcatgccatgtgcttaccagcatcatcattattgtgtcctatttttattttcagtctttcatctagatccattaaacgtagggatcttgactatctttgtaatgactaccatttgaatagaaattatagtatgtacttgttactcaaaattttgtttggtaaataaccattctaaattaatgatatattaactctggagcatagatcggagggggctaaataaatgtcttctttattctcattaattctcataatgcaatttaataattcatgatgtgacatcaagagttagaaattgagtaggtgagggctgggcacggtggctcatgcctgtaatcccagcactttgggaggctgaggcaagcggatcacgaggtcaggagatcgtgaccatcctggctaacacagtgaaaccccgtctctactaaaaaaatacaaaaaattagccaggtgtggtgccgggcgcctgtagtcccagctacttgggaggctgaggcaggagaatggcgtgaacctgggaggcagagctttcagtgagctgagatcgcgccactgcactccagcctgggcggcagagcgagactctgtctttaaaaaaaaaaaaaaaaatcaagttgtataagtgaggtggacaagtgaatccatagactatagtgtgtgaatgtagatagaggtcatcagaatagcagctacatcactacacttaagacgttgagctaagtgcttttcatgcgttcttttttttttatttttggatcataaagacagttttatactaggtggtattgtctgtcttaaatgacgagcaaagtaaaattgagatgaagttaagtaacttgccaaaggtcacattgctagcagatggcagagctagaatgcagactcggaaccattggattccaagcctttggttttaactaacacagcagacaccttttgctattaaactttctcatgtcttagaaccaatttgtgtaggataaattagagtcattggaggtggaaaagtaaaggtttaaaagagggtatgttatgaacttatttaagggaaagggttagatctaatttatctttgcatccccagagataatgcctggcacatagctgatgctatttaatgaagtgcacattgtcttcaagttctcttaggaatctacttacatgtgattaggttctcttttttattgttgttgttgagacagggacttgctctgtcacccaggatggagtgcagtggtgtgatcttggtgcagctgcaacctctgcctcccaggctcaagtgattcttccacctcagcctcctgaatagctgggtctactggtgtgtgccaccaaggccggctgaattttttttgcttttgccatgttgcccaggctggtcttgaacttctgggcttaagtgatcctcctgcttcccaaagtgctgggattacaggcttgagccaccacgccaggtcaatgattaggttccttagtatagtttaccactgtacatgtgccacctagtggatggagattatccgtagatagtggctacagatgaaatcgccttgcctgtccttatcccagggttgcagttgtccccacctttctgactttggtgcattttgtgaccaagtgtcattgcctgtattttaggtcaggttcaaagtaagggaaaagatatattagggattttatattcaagaaaaataccacactgaatttttaaaaatgcaatgtaattttttaaatgtctgctccaatttccacagtttggcttgcaggcagtttgagctaattggacctcatgaaaggcaaaaactctgcaaagtggtggagtcgccaaacctggactgttttattggttgaatggctagcttctttctttaggcaaagcataggatagtattcaagagtacatttttaataataaactggagataattaagtactggcatcaggcatatttcctcagatatcactgggtttgtagccatttcatccagagcatctctggatgacatctctggttggatccctggttgacatcatttttatccagagcagtctgtttcacattctgctgccaaactctgacaattgtttgaagactaggattaggagaagagagagagacataaacactcagttgtcctgccttgactttgacagatactaagatctaacatagtctaccaaatgaagagtgacagttaaagacagcttctgttattacctgaagtatcaaatatttagtgataccttttttgttgtttgttcctattttgtggcaggaattactgctatctaggaagcagtcatagagtcctctttatttgttaaagaacacaagactgaaacaacaaaatctaaaccaaaagtaaaaccaaaactatcgctccctactgtttctttagcagatccaagttagaatcatgggcagagccagtaataataatagctagaggagaaaagagaacaggatgaactctgaaagcctgtcttcttacctgctttatgggatcagatctggtgccgatcctatttcttaaaaaacaaaaaaaaaacaaaaaaaccctatagtctgaatctgtttttttctctttgaaatgcaggaaacataatttcaaaaggttgtatacctgcaaacctactggccaaccagtaacattaacgtttaacttttctatttccttctggctcttatttgagggagagatagacattgtcctgcttcttttcccttagctgtaagcaataaaactcccctaaaaataataaaagtgctatgtattttcttttttggggataaaaataaggaaaaagctgaaactgttatatacttcgctaggagaaggaaatttttgactggaggtcatatatggtagatagcagcatagtaaaaggaagcagacaagtcatactggattggagagagcacagcttgggagtggagacaaatggatctggctccaggaaaaaatgtgttttcagggtaatgtaatgatttgcgaccctgggccatttggctcattgttggtaagtttctgaaggcactattcttattcctccttaagtttgtcacttatttttctcttcccctttcttgttacccagtagtaagaatggtataaaatgggtatatcccaaaatgtattctgggactctctgagtagaaatgaaatgctttcatacaggtatttatatatgtgataattttatagtactttgaatataataggcaggcagagagagtctctctagcagaactgtattcttttctatctttggctgtaaaaatactagagagaggcaacacagaataccctttgggtcattccagatgctttgcctagagctacaggctctgtaggtacagtctacattccaaattgttgtaggtcatagctatattaaatattttaatatagcctaaaaagggtcagttgattttcagactccattatcagtgtttcacggcctgatcaagccacttgaagattttgttacggcaattcttcactctttaataccagttttctgtgttaattagggcatgggttaaactgctgtaacagagaccccaaaatatagcagtggcttaaataaaacaaattgatcttctctcatgtaatatttctgaggatggagaggtataggctgatgagttgtcttttgctccatattattgtttgttgacccaggtttcttctgtcttgtctctctgccatcacctggagcattgcgcctcattggcagcattgcgactgggttgctgtcatgtccattccagtctgtaggaaaggggactataatttagtgaagagcagctcacttccttttagatgatgaggttgcgcagttgcttctggtcatattctctcggtgagaacttgccatggtttgctgcaaagagggttggggaataaagtctctagctgagcagttatgtgtcctactaaaacttggaaagcatagaagatgaagagtatggattttgtcctttgtctactttctttctttctttttttgagacggagttttgctcttgttgcccaggcttgagtgcaatggcatgatctcggctcaccgcaacctccgcctcccaagttcaagcaattctcctgcctcagccttctgaatagctgggattacaggcacgcaccacctcgcccggctaattctgtatttttagtagagatggggtttctccatgttgaggctggtctcgaactcctgacctcaggtgatctgcctgccttggcctcccaaagtgctgggattacaggcgtgagccaccgcacccggcccctttgtctacgttctacaggtttatgtgccttgttcatctttggagttatttagctattcttgatctgaatacctttttttttggggggggattcaaattgtatttattttctctcatctgtgacacattcattttgttcatgaggtcatttgtcacatagaaatgtaaattttcattttattattccttttgaatacaagcttacgtatttgtagatttgattctagatactttatcaattttgtctcgggatagacaggacaccttgattgatagactgtataaacacttaatttaaggtcagcttttctatttcaattttttaaaaaagaaaagaaacatgttattttaagtatgaaaaccaaaaccatctgtttgatgcttcatgttatcattagttttatgatttgataggatttacaattatttgtagttttttctaactacccaagaatagttatacaaattgtttttcaaaatacttttctaaaattcattttgaatgtagaagatagttttctttttttaaagagggaagtcagattgaagtgctaatctgagcgataagagataaagttttgtgtgaaatttagtgttcaagctgctaagtatgtctagtgtatagttaaaatatggtgtggaactcaggagaggagttagtgctagagatgttgacttacaaatcataaagtccagaggaaattgttgaaatgtggataataagttcttcaaagaggagcttataggctgggagtagtgactcatgcctgtattcttggcactttgggaggccaaggcaggaggatgatttgaggccaggagtttgagactagcctgggcaacatagtgagacccccatctctacaaaaaaatgaaaaagaatgtggtgacatgtgcctgtggtcccagctgcttgggaggctgaggtgggaggattcttgagcccaagaatgcgaatgatcatactactgcactccagcatgggcgacagagtgagtccttttctcaaaaacaaaaacaaccacccaaccccaggagtatataaaggatgtatagagggctgtacctatatttagaggtctaaaggaaatcagctgaagagatagatattagactattatatctctgtgcttataaaagatagaagatcatttcactaaggaggaagtgatcctggtgtgaagtgaacttttaggatgtttgaagaaagcttgtgggtgctaactggattgttaattcttttgccgttggtctattggtggtgttgacgagaataatttgtgtgtgtgtgtgtgtgtgtgtgtgtgtgtgtgtgtgtgttttgagacgcagtttcattcctgttgcccaggctggagtgcaatggcatgatctcggctcactgcaacttccatctcccaggtttaagcaattctcctgcctcagcctcccgagtagctgggattacaggcatgtgccaccaagcccggctaattttatatttttagtagagacagggtttcaccatgttgttggtcaggctggtctcgaactctggacctcaggttatccgcccaccttggcctcccaaagtgctgggattacaggtgtgcatcaccatacccagctgagaataattgttataataggaggctggatacaattagaaaggtatagttgaaggggaaggtagtagagttcagtcatgccatctcatgaatttggtggtaaaaggaaagacagagaagaggcgcttgaaaggactttaagatgtttttgtttgtttggggttagtgatgcagaaaggtctaaataaatttcaaattagaaaagaaggagccagccaagagcatggaactgcatcatgagcactggtggggaggtgtaatgtcccttcattgtagtaatagagcatgacagacagagtggacatataatttttattaaacaagaagaatgatgttaggggtagtggtgtgtggaaatcctctcagctgttaggctgcctcctgagaaagaacatttaaggtgtttggggttggattcaaggagaatggaaaaaggcaataaagtgaaggtttgtccttttcaaatattaagcttttagaatgggtaataattaagatacatgatgagtcttttaatgatgattttataaagtgtgaagcaatttttaatgagtcactttgaaatacatttgttctgtagaccaattgctataatcctgaaataagatttttttttggccgggcacagtggctcatgcctgtaattccagcattttgggaggccgaggcaggtggatcacctgaggtcaggagttcaagaccggcctggccaacgtggtgaaacccagtctctactaaaaatacaaaaattagccaggcatggtggtgggcgcctgtcatcccagctattcaggaggctgaggcaggagaattgcttgaacccgggaggcagaggtggcagtgagtcgagatcgcgccattgcattccagcctgggtggacagagcgagactccatcaaaaaaaaaaaaaaaaaaaaaaaaatctttttgttgttgttgttgttgttgttgttgttgaggtaggatctagatgtgttgcttaggctggagtccagtggtgccatcacagctcactgtagcctccgctgccggggcttgattgattctcccacctcagccaccagagtcgctaggactacaggtgtgtgccactatgcttagctaattttttgtagagatggggtgttaccatgtttcccaggctgtcttgaactactgggctcaagcaatatgcctgcctcagcctcccaaggtgctgggattacatgtgtgagccactacacctggccaaaaataagattctttttttttttttgagacagggtctggctttgtcacctaggcctgagtacagtggcacgatcccagctcactgcagcctctggctcccaggttcaaggcatatccttccatctcagcctcctgagtagctgacattataagcactcaccaccttgcctggctaatttttacattttttgttgagatgaggtttcaccatcttgcccaggccagtctgaaactcctgagctcaagggatttgcttgccttggcctctcaaagtgcagggattacaggcatgagccaccatgcctggccaagattcttaacatttattactaggatgaaacttctctgagtcagctataatttgggcacaaggaaaagtataccatgcttcacattattttgataatcattttgcggtagagaataaagatgcacaataccactaattacgtgcatgaacttttcttgtgttagtgaaatattgttatttgttgtttctttttacattatgacctatgctttatagatacattcaccagtgattaaaataaacacaaaaatgactctttgttttctcttgtttactgttaagcagaaatcaaagaacaatctgcagaagaggatgctgaagcagaagtggataacagcaaacagctaattccaactcttcagcgatctgtgtctgaggaatcggcaaactccctggtctctgttggtgtagaagccaaaatcaggttagagaatgaatgcagctggattggatattagtgacaggaataaagcagtgaaatgactatagagaaaattcaaggagtatgagtttaggatgaaaatctgggtgggattttatgatttagtagctaaatttgaagctgatacctctgtgtttagttgggatgagttacatctgtgggcttaggcaattgtagagcagggcagcacactacggttttactctagtcacctcaggccagtacagaatattaccaatgtgctgttcctggcagaagacataaatgtgagcatttagcatgaggattaatttttgatacttacctgtaaacttaagttgatagttttgttccttaccttctccccattcattaaaaaaggaaacacaggacattataacctattttttttctttctttttctccccccccccaccacccctccccccctccctttttttgagatggcgtcttgctctgtcaccaagctggagtgcagtggtgccatctcagctcactgcaacctccaattccctggttcaagagagtcttctgcctcaggctcctgagtagctaggattataggcatgcaccaccatgcccagctaatttttgtgtttttagtagagacagggtttcaccatgttggccaggatggtctcgatctcctgatctcatgatccacctgcctcggcttcccaaagtgctgggattacaggcatgagccactacactgggcctgtaatatatcattgtataattcagctttgaagttttaagagtttttagaccttatttgaaagacatgaataaaataatgaaattatccatcagtttggtactcccatctccttccttccctccctccttacctgtctccctcccttctttccctccttccttcccgccctccttccctccctttctccctccttcccctccatcccttctccctccttcctcccttcgtttcccttctacttccttttcctcttcccttttcttcctttcctttctttttttttttattttttgaggcaaggtcttactctgttgcccagggtagagtgcagtagtgtgatcacagctcactgcaggctcaacctcccaggctcaggtgatcctcccaccttagcctcccaggtggctgggactacaggtgtgtgccaccatacttggctaatttttaagctttttttttggtagagactgggtctctttatgttatccaggttggtctggaactcctgggctaaagcaatcctcctgtctcagcctccctaagtggtggaagtgcaagcatgaaccactgcacctgacctctctcatcttcttgaaccattttctttcttttgcttttgggacatctcactcctcattttatcttttgctagttgctgtggagactctacatgtttataattttggagttcttaaggataagtcctcagatatcttgtctactttttgtctctgttcactccctgggaaagaaagctcattcattctaatggctgtaacctctgtgtgtgcccttaagagtctcacgtgttcatttccgttactcttctttacctgaactccagacttttatgtccaactgtctgcttgacgtctctatttggaagtgtattagacacctcacccttaacatgtccagtaccatgcttgattctgcctccacctctgccccaaatctgcttctccctacgatttcctcatttcaataaataatgccagtattcactcagttgtttagtccagaaactttgaaagttaatccttgatttctatcttttctcataccttgtagctcaactcgataacccaaacaacttgttagtgtcttaacttgcctaacattttagttgaagtcactgttatcctttggaagttgtagtagccttttaaccagtctttctgcttctctttacctttccatagtccaatttgtttatagcacagttgcaaaaattattctaataatgataatcaggtccccactctccactctctttcatgactattatatttaaattatattcataatttcaagtacttaccatgtctacaaggtgtgatctgttcctgactgcctctctcatgtcatttgtcactcactgtgctctcaccacattggcctcactcttttaaatgtgctgatggggtttctgtctgagagctttggtgcttgctctgcttgtctcctggcttacctcccagagaggctaccttgctgataatactagcctcctctgaagggccacatccagcttagtctcagtcagcttaggaaaaagaacatacaatgtgaatcaacgaaagaacacactggtgtttgttatactgtagtcctctcctcctcctccaatattttttgggaggtttgaacattttcaaaataaaggagtaggatggaaaagaaaacagcagctcccaccatattttacatagtaacctgctttatttttctttgtggcacttattattttccaacagttcatttgactgtcatgtgaactctgaagacacgcactttgttggtgggctttgttcaccacactgtgtcctgcacttaatagttcctgacggagattaggtgctgtataaatttttttttcttttttcttttttttttttttttttgaggcggagtctcgctctgttgcccaggctggaatgcagtggcgcgatcttggctcactgcaagctccacctcctgggttcacgccattcttctgcctcagcctcctgagtagctgggactacaggtgcccgccaccacgcccggctaattttttgtatttttagtagagacggggtttcaatgtgttagccaggatggccttgatctcctgacctcgtgatccacccgccttggcctcccaaagtgttgggagtacaggcgtgagtcaccgcgcccggcccaatatatttttaatgaataatgaattctagttgattgaaaagcatttaaagttctgcttaaatttttgtagtttgatactaccatgaactttactttttgctatgtgttatatagagattagaaatggtgtaatgcatatgtggtattgagaggtacagaatgcagaatatttgctagtttagagcaggtgcctgagagccttctgaaagtattctgtgcctctgtatcctctaggcctacttcgggaacccattgtagttcttaaccttcttgcttggttcttctgcagatcttaaggacacagtatgcctgactgacttatctttttgtcacctgtgagtagcacactgtcactgttagtcctcatctaatacttgtacagagaatgaaagttaaaagctactcatgaatatatgataatttcatttataataatcatggcctatcagtggaaaagaataggtcactcaataattggctatccatgtaaaaaatataggtagattgatgctcatgccacatggaaaaataaccttgaggtagattaataagcaatgccattgttatttatttatcctgggctatactaccactaccactgttattttcattagacaggacagagtgaatgtacactgagaaagccagcatactgtaaatacagacttggtgtttattccaagctccgactttttgacctttatttattcatttttatctctctgtcccacagtttccttaaaataggatgaacagattgaatttaatgaattttattttattttattttttttgagacagagtcttgctctgtcgcccaggctggagtgcagtggcacgatctcagctcactgcaggctccgcctcccgggttcgcgcgattctcctgcctcagcctcccaagtagctgggaccacaggcgcctgccaccacacccggctaatttttttgtatttttagtagagacagggtttcaccatgttagccaggatggtctcgatctcctgacctcgtgatctgcacatctcggcctcccaaagtgctgggattacaggcgtgagccaccgtccccggcctgaatttaatgaattttaatggtgcagtatataaaatgttctaaatgaatatgtataattaataggattttagcaagattactagataacaaaatcaaaatgcaaaaatcacatgtatttttatatattaggaacagagttaaatggtattttttagaatattttccaataatataaaataatatgtgactaggattatgtgcaaaaatgtaagacttttatagagaaaattataaaactttttggaaagattaaggatcacagacataatagcagtataatactcacattttaggggattcagtattttaaagatattctttcccaattgatgtgtaggttcaagaaaattctaataaaaatttctacagtaaattttacaagctgatcttaatttatatgaatatgcaaaagacaggataagccaaaggacccatgaagaagaggaaggattgctttacttgatactaagactttttgtaacacactaataaattaagtcagtgctgtattaccacagaaacagacaaatagaccaatggatcagaatagggaacccagatacagatacatgattaatatggacaggttatttataacaaaggggcatcacaaattagtgaggaaggaagtctctttcaacaattgtgctagaacaattagacatactttaaaaaaaaaaaaaaagaaagacctaatttattcatgtctactccagttaatttatagacttaacacgtgagaagcaaattaataaaagaagttaatgtagaggaatttcttcattgctttggggtaaggaaagacttttaaaaaacaaatggaaagccctaattatagaaaagggttgattggccaggcacagtggctcatgcctataatcctagcactttgggaggttgaggcaggaggattgcttgagcccaggagttcgagaccagcctgacttgaacatgacaaagccctgtctctacaaaaaatacaaaaattagtaggacttggtggtgctactcaggaggctgaggtgggaggatcgcttgagcccaggaggtcgaggctgtagtgagctgtgatcctgccactgcactccagcctgggtgacatagtgagaccctgtctcaaaaaaaaaaaacacacataaaaagaaaaggggccgggtgcggtggctcatgcctgtaatcccagccctttgggaggctaaggtgggtggatccctgaggtcaggagtttgggaccagcctggccaacatggtgaaaccccatctctactaaaaatacaaaaattagctgggcgtggtggtgggcacctgtagtcccagctacttgggaggctgaggcaaaattgcttgaacctgggaggtggacgttgcagtgagccaagatcgcaccattgcactccagcctgggcgacaagagagaaactgcatctcaaaaaaagaaaagaaaaggattgattaataccactatacttaaatttacaacttttcatgaaaaataccaagagtaaaaagataaatgacagaaaagggaaaaatatttctaaagcatataactaacaaagaacttatgttcatatgtatttaaaaatgaagcaaaacaatgcaataagaagaagcttctgtagaaggcagtaagcattacttgattacttgcaataaacattactcgattactttcaataaacattacttgattatgacattttttaaacatgctgttgggttttagttagctaatattttgtttatgttcataagcaatatgaatttttgtaatattgtaatgtcctagttttggagacaaaattacactagcctcgtgtgtgaggcatctttcagttttcttattttctggaacagctagtttaagacaggaattgactccatgtaggtctgaagtaactgtcataaaattacatgggtctgtggggtttcttctagaaaatgaagtcattaccagttcaattcaaagattttttttcttggaatatgtattccataaatttgctccccacttccaaatttttttctattcagctgtctgtttcatcttgtaccaattttctcatgttatatttttctcagaacatatacattttatctaaaatgattcatgatacatttattatttttgaatgttatttttgattggcaaatcctaattgtacatttatgagtacagtgtgatgtttcaattcatgaatgcaaagtggaatgattgaatcaagtaaattaacatccattaccttgattaactctcatttgttacttgaaatttactcttaagttggtgcaaaagtgattgcggtttttgccattacttttaatggcagaaccacaatcacttttgcaccaaactaatagttattttaaaatataggtcaccctgctatgcactgtatctcaaaacctattcctcctgtctcaaccttcgtatcctttgcaccaaattgttattttaaaatataggtcaccctactatgtagtatatctcaaaacctattcctcctatctcaatcttcatatcctttgaccaacaacttactatttccttcttcctgccttaccttctccgagtgtctggttaccatcactctactactggttcttttagttcaacttttttagattctacatataagtgagatcatgccgtatttgtctttctgtgcctggattatttcacttagcatgatatcctctagattcatctgagttgttgcagatgacaggtccctcccgcttctctctctctctctctccccactcttccttaatccccttcccctcccctccctgcctcccttcccttcccctccccctctttttctacctccccttccctccctcttttttccttccttctctcccttcgtccctccctccttcccttccttccttccttctttcctttttttctttccttcctttctttctctttctctctctttttttttttctttgaaagggtgtcactctgttgcccaggctggagtacagtgccatgctcacaactcactgcagtctcaacttcctgggctcaggcaatcctcccaccacagcctccaagtggctgggactacagttgtgtgctcaccacaccaggctaatttttaaaattttatgtagagatggagtcttactgtgttgcccaggctggttttgaatatctgggctcaagcagtcctccagccttggcctcccgaagtgctgggattataggcatgagccaccactccccatcctcccgcttttcaaggctgaatagtattccattgtttatatataccatgttttctttatccattcatctattgatggatacttaggttgattccatatctggctattgtaagtaatgctgtagtaagcatgggcatgcagatatccttttgacattgatttcagttcctttggatatatacccagaagtgtgattactagattatatggtaattctatttttagttttttgaggaacctctttaccattttccataatggctatactaattgacacccccacagcaatgtacaggactcccattttttctgtatccttggcaatacttatctttcatctttttaatagtagccatttgttaggtgttagccaatagccaggtgttacgtgatatatacttgttttaattttcatttccctaatgagtagtgatgctgaacattttctcatgtacctgttggccatttgtatgtgttcttttgagaaatgtctgttcaggtcctttgcccattttttaatcaggttgttttcttgctgtttatttgggttccatatatattttggatattaaatattttctcccattctgtgggttgtctctttactttgttaatattttcatttgccgtaaggagcttggtggtttagccatcccatttgtctattactgcttttgttgcctatgctttcagggtcatatccaaaaagttattgcccacatggaactttctccctatgttttattctagtagttttatagtttgacatccgaaacataagactttcatctattttgaattgattttttgtgttatgtgagacaagggtatgattttattcttgtgcatatggatatacagttttttcagtgccatttattgaggagacagttctttacccattgtgttttcttggcatctttgttataaatcaacttagtgtaaatgcgtgagttcattcctgttccattggtcgatgtgtcttcttgttttttgagccagggtggtatttgtagcccaggctggagtgcggtggtgtgatcttggctttctgcaacctctgtcttctgagctggagccgtccacccacctcagcctcttgagtacctgggactacaggtgttcactaccacccctggcttattttcgtatttttagtagagacggggtttcaccatgttgcccaggctggtttcagactctgggctcaagcagtctgcctgcctcagcctacccaagtgctggcattacaagtgtgaaccaccatgcctgtccagatgtatggtttttttttttttggtgccagtaccatactattttgattacaatcattttgtaatgttttgaaatcagacagggtgatgcatccagcattgttctttttgctcaaggttgtttcggctgtttgatgtcttctgtgcttccatataaatttaaggataatttatttctgtgaaaattgacattggaatttcgatagatattgcattgaatctgtagatcactttgggtagtatggacagttagtttcacagtattaattcttccagtccatgaacataggatatcttcccatttcttgatgttttcttaaatttcttttgtgagttttatggttttcagtatacaggtcttttacctccctggttgaaattacacctaagtatttaatttttttgttgctattgtaaatgggattattacattaattttcttttaggatcgtttgctgttagtatatagaaatgctactgatttttgtatatttactttgtatcctgctactttatcaaatttgtttattagttctaacagttttttggtggagtctttagggttttccatatataagatcatgccatcagcaaataaagacagtttcacttcttcctttcctactgggatcccttatgtctttctcttgaccatattgctctgcctaggacttccagtaatatattgaaatttttatattcagtattttatattttatatcaattttatattcagtattttcattatgattttatttcacatattgggatttccattttaagtgaaagattcttaaacaatatcttttctagtttccaaatttatttatttatttatttatttattttcttgaaagggagtcttgctctgttgcccaggctatgcaatggtgcgatcttggctcactggaaccaccacctcctaggttcaagcgattctcctgcctcagcctcctgagtagctgggactacaggcgtgtgccaccatacccagctaacttttgtatttttagtagagacggggtttcgccatgttggtcaggctggtctcaaactgctgacctcaggtgatccacctgcctcagcctcctaaagtgttggaattataggcatgagccactgcacctggccagaagattttaagttatccatttattatacatttttagttttactgcattattgtcagagaatgttgcctgcatgatgttggtcacttgctatgtatcatgtattcttttatggcctactatgtaatccactcttgaaatattttaatatacttgaaaagaatgtgaaccgttagttgtagatagagctgaatatagtatctcaaactaatttattatgctcaggtaattaataaataatgaacaataaagatgttcaatacttaatttttattggtttgacatagtattttctgagaaaaataattaaaatcttccactgttgttgatttaatttttttagtcttccagttttgttctgagaaactcaggttgagtttctcctatccaaaatgcttgggacaggccaggtgtggtggttcatgcctgtaattccatcactttaggtggccaaggcaggtggatcacctgaggccaggagtttgagaccagcctggccaccatggcaaaactccgtctctactaaaaatacaaaaattagctagatgttgtggcgtgtgcctgtagtcccagctactcgggaggctgaggcaggagaattgcttgaacccaggaggtggaggttacagtgagccaagaccgtaccattgcactccagcctggacaacggagtgagactccatctcaaaaaaaacaaaaacaaaatgtttgggaccagatgtgttttggattttggattttttttggattttggaatatttgcacatacataataagatattttggggatgggagacatgtataaacatgaaatttgtagggtccagccccacaggttcggtgggttttctccccgtgtgcggagacgagagtatagaaataaagacacaagacagagataaaagaaaagacagctgggcccgggggaccactaccaccaagacgcggagaccggtagtggccctgaatgccaggctgcgcagatatgtattggatacaagacaaaggggcagggtaaggagtgtgagccatctccagtgataggtaaggtcacgtgggtcacatgtccagtggacagggagcccttccctgcctggcagctgaggcagagagagggaaagggagagggagagggagagcttatgccattatttctgcttatcagagacttttagtactttcactaattttctactgctatctaaaaggcagagccagctgtacaggatgaaacatgaaggcggactaggagcgtgaccactgcagcacggcatcacaggcagacggttaggcctctggataactgcgggcgggcctgactgatgtcaggccctccacaagaggtggaggagtagagtcttctctaaactctaaaagagtttagagactccctttcccggtctgctaagtagtgggtgtttttccttgacactgacgctaccgctagaccacggtccacttggcaacaggtgtcttcccagacgctgggaccaaggactcctctggtggccctgtctgggcataacagaaggctcgcactcttgtcttctggtcacttctcactatgtcccctcagctcctattgctgtatggcctggtttttcctaggttatgattgtagagtgaggattattataatattggaataaagagtaattgctacaaactaatgattaatgatattcatgtataatcatatctatgatctatataactattcttattttatatattttgttatactggaacagctcgtgcccttggtctcttgcctcggcacctgggtggcttgctgcccacagaaattcatttatgtttcgtatataccttatacacatagcctgaaggtaattttatagaatatttaagtaattttatgcttgaaacaaagtttatattaagtacttaggtgtgaaattttctacttgtgatatcatgttggtgcttaaaaagttttgaatttcggagcatttcagattttggattttcagattggagatgcttaaccatctctttcagattcgagattcattttgagaccagattcatgttggtctgagtatatggttatgatcgatatctattatactattcatcattttgttagtgtgtaacatctttttcatctctaatgtcatgttttctttttgacataactttcattttgtctgataaaattattgccactcaaacttccttttggtttatgtttgcctggtatctttttacctcttttcccatcaacatttttgtccttgttttatatgtcatttgtgtttatacttccaacattttttgcacctattttttttttttttttttttttgagatggagtcttgctctgttgcccaggttggagggcagtggtgcgatctcggctcactgcaacctctacctccctggttcaaacaattcccctgcctcagcctcccgagtagctgggattacaggcgcacaccatcaatgcctggctaatttttttgtatttttagtagagatggggagggggtgggtgggtggtgtgtgcttcaccatgttggccagagtgatttcgaactgacctcaggtgatctgcccaactaggcctcccaaagtgctgggattacaggtgtgtgccaccacacccagctgcacccaattgttagatctaattttaatctaatctcaaaaatggtcttttaattggtgatttttgccttttaattggtggttttggtttacattattgtaatggctagtaagatttcgtatgctattttagaaaatgttttttagtcactgtatatatgttttttctttcttttatttgtttttgaggtggagtcttgctctgtcgcctaggctggagtgcagtggcacgatctcagttcattgcaacctccgcctcctgggtttaagtgattctcctgcctcagcctcccgagtagcttggattacgggcgcctgccaccatgcctggctaatttttgtatttttagtagagacggggtttcaccatgttggctgggctggtctcgaactccagacctgtgatctgcccgtctcggcctcccaaagtgctgggattacaggtgtgagccaccatgcccatcctctttttctttttaaaatacaggcagggtctcactatgttgcccaggctggtctcaaaatcctggggttaagcaatcctcctgccttgacctcccaaagcactggggttgcagtgtgagccactgttcctggctgagttgctgtagtgcgtgacatctaatgaggtacatgaagaggagcctttgtgtgggttagaattcccctgtctttggtcacaggtgttaacatagtctcactgtgtttcacacttggcttctagcaatttcttaaaaatttttactgagttcttatcaccctgctggtatgatatcagtggcctcttcctcagaggtgctattgtcacatttctttatggaagtgtctttcatttggtggtgagttggttgccttgtgatttctgccctctgatgggtttcagaaaagtgaatttgcagattctctggttgggttatgttgtgtggttgggcacaatgttgtttgcagctttctacagccagaccaaaagctagaaatttcccttgacctcgtattaaaaaaaagtcaacaataaattactctgaggtgtttgacctcccttacttcatacaaccttttctaattctttaataatttaagtacttctctaaaagtattttcatttttgatctgttgtctggcaaaatttctgaggtcttctaagccagagagtaattttattataccttcacatttaagcgatagttttgaatataaaattgaatgctaaggtatttttctgcaatagctttaaaatattgctccattttctaatcagtgctgttacaatcaatgttgataagactaatgtcaatctgattgttgcttctcatgggtagtgtttctaggggaagaaacaaaccagaaatgggatatggtgaaataaatgtaagcttaatagctcagagaacattacaaataaggggatagtaagatactggcaaagcataaggtggtggtctctttttggaaagaagaaattttctttttcaacttgacttgatttttttttttgaaattacactacatttaatttgtgtatgtctcggtaccagcagacaacatagtttctcatgaacttgaaataggtaatttattacaaaaacaaagctaattttgataaaagtaattagttgagagtccaatatgatttaaacctaagttttaaaaagtcacctcaaaaggctataggttagttctatcacctggtaatgcaagatatgtaagatcatggggtaaatactgtagaggtaactttaatgcccaagaaggaggatttgggtatagcagcagtaaatatcttgtgaagtgtaaatataatcaagaggaagcagtccttttaatttcattctttctaagatctcttagtaagtgtatattctatatatgtatattgattgttgtctcttaattttttaatgttttctccttttttattaatagacttagagcatttttaggtttacacaaaaattgagctcattctcccacctctacccccagcagtttccctcatgattagtattgtgtgctgtgttacagttggtaaaccaatatggatacattatttttaactacagtccatagtttacattagggctcagtatctaccattatagtatcatataaaatggtttcactggcctaaaaaatcccctttgctcctaatcatccctttccttcttccagttcagctcttctgcttccctaaaaatctactaccactcaacccaggaactatttaagtttatatttttatatctccccgtgtgtatgcatgtgtgtggtatatatatatcatgcataatgaacgttctatcaagtggttaaataaaactgtcaccatatgttttacagaactgtcatacagttgggtggctactaaactctaccttctttcccatttttaacttgcattttttttgtttcctgagacagagtcttgctctgtcacccaggctggagtgcagtggttcaatctcagcttactacaacctctacctcccggatacaagcgaggtgcctcagccacccgagtagctgggattacaggggtgtgccaccacacccagctaatttttgtatttttagtagagatggggtttcaccacgttggacaggctggtctcgaacttccacctcccagagtactgggattacaggcatgagccaccgtgcttggcccccacctttagctttcttacttggatttttttctagtcaaatataaaagaaaataacttttctaactgctaactagaattttttggatttgatatgtgtactactttttaaaatgctatggaaaagtagaattccaaatgtataattattaaacttaattgttcttatgggtaatcactgaatagactgtagaaaatagattgaaaagcttagcttgtgctttagacataatttaaaagcacaagtatctatagttatcgcttaaagcagttgaataaagctacttttctccttctctgacttacatttcatttttactagtgaacagctctgcgctttttgttactgtggggaaaaaagttccttaggacaaggagacttaaaacaattcagaataacgcctggatttatcttgccatggagaaaccaaccttctaacaagaaggacattgatgacaacagcaatggaacctatgagaaaatgcaaaactcagcaccacgaaaacaaagaggacagagaaagtaagcagtttcgactttaaatgttggaatagattaagactgcatataatttatttccattataatgtttataaattttcaaatgggattgttcttgttgaacagtttctcctgttctccacatttatgggatactctgactcaccattaacccaattaatccaacaaactatccttttcacaaatttttcttgttattttttaaaaagtttatattaattgtatatgaaagcggtgtgatcacaaaactaaacttttggaagaaaacttcaaagaacataacacaagctgagagggagggagttcatggaatttataaatggaaataatgtaataataaaacagatcaataaagtccttcttttgtttctctaaataagcttttaattttaagaatataacataatacaatagcaaatccagaattggttttcactactcatgtcttttgtgtcattcattcatcaatccattcagtcatttatttaatttatatataagtttgtgtgcttcagaaaatgttgcactgtcctatacattcttccctccctccctcccctgccttccctcccagaagatgcttttttcttttttaaggaattttttttttgtaatgatgtgtgtatgtctgtattcacgggcacattgtaattacctaaaggtcttgtctgatatagtttaaaatattttgtacagttgtgtttaaagaccatattaatatggagacttggctgtgctggttaagggagtagaagtttctgtagttgatgagaatgtgtaaaaattaatttagcttgcaaagctaacactgcctcttgagggttatgatgtaatcactcaagtgcttatctggcttatatccaaatttaagtactaaatcattgttgtgttgtacttatttgattggctcattgttttgaactgctgccaatgccttgaagacctgaagtaggaaatgaaacaataaaaagagggagaatcttttaaaagaatttaaggtggaacagtttaaggaaacttagaagtactatatttggagagttgtgatgttttggaggctatagctttttctttagttgtcagttgagtacacacatcttaataaaataatcaaaaggccagcaaacttaaaatgtctattagcaaatttaatggagtgaatcaggctgtatcttatatcctcatgttctgccttaaataatggcaattatataaaatcctctcctgagaaatggaattggtttcatttccttgttttaaaagtgaaattaatttttagtgaaaattcttatgagctcagataattatataaaaatagcctttgttaaacgaaagtctttatatatacttagtgcttaccaacttaataagtaatgataatatggcagttaatgaagtacacttaaaaatttggcatcattgaagggtaggcaattaatttagcttggtaatgatttcaaatatttacaaaatgtatgttgctaatgaagtttaaatagctagttaatttaaaaaacaattttacaaaggttttgaaaatgtctttgctcattttcactaaataaaaaaatcaagaatttttttcctttttttgttttataactaagaattttgtgggtatgcatttcagctgattcctcttgatatctctttctaagctgggctgctgtcatccttagtgttgacattgatatcttactgatatggtatatacatacaaaccagtctcaaaacttgaaggttgaatttgattaagctgctggttaggacctgattagtaataaattagtcattctcttggtttttttacacccctttccctcatcaaatactagtgcaaaacagtatgctaaaacaacatttagtagttatagatgaactgttggtcttttttttttctcccaataaaataacaatgatttgtaatggagcatatatttgtaggaatagagattatacttataggaaagaatttgttctcattttactgtgggcatttattaaaatgagaatttaaagttagcatagcatgctataccttttaaaaaaagtctatgcatttctaatgctgaacataaaaacattactggttatttttatatggtttgatatttaaatgtacttattgaaatatgttaatactttttttctttcaatgattccaggtataaaaatgtttagtaccctggtcattgtgctgattttctcttaataggaatcatgataaatatccagcatacagaagtgcagtgagttatgatctatattcaatagtgatttaatccagaattatgatcaggttaaatactatgatattaggagaagatttaagttttagtggtagtcatctgatttcccatatttaataattaagtacaatagccatttttatttatttaatggtcttaaataatacctaaagtgttagaccttgaaagcctgaaatctcccatatgttgtttactttattcaatgttctttttttagactatagtttttgctgttatactatcttccttattctacatgcctttggtagctattttgcttttgctttttacttccaatttgtgacatacagtcttgattgagagtacttgcaacgtcatgccacagaccagctgttgagatttgttgacgggaccataagaaagctacagctgatacattccattcctcctgcctctgttttcacactctgtagtgggttttcattttccctggaaaatatcctttctttacacagttaactgccacctctgttgtggcagtcctcagtcaagatacagcagactaaacatttctgatttgatcaagttttgttttgtaagcgtttaagtaaagccaaaggaaatactcagtttatgtgttaaatacaattcctgactaggatatgagagttggttttaaaaacattatattatggaatggaaaaacaaatttacaatttaatacttccctgtgggtttggagactctttttcttacttgttacttatacgatataatatggcaacccagtttaatattataccatggataatactaacagatgaattctaaaagttgttttatgacagttaatggctgataaattaaaattgatttggcagtacattgcatttaaacagttaaaaatgaaacaattttctgcttgttttcactttcacagttattttattttattttcagagaacgatctcctcagcagaatatagtatcttgtgtaagtgtaagcacccagacagcttcagatgatcaagctggtaaactgtgggatgaactcagtctggttgggcttccagatgccattgatatccaagccttatttgattctacaggtatgggcatgttttcaataatgactgcctcttaattctggaagcattttaattttaatacattattaatgtcctcaataataaatacctttcatctagaaataattataatcatactataaaaaaatcattattaaatatgcctggttaggtaaaagaaaaggtttatctatttaaaatctgtacagtaccaccaccggactggatgctttttaaaatacttgtattttttcttgtgtagatagcggtgccatggagatctgacaattgagaaaagagaaaattttaaaggggaaaattttaaagtgagaacttggggaatgtggcattctgagtctattttatttgggcatgaatgaaaataggtcttagccgggtagattatcttattataacagtattgtaactcagcactcatgatatggtgctactggaatttaaagtacatctcattctgtagttgaactgcagattgactgatagtggttcaagtgttatgtgatggataatttaaaggctgaagtgttaataatcattgatacgtgctctcactgtgggatgagggaagtagaggtgtatgtgtagtttattttctatacatttcctttgtatatcacctcaacaaagtactaagtaatactttgtttgctttatataaagataccagaaacatatcaaatacatatataatatttaaataaaatgactaaaaactaattttgtttgttgaagaaataatcactaattcagttattcttaaacttgtgtgtgcatcataataaccagacggcttgttaaatcacagattgctggcagggcacggtggctcacagcccgtaatcccagcactttggcaggctgaggtaggtggatcgcttgaactcaggagttcaagaccagactgggcaacatggtgaaaccctgtctctacaaaaaatgaaaaaaattcccggagtgtggtggcatgtgcctgtagtcccagctatttggcaaggctgagacaggaggattgcttgaaccctggaggttgaggctgcagtgagctgtgttcatgccactgaacttcagcctgggcaacaaaaaaagtgagaccctgtctcaaaaccaaaacaaaacaacaacaacaaaaaaaaacagaaccaaacacagattgctgggccccactgcacgagtttttgattcagtagatctcacttgtgatctgcgcttctgcatttttttggtttttattttgagacggagtcttgctctgttgcataggctggagtgcagtggtgcgatctcagctcactgcaacctctgtcccctgggttcaagcgattctcatgcctcagcctcctgagtagctggaattacaggcgtgcaccaccacgcccagctaatttgtagagacagggttttgccatgttagccaggctggtctcaagttcccagcctcaaaagatccaccagcgttggcctcccaaagtgctgagattacaggagtgagccactgcacccagacagattctgtatttctaagaatttctcagtttgatattgatactggcactcagtggttggtccacatttttagaagggccactttactgctatcacaaatacaggatgccattgtatatttacatattagagttgattttgaagttttatgtctttatttattagctttaatttttttaatgtttgctcatttgctccttttcatttttcccattttaggcacttgttgggctcatcaccgttgtgtggagtggtcactaggagtatgccagatggaagaaccattgttagtgaacgtggacaaagctgttgtctcagggagcacagaagtaagtagacaaagcaaatatttaaatcatagttttataacattcactttaatcagaagttcacttgaaaggattattaaatgattgctgtagtgtaaaagctctcaaaataggaaattattaatttttattaagagaaattctaggccaggtatggtggctcacacctgtaatcccagcactttgggaggccgaggtgggtggatcacttgatgtcaggagtttgagactagcctggccaacatggtaaaaccccttctctaccaaaaatacaaaaattagctgggcatggtggcagtcgcctgtaatcccagctacttgggacactgaggcaggagaatttgcttgaatctgggaggtggaggttgcccgtagccaagattgcgccattgcactccaacctgggtgacagagagagactccgtttaattaaaaaaaaaaaaaaaaaaaaaaaaaaagttattttatgcaaaaattagccgggcatgctggtgcacatgtgtagacccagcaacttggggtgctgaggtgggaagattgcttgagtccagtagattgaggttgcagtgagccatgattgcaccactgcactccatactccagcctgggcgttggagtgagaccctgcctcaaaaaaaaaaaaaaaaaaaaattaatttgtgtaagccattggaatgtagtatgttactcagtgaacttgaatcttttaaaataagtagtttacatttaaattagaaattaaaattttagaaatgaaaattttgcactatgcttatacattcatgtggtaactttttaagacaaaactatttgataatgatttaaaatgaaagaaaatatttgaaaagatttgaaggtcattagtccataatgtggactacctctgtttgatattttaaaaagtgattaaaaaaatttttttagttcggtcagcagttcagttcatctttattgcattgtatcaaagtaatatgtgcatagtctgccatttttcagagcttttcctgtgattttcatgtaattttgaaacaaatgcaaatgaaacggcttcctcccatctataaagacagcaaactctgtgaagtgatactgctttgctgtctacaaattgcttttctttttcttttttcttaaaatgtagagatggggtctcaccatgttgcccaggctggtctcaaactcctggacccaagggatcctctcttctcttcttggcctctcaaagtgctgggagtttagttgtgagctactgtgcctggccttcctttttttttttttttttttttttttttgagaggagttttgctgtgttgtgcaggctggagtgtggtggcatgatctcagctcactgcaacctctgcttcctgggttcaagtgattctgccgcctcagcctcctgagtagattggattataggctcgtgccaccacaccggctaatttttgtatatttagtagagatgtggtttcactacgttggccagcctgatcttgaactcctgacctcaggtgatctgcctgccttggcctcctgacgtgctgggattacaggtgtaagccactgtgcctggcccctttggtttttaacaagtatatttgggagaagtgagacagcccttccaatggaatattaaaactggaaattttgaccttagaaactatatgggctttaatagatagaacataggcaaagctttcaaaagtatagttgagacaaggacttagattcaagtaaaaattcaatcattagaacattagctttacttggattatcaaaatgaactgatttacatagatgagtaagcatcacctcaagagtagtgaagtcagagtgcttgttttggaaattttacattaaagtgtatatgtcatcaaattttgaacagtttaatgcataatagtattttccccagcctgaacattcttagagactggattaagacaatgatatttcagtgaaaaccatctgttttatgaattacttcataaaagtaatttttattttgggctattttgtgacagtgaaaagtattacagggaaggtaacaaaggctaaatgagctttttggtggtggattagaaccagaggaatcaatataaactcgtagtgtttgatacttagtacagaaatgtaggtgtatgtatttgcatgagtttgtatgtgtccatgtatttcctacctctgtttgctaggaaggtagttaaaagaaaacttgcctcactctgtcccttttggacagaagttaccatttttgttcttactgattaataattaaatggtatttagagatgaagactgtgtcctaccactggcagaggaatcacaagcccttaggagacattgcatcccttccgactttgtttaggcattagaatttggtgggcctaagcaagttaaatgcagattgagtacttggagttggtagaccatgtggggattagaagggatctagtggtaactctgtcaaatctttacctctccactagattgaatcactcaaaactcacaggagtgtcagttttgtgtcgccatttgtacggttgtttgttttgtccttcttccttctcccctcccttcctccctccttccctccctctctccctctctccttccctccctccctccctccctctttccttcctcttctgtccttcgtcttccttccttccttccttccttccttcctttctttcttccttccttccttcctaccgtccttccttccttccttccttccttccttccttccttccttccttccttccttcctccctcttctttccttccttcctcttctttcctcccttatttccagggtctcaccctgttgtccaggctggagagcagtggcatgatcacggctcattggcacccttggcttcccaggctcaaacagttctcccccgagcctcccgaatatccgggaccacaggcatgcgccacctcgcctaactagtttttaaattttttgtagaggctaggttctgctgtgttgtccaggctagtctctatctcctgagcttaagcgatactcccacctcatcctcccgaagtactgggattataggcatgtgccaccacgcctggcttttgttcattattcttcattatcaaataggcacaagatggaccagttagctagaactttgtctcaagaaaggaagacttgtctcactggcaaaaattcaaacataaaacaacacatttgttgacagggctgtggggaaacaggtactctcattctttgctgctgcagatgcaaattggtacacatcttttggagggaaatttggtgatacctaacaaactgtatgcatttacctctcaattattctaggaatctatgctgaatatgcctctaacaatacaaattatgtattacttaatgttattaattatagtattatttaatttgcgaaatattggaaacaaactaaatgcccacacagaggagaaggtttgaataaactgtgttacatccatatagccatataatggagtaccatgcagataaatcagaaactagagattggttacctgtagggagtgggagggagaagaagggagtggagatctgtgtagcatggatgaaatgtgagtggcacttctcagagtatatttgtcagtataactctgattcttagaaccataggaatgttttaaatgcttctatgcaattgccaccaaccaggatgtgggagaccaaataagcaattaccacctacccagatgcaggagaacccaaaaaggaatagtaaaattcacataaaagaggatagggagggaaagaactcacctaagtaactgtagaaaatagtgtcttgattaaataacataaaactagaggcaaaaagaactgtacagtcatgctgtagtgttgagatcagaagtatgaaaataaactcatgttttttaatatttacacagacatacagaaatatagatgtgtgcatatgtatgagttaatttgaatatgtgtatttcctacctctatcccctgagagggcatagaaacaatgacaccccagtagcattgagaatacctagtgcttagatcttggtctccaaccattgctcttcaatgaaaggaaccagggctccttgagaagtagttccttacgggactggtgcagagaaaatacaaggtaagcctagatcatcttgtggtgccagaaagtaatgaagtgcttaaaaagatgaaaacctgttcaaagcacgggaacctacctgaaggagctcctaagaactggaccaattttagcaaccacaaaaataatgataatattgcattttcatccatagaataagtacacgagtccatactgatgtaaatagattgtccagtcatgtcactgctctacttaacactcttcagtgacttcccattttattctgagaaaaaaaaaaaaaagattccttgctaacctgtaaggctctacatgatcttcaccacacctcacgtatacttctcagacatctttcactataaccgtttgttcatttacttccttcagccatgctgacctcattggtcttactcaagtacgcagacgcagatccacctcagggcctttcataatgcatgtgttgccccctcatatcctttatgtatttattcaagcgtgactttacagtgaggcctttgctaggcttgctgtcaaagatttcaaatgccttcccataatatctgcttttttgttttctttttcgtacttatcacctctgacagagtgtatattcacgtaataatcttacttattgttcatctccctctcactagtatactagtgccattcggatggggtttttttctgttttggttattcctcagtgaatatttgtagactaattaatagcactgaagatcattcatggaatcattcataggcagcaaataagttctaagtacccaaaagtgttactggaggttatcaatatggctaattacatgaaagtttatatacttaatctctaaatagagcaaatctttacagttctacagaaatgattgggaaggaggagccaaggaaaatttctgctatcacaaaagtttccctaggggcgatatagctattgaacttagaagacgtttttattttgccaaaaggtcgattttgctgaccttggctaggtgcagtgcctcccacctgtaattctagcatgttgggaggccaagatgggaggatttcttgagcccaggagtttgagaccagcctgagcaacatagtgagatctcgtctctattaaaataaaaaatgaaaaatgaaatttgctgacctttattatgtagctgagtatattctgatacctagctctattttcaaagaaaacaaacacttaacctgccccttcaagataaagatgacatttcaacattgagaatgcagtgacttttcaaagaaacatgtcctggggcgttgaacattttgaaaacagatgttttgaactatttatattgatattttattgtcagaaataatgaaggttgtaaaaacaaaacaaaaaactctcatgtttgtcaccttaaaagaaacttgaacatggaattttctgatatgtttaaaatattctaaagagctctggtttaagcccatttattaaacattcaatatttttattagagagggtgaaattttatttgcttaaattttgataatttcggttgagatttaaaaatggttgcagaaatcatgtactacttctaattagatcattttacttttggggagaacctgtttttttaaacctatgagagccatagaaactaggtattaaaataaaccaaagttagaattaggctttttaatctaagaaaatggaagggaatgagatactataaagctcaggtgaggggttgcagtattttgtaaattttttgattgtgcacatcttttaataagaaatgtttgagtatgcagctttattatacattctcagtggaatatgtatgtcttctctctctttttttttgtttttggagacatagtctctctctgtctcctaggctgagattgcagtggcgcaatctcagtttactgcaccttctgcttcctgggcccaagtcatcctcccacctcagtctcccaggtagctgagatcataggcgtggaccaccacgcctggctaatttttgtatttttagtagagacagggtttcgccatgttggccaggctggtcttgaactcctggcctcaggtgatccgcctgccttggcctccccaagtgctaagattacaggcatgagccaccatgcacagccatgcatatctcctttatgtaacttaacatctgcagcgtttgtttgtgtgagttttttattctgtctgcatttgtgtatgtgagtctttttctatggatttttcccaccatggctgtaagcaccatgagagtgaggaaaatagctgttttgctttatcatattttctctggtgcctaacaaagtatctggaacacaagagagtcactaatgggataaatacatgcattaatgggatttgtcaatgaagggcaaaatttagtgcattagcttgaatgaggaggtaggtcctactggctggcctcttgggtagaggccaggactgccgctaaacattctgcaatatgcaggacagcctcccacaccaaaactatacagcttaaaatgccgatagtgctgaggttgagaaatcctggtttgacatattattcctgtgttaaaattaatatatttaaagtaatttcctcggttgttaacatggcatttttgtcaagcaattttgttttctctgaaacatacctcagattgtttttagtttttccaggggaaactttattcattttttactagagaaaagaacatggcaaacagtgaatctgtgtttcaggaagggtaacgtcgtttttcttttaatttcccttttgaagctctcagggtgctaccaacatcttggaaatctggataatttgagtattactgagggaatattttcattctacatgctacaaatgtttaatcattttatttatctaaagttcctttcttggccaggcgcggcgtctcatgcctgtaatcccagcactttgggaggctgaggcgggtggatcacctgaggtcaggagttcgagaccagcctaaccaacatggcaaaaccctgtctctactaaaaaaatataaaaattaaccgtgtgtggtggtgtgtgcctgtaatctcagctacttgggaggctgaggcaggagaatttcttgaacccaggaggtggaggttgtagtgagctgagttttcgccactgcactccatcctgggcaacagagcaggacttcttctcaaaatgaatgaatgaatgaaagaaggaaagggaaaggaagctcctttctcttctattcccagtattgccccccaaaaagaagtaatccataaacccccaatgtatatttctgttttcttaactatttctgaataaaatgttcagtgttggctgggcatggtggctcacgcctgtaatcctagcactttgggaggctgaggctgaggtcaggagtttgaaaccagcctggccaatgtgatgaaaccccctctctactaaaaatacaaaaattagcttggcatggtgacgtgtgcctgtaatcccagctactcgagaggctgaggcaggagaatcacttgaatcctggaggcagagattgcagtgagccaagatcgttctattgcactcctgcctaaaactccatctcaaaaaaaaccaggtgttttactcttaaaataagacattaaaaaaatacttctgttgtctcccctcatagaattggtaatctcttccttctccaccctcatcccctgctgtaattctatattgaaatttcattgtattttgtgccagatgtctttgtgtaaaaccaacttagttctgtgagaagagttgtacgtttttaatatttttgttctttttgtagactgcagaaacaaaaatagccttcctatagtaaggtggcaattcacattaagaatgtagataggcaaatttaaacttctaaatgtaatttgtctaaaaaagttgaaaaacagtgtatagtaaaagtctctcctccaaccaatggaaagtacttttatgtaagatcctttaagttactgacttgaatctttacgtaaggtaatttgctagtatctattttataaataatgttatttaatactgttttattttctatagaatcctagtgtttttccatgtaaatttttagaaattcttaaagtatgtatccctcattttcccctatagttgtttgcttctacttctgtttttaagagatagcatctcagttgtttaagctggaatgcagtggcacgatcatggcttactgcaaccttgacttcttaggctcaagcagtcctcccgtctcagcctttagagtagctgggatcacaaatgcatgccaccacacctggctaacttttcttttcttttcttttttatttttttgagatggagtctcacactgtcagcgggctggaatgcagtggcatgatctcggctcactgcaacctctgcctcccgggttcaagtgattctcctgcctcagccttccaagtagctgggattacaggtgcccaccaccatgcccagcgaatattttgtattttttttttagtagagatggagtttcaccgtgtgggccaggctggtctcgaactcctgaccttgtgatttgcccacttcggcctcccaaagtgttgggactacaggtgtgatccatcacacccggccaacttttctttttttttttttttttaggagacagggtcttgctctgttttccaggttggtctcaattcctgggcccaagcagttctcccacctgggcctgccaaggtgctagtattataggcgtgagccactgcgcccagccctttatagtttttttcttttttttgagatgaagtttccctctgtcaccaggctggagtgcagtggcgcgatctcggcttactgcaacctctgcctccctggttcaagcgactctcctgcctcagcctcccgagtagctgggactacagatgtgtgccagcatgcccagctactttttgtagttttagtagagacggggtttcgccatgttggctaggatggtctcaatctcttgacctcgtgatccacccgcctcagcctcccaaagtgctggcattacaagcgtgagccactgtgcccggccagctctttatagtttaagaggaaggataaaccttaagagatcacaaccatatatttgtgtcaggggtccacaagactgcctccatgtttggagatttgctagaaggactcatgggatcagcttagggttgtaatggctaagatttattactgtaacatagtatggatatatagtagaaagacctcaatggcaaaagacactgacagagtctggaaaaatccatgtaccagcttccttatgtgctgtgccttccatgaggatcacacagactaccttctttcccccttaacgaaaatacaacaacatatgtgactgcccaagaaacacagtttttatctaggctggtcatgtaggtgtactctctgcctagcatgtgtgaaatttccagactcataaaaagaatagcaggataagccacattatttccatagtctagatatagtaaaccatgattaccagttagggaaccctcttgaaattcaagttctcagaagccagcctaggaccaactgtgcaaacagacagaccctccttcacaggataatgtaatagtctcagatctgctttgttaatttttgtttgcatagagttttataattggaaggtgtctcaaatgctacatatttctgtctaatggactatagtaagagtgttgtatagtatataacattgaattattctccattatagacaggctgtgataagtgttctaatgtttatacaaaagaactttgtaactttgagcagagtaaagagactgttaatgatacttttgactgcaagtagtagaaaaatgttgtgtttaactctgaaatatgctttgcctcatattagtatttctactctagctttctcttgactagcgtaagcatggtgtatattattccattcttttattttaacctgtttgcatctttgtatttaacttgtgtttcttgaaggcgatagttttatttctctgataaaaacatataagaagacaatcacattaaatgtatatggtctaaaacctctgctttttaattgggggtatttagaccatgtacatttaatgtgattgtcttcttatatgttttctatttatctctatctgttccttgcatcatttttcttgcatcccccacctgccaagatggggtcttactctgtcacccaagctagagtgcagtggtgtgatcataccttactgcagccttgacctgctaggctcaagtgatctacctcagcctcccaatagtggagaccacagttgtgcaccaccacacctggctactttgttttatttttttatatatggggtctcactatgttgtccaggctggtctcatactcctgagctcaagtgagtctcctgccttggccacccagagtgctgggattacaggtgtgagccattgcacctggtcttcttggattcttttactttatttatttatttatttatttatttatttattttttgagatagagtctcgctctgttgccaggctggagtgcagtggcgctatctcggctcactgtagtctccgcctcctgggttcaagcgattctcctgcctcagtctcctgagtagctgggattacagacgtgcaccaccacacccagctaatttttgtatttttagtagagacggggtttcaccatgttggccaggatggtctcgatctcctgaccttgtgatccgcttaccttggcctcccaaagtgctgggattacaggcgtgagccaccgtgcccagcctacattatttattatgattccagtttgcctctttttattacttttacctgtttttaaaaattatttttgtagttgctttaagattatagtgtacatttagagaggtctaccttcaagtaatattgtacacttcatctataataaaagcattccttcatttgctttcttttcctccctcgtgcactttgtgctattgctgccatgcatttgacttttatatatgttataaactctgtaatattttgctgtcttttattaaacatatatctcttagagatttaaataataaaaaatttaaaagatgtttgctcatatagttaccactgtggtgctctttattccttcgtattgatccagattttcatctgacatcattttgtttctggagaatatcctttaacatttcttgcagtgaaagtctcctggtgatgaattatttcattatttatgtttctggtgtgcctttatttcaccttcatttttgaaagatatttttgccaggcatggaattctagttggccttttttcttctagaactttagagatgtactgctgtcttctcacttgcattgtttctcaaaagaaatctgatgttgttcttatctttgttcttctataggtaacatgtctttttatacagctgctattaataatatatccctgattttgaacaatttgattatgttatcccttaatgtaattttcttcatgtttcttgtgcttggggtttgctgagtttcttggatccgtgagttaataggtctttttatggctagaacattttcagcagttgtttcttcaagtattttttttctcttcctcttttttctcctttggggactccagttacctgcatattattaggctatttgaagttgcctgactgctcactgatgctttttaaaaatcactttttaagattttttttttctttttgtactttagctagtgtctgttcttgtatcttcaagtttgctaatcttttcttctgcagtttctaatctgctttagttcatccaatgtaattttcatctcaaatgtttttgtctttgaaagtttgattttggcttttcttgtttatctcccatgtctctatttaactttttgattatatgggatacatgtataaaaacagttgaatgtcctcctctgctaattttaacatctatttaagttctgggtcagttttgattgattattttcagtttgcatcatgattgtctgctgctttttatgcctggtaatctttatttagttgtaaaatttaccttgggttctggctattttctttattctataaatcttcttgagctttgttttgagatgtagttgagttacttataaaccgtttcattcttttgggttttgtttttatgatttattagacagatatgaaggagtgcttagtccaggactaattattcctcaccactgaggcaagactttctgtggactctgttgaatgttccatgaattaatagttttcccagtttggctagtgggaacagatactattcctggctttgtatgagtatcaggccctgttccctcccattgtttctgatggttctttttctggattctcatagtttcctcatatgcatatgctgatcagttatctggtgaatgcttgagagaagatctctatagacctctggggttcttttctatgcaactgtctcctctcagcattctgtgcagttattccttgctgcttttttctctcctggctcttaactttctctttccaactcaggagtcagctgagatttgcctcagttgccactctctatgccatggcctggaaactcttatcgttgtgtgctggggcatatgtagggctcacctcttttgtttctcatttctcaaagctctacagtcctttgttgcctgatgttcacatagcatatatatgttcacatatattcacgtctttctttctttctctctctctctctctctctctctctctctctctctctgtctttctttctttctttctttctttctttctttctttctttctttctttctttctttttctttctttctttctttttagtggtgatgggatttcaccatgtttgtcaggctggtctcaaactcctgacctcaagtgacgcacctgtcttagcctctgaaagtgctgggattacaggtgtgagccaccatgccctgccatgtcttcattttttatggttgtttcaggaggagcgtaaatccgataatccggtctctgtgactccatcttggtcagaattagaagtattatgcaagtaactaagaagtttattatttcacaatagaaaattaggagttagggtgatgggtagttcagtagcttcatgataacaagttgtcagggtcttaacatcttttcttggtgcatccagaacatattggtctctttcttgatccagttcctctcatgagcaaaagatagtgggcaggacctctaagcattgtactctcaggatagcattcagaggcagaaaggaaaaaggaacctttttattattatgttaattaaggaaaaatccttgccagatgcttgtcccatcctagcatatttctctctctctctctctctcttttttttttttttgagatggagtttcgcctttcgcccaggctggattgaagtggcgcgatctcggctcactgcaacctctgtctcccaggttcaagtgattctcttgcctcagcctctggagtagctgggattataggcacccaccaccacgcccggttaatttttgtatttttagtagggatgggatggggtttcgccatgttgcccaggctagtcttgaactcctgacctcaggtgacccgcccgcctcagcctcccaaagtgctaggattataagcgtgagccaccacgccctgcccctggcatattcctcttaacattttattagctagaattaccttgagtgttcatatctttttttttttttttttttttttgagacggagtctcgttctgttgcccaagctggagtgcagtggcgtgatctcggctcactgccagctctgtctcctgggttcacgccattctcctgcctcagcctcccgagtagctgggactataggcacccgccaccatgcccggctaattttttttgtatttttagtagagacggggtttcaccgtgttagctaggatggtctcgatctcctgacctcgtgatctgcccgcctcggcctcccaaagtgctgggattacaggcgtgagccactgcgcccagccgagcgttcatatcttaaaccaataactgataaagaagttgagacagccatgatggctttcctctgaggctggggagagtatttagcccctctgaagcatgtttctgcttagagcagggtgcgtatctgaaaaagtggaaatctgtaggaaggaaaaagggggaatggatattttataggcaataaacagtgtctattattggaaatatgttttaactgagggaatctgaaaatatttttaaagaaggaaagatttaaggtggtgcttggaggatgggtaagtttcagtagattaacatagggattctagacagagggtcaccctttacagggtttgaaactatgagggtatatggattttggaaaaatggcacatacgtaagaatgactggagaataagtagggtagagaatactaggggacaggaatggaaaatttccttggctttgcataccaagatgaggaatttcagtaatgtaccttttaaataagaagagcagtattaaatgatctaaattcccccagccctttgtaattgaattggaaaaggtttacttgaagacaaacatatttaggattactgctataaattaaaggccaatgagtgtaaaatcttgagtttaggtattatgtgtaaaacataaagatgaaatattgtaatagaatgcatagtatttgattctttataaattagatggaggaactgcagatgtcttttttttcaagtctaagtatgttggaagatcacaagttttgtttggttgtgctgagcctgaaaccgtgtgaaatggctttgacactaaatgtcagggtaggaatcatagacagttttcctaactagcagtggtggcaaatcaaactgactttggagaacaagaagagaaaagaagatggaagattgatcctttggtcaatgctctgaggaagaaccagtgaaaaggtggatgttaacacagaataagttacaggaagtatagtagaaattatagtagtttggattaatagatttaaggaggtatggtcaataatctcaaatgcctctcaagtgtgtttttgtattataagattttctaaataaaagtttctaaataaaacctaataatatttattttttaagagatagagtcttctattttgggagtggcgggtccggcagagagggatcttgctgtgttgctcatgctggagtgcagtggctattcacacatgtaatgatagtatactgcaactatgaactctagcaatgtttccagctcagcctcccacatagctgggactacaggtacatgtcaccatacctggtcataattattatttttaatgggaagcaatcgggagtcttcacttcttaatctgtctctgacattgttagctaatgtcaagtgacttcttccccaggtcatgttacctgtcagtactcaatcatcatgtacacagtaagaaattgttttatcttttcactctgaaatgcagggatagaaggaaggcatcaaaaaattaacaatggattatttcatcacaatgttaagtgcaaggtgtcggtacagcaagataatcctagatatttatttgaccttggaatgccgttaggcatatatctacttaaaaattgatgtggctgggcatagtggctcacacctgtaatcccagcactttgggaggctgaggcaggcacataacttgagctacaagttcgagaccagcctgggcaatgtgacaagaccctgtcttttcactaaaagtaccaaaaaaaaaaaaaaaaaggcaggtgtggtggtgcacacctgtagtctcagctactcaagaggttgaggtgggagggatggcttgagcccaggatgcagaggttgcagtcagctgagattgcaccactgcactccagcctgggcaacagagccagactttgtctcaaaaatgaatgaatgagggaatgaatgaatatgtttatttcccgtcaccttgacaccttgactctggagctaagaggaagctgaaaaatttgttttagaaaattaagagttttgtatgcctatttaaaaacagttaaattttggtaggcccattcaatgaagatgtctcaatttaattttaatctttctttttagtattaaataagtttaaagaaatgaacttacctttgtgatgaggtgggtggtattctttggtattgtaaaggaccccttgaatgtaaagtttaggggaggggtggagaataatatgaacttacatctgcataaaatatcttgtgaaggatgcataggaaactggtaaaattctttgcctgtaggaaacttattttatatagttgtatacaaagtgattttatactgcataccctttaggaacttttgaaccatggtaatgtttttatttcaaaaattaaaaaccttttaacagtttctaacttgttttgaaaatatacttcaaaaacttatttctctagttgtgcactattgtgtgttttatctatttgaaattgatttgtgtatcatgtgatataaggggtccagtatcattttttcacacatggacagccaattgttactacaccatttattgaaacatctttttcctccacatttgaaatataacctattatatagcaaacgttcaatgtattttagattgttggtaggttctctgttttattctttgtgtatttgagaatcccagtgatatatcatgatgtcattgttactgtagctttatactaagtctttctattcggtagtataagtgttatttccacctcttcctatggcagagatacttggtttagactagcctttccactgagaacaattagaaaagctgtataaaatgttgtttcaaataaatatttaagggatcagaaaactagaagagtggtgaggacctgagggagtgagaattcagagggtaaggttgtgcagagtttggcctgaccttaaattttcttttccccttgagttaattactcagttcaaaaaaatccagctgagaggttgaaaagctgagaagcttctggcagtctgcagagctgggaagacaaaaagggaatttaggggtcattaaatgctatagaagtttatttaggaccctgaaggctacagaggggtggatggaggtgtcagcaaatgacagcctgtggggtcacattcggtcctccagctgtgtttatgtgggacatgagctaaaaatgttttttaccttttaaaatgtctgaaaaaaatttaaaagggaataatattttatgacacaggaaatcataacgacattcaggtatgagtgtttaaaactaatgttttatgggaacaaaaccacacccatttatttgggcattatatatgacttctgttgcactacagtgtcagagttggttgctgcagagagcacatatatttcaaattgctgctctgcatgctacgaatcacaatgacatagttacagtttgtcagtatgtgtgtgtgtgtgtgcgcgccacacatattgccctggcatcttatttatttctctcattaccagtgcatacccacctatcatgttaaaacaagaaaaggagaaaagtggactttatatgtaacactttagaggtatagtggaatgtatattattattaacaaattagatagcaaagcattatatttattatgctagaagactatggctgtgctaaaagaatataatatatgtcagcattaccagacttggcacttctcacaatattcccagccaacaggaataaaactaaaaggtcagaaaaaaaaatagtaaattaaaacaaaattttatcacagcagaatttcttctcaaaaacaaaaaatggaaattaggctataattaaagtaagtttttcaatggcttatttgttagccaagcaaggaaaaccattaccaacagtagttaattaaattatgttttattaaggtaaacaaagatgtgtccatagaaaataaactttaaaaaagactattagcctttcagcgagagtaattgctctaaaagttaaggacgttgggagtaatatcaagtcattttggaaagaagggtgaatgatttttcatggttttcttaggcttttgatggatgaataggtgttaccagtactgttcagttgttacatactccagaagttagtgctgagtttgaagtgatggaagaattagtgtttatgcatagtctatgtgaaacaactacaagagaaaatattttcagaaaagttgagcaaacactaacttagtacaacctgaagtggaatccgctaagatgcgttacagttgatagtggcaaaaataactgtggagcagaaagacttgagttggacaaatttacaaagcttgttaaatgtcaggtgtttaaagcctgattatttactgtattatttattagcaggtactttgcagaaaatatttaaatctgtcatgttttagtgaactattatataatagtgtcagcagtgattttgacttgcatttgtggacttcatcatcaaatcctatgaatttttgttagatatagaggcagaatatactgaattgccattctacatagcaatttagtgacttggcagtggtaaagttttattgcagttttttgcgctgcggaatgagattgaaatttttctgaataataatgccctcaactattaagtcaaatacttaatagctttgaaagttggcttttcctgtagatttcataatattttgtaacaaattcacctaaaattacaaggcagaacagtgattataagtgaaccttatactgtggtaaggtcacttctacaagaataatgaatcatgaaaatcaagagaaagaacaaatagtaggaaaatgtcttccaattccttttagcccttcatatttctacctgaactcataagcttttaaaaagataattatttttatttatatttaaaaagataatataggataatatttttgtaaaagagttcttgagatacagcactgaatgtaaaggaaaatattggagcattcaactacatttgagaaataacttctgtttattaaaagatactataagaatgaaagcacaagccctaatgaatattcttgtttgatactaaaccaaagcttgagaagtggtagtttcgcaagtttttcaagtggtttggtgcaatctgaagactgcaatcccatcaatgaactttatatctttaccctttaaaattataatttatgggccgggcgcagtggtttacgcctgtaatcccagcacttcgggaggctgaagcgggtggatcacgaggtcaggagctcaagaccagcatggccaagattgtgaaaccccgtctctactaaaaatacaaaaatcagccgggcatggtagcaggcacctgcagtcccatctacgggggaggccgagacagagaatcgcttaaacccaggtggtggaggttgcagtgagccgagattgtgccactgcactccagcgtgggtgacagagtgagactccatctcagacaaaaaaaaaaaaaaaaaaaaaaaaaaaaaatatatatatatatatatatatatatatatatatatacacatacacacacacacacacacacacacacacacacatatatatataaaatttattagactaccttgcaatttcaggggatcttttacccatatatgattttataagattactaagtggtctttggaaaatattggttcactgagtgatccagatattccaactattgatacggttgtttttgtttgtttgtttgtttgttttgttttgtttgttttgagacagaatctcactctgttgcccaggctggaatgcagtggtgcgatctcagctcacttctgtctcctgggttcaagtgatgctcatgcctcagcctcctgagtagctgggactataggcatgcaccgccaggcccagctaattttcatatttttagtagagatggggtttcactatgttggctaggctggtcttgaactcctggcctccagtgatcccaaagtgctgggattacaagtgtgagccaccttgcctagtcctacacatttttaataaataacaaaattcacatttgttataatccactgatctcatcagaaaagtctttaagtattggaattagttaagcttacattgttggatataagtttttcaaatcttcttattgtccactcatgttctaagttgttttccttgaagtgacaggctcactttattccttttttcaagaaatatgttagataatcaagttttaataattgtggtttgttatttgttcttacatgtaaaaccggtgttccatgaaaaaagcatttatttcagtttataaatcacatgatcacaaattctttcctcaagaaaaactatggtgtaacaattattttactctttatttctcgttttgtcacatagataattaaaagatgtgtattcatggatcaagacttaaaacattaatgatttttgctgcttcatcagtgatattctcaatgatactctacattatttttactgtagttgtagtgccaattgagaatgtgacaacttctaatacagcttggtgccaactgctttcagttttggaaatgcatcaacagttttacccaccatagcttttgcatcgtgtaacaatttttgcttcaattgttaaacattattttgaaaactcaaggaacagtaaagtctgttttattgcccatatttttactatttgtttgttctttcttccttcaggatgttctgagaatccttctttttatcattctcctttctggttcaataacttttctcactattcttttggtgtagttttgtctcatgactaatttttagttctcattcatctcacaatttcttgatttccctttcattactaatggatgtttttgctggatatagaattctttgttgtcagttcttttaggacttgcaaaaatgttatgctgctttgttctggcctccatggtttcaggtgagaaatctgctgtcatttgagttgtttttcatctgtggataaggtgtcatttctcttatttatctcagggttttttagtttagtcattagttttcagaagtttatgatatatattagcattgatttatttgtgtgtatcctcttaggatttattcaatttcttgaatctgtgggtcttcgaataattgttcagctgcgtcatgttccttttctgagattccagtgacaggaatgttgcatcacttattatagtcccacaagtgtctttaatgtcttttttaaaaaaaaaatatttatttatttatttatttattgtcagagttttgctcttttgcccaggctggagtgaagtggtacgatctcagctcactgcaaactccgcccctgggtctaagtgattctcctgcctcagcctcctgagtcgctggaattataggtgtgtgccaccatgcccagctaatttttgtatttttagtagagacagggttttgccatgttggccaggctggtcttgaactcctcacctcaggtgatccacccatctcggcctcccaaaatgctaggattacaggcctgagcgaccgcacctggccacttttttttttttttttttttaaatcagttcattttcttctcttgtttaggttgggtaatctctcccattttgttgttcagcttagtttgtattttatttttgttagcatattttttagttttcaacttggtatttgtttctttcttgatttctttgcaaaactttgtattgtttcctttgtttcaaaagtatgtttgtaattgctttttttttttttttttttttttgaggcagactcttgctctgttgcccaggttggaatgcagtaaatgatctcagctcactgcaacctctgcttcctgggtttaagtgattctcatgcctcagcctcctgagtagctggaatcacaggcgtgcaccaccatgcctggctaatttttgtatttttagtagagatggggtttcatgatgttggccaggctggtctcgaactcctgacctcaagtgatccaaccacctctgcctcccaaagtgctgggattgcaggcgtgagccactgtgtccggctgtaattgcttgttgaagcagtgttatatagtttaaaatctttgatagataattatgacatctatgaattctcattgtttgcaccttttgactatattttcaaattcctgttcagattttcctggttcttagtatggtataacatgttatatttggttgaatcctttgcattttaagtgttgtgttatgaagctctgcattttatttaaatacccccttttagtaggatttatctgaaactttgcttttggggtggaggtggggcacagccttgttactactcccaggtgtatgtgaagattccagttccttagtaggcctttgttgactcattgatggagacgtacacctagtaaatgctgagtaggagtgaaaactctggacttgcattacacctttgtgaataccaccctggctcaaaaggttcctgcttttcacttggcctccactgaatgggatggaggggtggttaagttatcactgggcagtgctttgagtttggattctccaataggcctctcctgtcatatctctgtagagggagggatagggatatgtccttatcactgggtgggtgttgaactcaggctccccactttttttccacccacactctagagggaggaagccgcgttactgctcagtgggtatgaatgtcctgtgtcccagttggcctgctgtggtatcatgttgtccgtgggcaggagtggggaatggctgactatgtcctccttttaagtctttgcaaaaggtatatggcttgggcttttatttgtaccatttggcttaaactggtttgttgttgtctatgagttttttgtcttggtagcctgccgcttccctgcttttttgacaaaagacagcagaattttcttggagttttacgtatgtgtgtgcctgttggtgtttctgagttgtctgcttctctagcaacttttcttgtatatatgagtcagaaaggaaacctagggaattcatcctcttttgtttcttggctcctgaagccctaattggtctgccctctctctacattttgttgtcttcttttgtttgtcttatgtatcacggctaagggtttttaaagctgtatttagtggaaagaacagggaaaagtacattttctgcattttgtctggaagtggaagtctgcattcatttttgctgtttttccctgaatacagagttctgggatgattatgtttttcttcttcaagcatttaaaagatgttgcattgtttcctgtcttccatggtttctaatgagaagtcaggtgtggtgtcagtagtatcattattcccatgtatataataatgttttgatattctctggctgctttcaggattttctctttatctttggttttcagcagtctgactatgatgtgcctaggtgtggttttctttgtattcatcctgcttgggggttgctgagcttcttgaaactgtaagttgatatttttcaccaaatttgtgaaaagcttgacttttatttcttattctttttctgtctcatttctctctcctcttcctctgtaactctaattacatgaatgttagtatatttgatattttgtagattactgagggtctgttcgttttcttcccagtgtttttacttttagttcctcagaatagatacactattcatgtattttcaaggagatggaccaattttctaccaatctcttgttaagcccatccactaaaattttcattgaaattaccatacttattagttgtagaattttcttttcttttcttttgagacagggtctttgtctcccaggctggagtgcaatggcgcgatctcggcttacagccacctccacctcccaggttcaagcgattcttgtgcctcagcctctcaagtagctgggattataggtgcccaccaccacacccagctaatttttgtatttttagtagagatggggtttcgccatgttggctaggctgctctcaaaatcctggccttaggtggtccaccttccttggccttccagagtgctgggattacaggcaggagccatcgcgcccagactgaaactctatttaaatatagattttagccaatgatattctgctttttttccaagggtataatgtcctcccattccagccagtttttggttatttacaggtaacttcaattagttagcttttacgttttcttcagatttgagacattttaggaaagttactctgatattagtccctatgctgttacccaataaataaataaatttatgtgtgagagccattgttttgttaaggtatattttgcatacgctataattcaccctttctaaggtgtgtattgaatgtgatttggtaaatatgaacagtcatgtaattaccatcatagtcaagatacagaatagaccctttacccataaattcactcatgaccttttgaagttactgcctacctcccactccagctcctgccaatcaccgatctgttgctttcctatagttttgccttttctagactaatatatgaatggaaccatacagtatagaatcttttctgtctgcctttttttacttagcataatggttttgagattggtccattcactagcttacagttaagtttcgttcaatttttggccagtatataaagctgctgtgagcatttatgtaacatgcttcgttgtggatgtatcttttcatgtttcttgggtaaatacctaggactggaatttctgacttgttggaaatatattcttaactttggaaaacagtttcacagtttcttaagtgtctgtatacttctccgtttctagagatctgagagttccatttgctgtacattgttgccagcactggatattgccactgtttctaaattttagccatctggttggcatttagtgataatttattgtgggtttgattttgcattccctgatgattaattagattgagcctctttttatgtctttttttgccatttgtgtatctttggtgacatgtctgttattttgtctctaccatttttttccaattgatttacttgtcatcttcttgagttgtaagagtttttttatatattattcacagaagtcagttttggagatgcattttataaatatttttgcctaatgtgtgacttgttttcatttatttagcaatgtttattgaacagcagagggtttaattttgatgacattggtcatttgttaattttttggaagttgaaaaaattatgctgtttatgctttattaaaaaatctttgcttgccccagtgttagttgtaggtttaaaaaatccatttatggttaaattacacatatgataaaagaatttgagataagattcatgtttctttgttttccatacggattatttagcagttccagcatcattctaaaagactatttattgctctcttggattatcttggccccttggtcaaaaattaattgaatatggaaaagtgagtctatttctgtattttctgtttttctgacttatttgtctctccttttaccaaaaccaaacataaagattttttttcaaaatcatgagttgatatttatgttttcagtttaattcaatagcacaattacatatctttaaaacagttttatacctgtagctaagctatagttgtatattttcttttaatatcatctttcctataactgaaaaagtcattaaaagaagaaaagattattgtttttgtttcaatttcaaagtaatcaaaactaagtgtactagtattaaatagttaaagctagtagatcaataaggaaatttaatgttattgcttttttctatctttttttgagtttactagtgatgtaaaagatttgagttatttgctgtgattatataaatactcttttgatgcataattcagcagttaacatcatgttaatttgtggcattagtaattttactgatagcccttctgtgattctgatttttggtagtggtttttacctggtaagtagcattttatcagttggcaggtactggaaatctgctttatcacttcttttttaagaaaagtggaaaacacaaacagtttgttcaccaaagttatgtttcaaggattccattcaaccagaatctggttcaccttattgactcaccttgggggtatatgtactagatttttacatacatctgtttggagaaactcgttttatctgtgtaatgtttgtaagaccagaagttcttttactgttcttgaaataaaacttttaagaagctgagtattcttctgttagtttcaaatttggactaaaattacacccaggttttggactaaagagaaagcaaataatctgttctcatgttcttaaaagacatgatttaagtgtatccaactaacttgattcttactgtgtctgtgtttactcctactaaaatgaaagcttttaaattttttcccactttttgaagtatttaactcttctgtaataggcagtgttttcttattaactttaaagttgtgttaagcaaacgtgtttaaattaatatttcaatttcaaaaaccctaatttgaaacaataaattttatcattgtatacattatgagcttttaagaataaccaaaaaaatgggggtggatgttttatgtggaagttatgtgtatcccttttctgcttttggctaaggacagatatcttagaattagctttatggcgcattcatctatctgattatttcagttaatatcatcttaatataatacaggttacttgagaagaaaacaaactcttaacccactattggagagataccaggtaggatactaaccttgatatagaatttcatgtgagaaagaaaaaggaaaatattttccattaaaagttgagtttttatctaaaattctcttaattttctagaaaaaacttaatttttctaaaaatatgttgaagaattatatataaaattcactttgctatatatatagcaagtgaataataggtacacatttctaggaataccccaaatattagaacgtatatactaaaatcacatcaggaaacaaataatagcgccccagaaattccattcagcctcctgttggttactattcctaactccccaaagacatgcactatcatctagtaacaacataggtgagtcttgcctatgtttgtactttgtgtaattggctttgtactttgtataattggctactaagtactgttttctgtcatctttcatgtatatatttgtgagataaatccaaattgttccttccagtcgtttatttttctcattgatgtatagtattctgttgttaagagtactataatttatttattttaccgttgggcattttgaggactttcaatttgaggtcattatgaattgtgttctatgaacattgcagtacatttcttttggttgacactgagagtattttatggattctaaccccaaagtggctactttcttttctttctttcttttttttttttttgagacaaggtccagctctgtcacccaggctggagtgcagtggcgcaatcttggctcactgcagcctccacctcttgggttcaagcgattctcctgcctcagtctctcgagtagctaggattacaggcgtgcaccaccacgcctggctaatttttgtattttttttttggtagaaatggggtttcaccatgttggccaggttggtctcgaactcctggtctcaagtgatccgcctgccttggcctcccaaagtgctgggattacatgcacgagccaccgtgcctgtccatatgttattttcttacaacctaaataaaaaccattacgtaaacaagacaaagtacttagtacatttccatagtcgatgaatttgtctttattacttgtatataactaattatgaactccttgagttcagttcctttcatttcctgactcattgggcttgaacaaggatatttaacctctctgcttcatttgtaaaatgaaaaatagtaatatctacctgaaatggtggtggttagatgggaataaagtaatttctttttttttttgtttttgtttttgagatggagtctcactctgttgcccaggctggagtgcagtggcgcgatcttggctcactgcaacctctacctcctgggttcaactgattctcctgcctcagccttccaagtagctgggattacaggcgcctgccaccaggcccagctaatttttgtatttttaatagaaacggggtctcaccatgttggccaggatggtctcaaactcctgacctcaggtgatccacctacctctgccttccaaagtgttgggattacatgcgtgagccactgtgcctggcgtagatgggaataaagtaattcttataaagtacttggcttagctgctggcaaataataatgcttactgattcttgcatattacccatagtttattggctaacttatgtcttccttaaattatgaaattctataaactatccttgtctattttaaaattatactcatttttataacttacatgctttatttgtatatatccaggatactagatatttgtaattcaaattggaggttattttttgtcacttgattttttttctgtaatgtgtgttctcaccacatagaagtttttacatttctatgtagtcagatttattcatgtttttatttatggttatgttaaagattatagctattagggacctatttcttcagggtttataatttatgtatgttgttacaaatagagagattactttttctttgacccaataggtagagggcacttttgtggactcagaaagcttgcctctcctatttttttaggaaaatatctgagattctgcctcctcatttccaagccagagtttaaaatatttacatttttacttcatagtgttaagacattgtgtaatgtaagtataatgtttaaaaaaaaatcttaaaaatgtaatagtgatttggcagagaccaaagcatggagggccttgaaatgctgctctgtttgttatctgttacaataaagcaattaccataaacttaatatcttaaaacagcatccatttacttaggtcagaactcagggtaggctcacctgtgctctctgtttaaggtctcacaagattcaaatcaaggtgttacctgggtggaagctctgggggtgaatcctcttctaggtgcattcaggtgtgggaggaattcagttctatgcagttgtagggctgagctcgccattttctttctttctttcttgatctgccgcccaggctggagtgcagtggtgcagtctcggctcactgcaacctctgcctcccgggttcaagtgattctcgtgcctcagcctcccaggtggccgggattacaggcgtgcgccaccacgccggctaattttttttttttatttttatttttagtagagacggggttttaccgtgttagccaggatggtcttgatctcatgacctcgtgatccgcctgccttggccttccaaagtgctgggattacaggcatgagccaccgcaccctgctgagctcaccattttcttactgcctattggcttgggtcactctcagttcctagaggccactctttggtttttcctcgtggctctttttatcttcaaagatagcaacagtgtattgaaatgttcccttgctatgaatttcccttttgctactagctggagaaaactccgctttcaaagaggttatttgattagattaggcaaatctcccttttgattaattcaaaggcagttgattggtggctttaatcacatctgcagaattcctttgccatataatatattaatggcattatccttgccatgatatttcatcatatttacagcctctgtattagggtaggaaatttggtggggtcggtggtatgcgggcattttagaatactgcctaccacacattctgtattgaggggtttgcgtgtgattcagaatatatttgtattccttcagaaagattactgtggcagcagggaggagaatgtggcagaaaggaaaggtactggcaggagaaaaatcccactcttagcagtctccattttgattttgtaatgtcgtttgatgttattttttttagcagatgtttcaatcagaaatgtgtgtttaatagtatgccaactagaatgattagcctggaccagaacaagagttatgagtcagtcaatgaactgttcattacttcaggtcaattcatatacagaataatttcatagattaggttttatttcagtcagctttatttcattttctaaagtgaacagttgtttaaacctcggatctcattaacagcattttaataaacacagtattagggtgggtttacttccctagattgtgaatctcatggattatatgttgattcttattggcttaatttttgaattgggcattatttattttaattctttagtcttatagttttgcatgtttgaagctatatgttttcctctgaagaccacatttgccacgtctcagagatttttttgatgtttcttaatcatttaaaaataatacatgatttttcttcttgattgaaactctgccgttatatagaaaggacttttaaattttgccagtggatagatttgggactttatccttatattgtgaatttctaatttttattgtattaggtctagggacacatctgcttttactgaatataacctaggaaatacctgctttttaaaatatgtggacatttctttacgaccatacatgtggatttttttttgaaaattctatgtatatttgaatagaatgttttctctatttttggaatacagagatctgtgtgtattttatgtgtctgtttgaatcaaacccgatcattgttattatttatttcatatctacttaatatcctgatttgagagctatgttaaagtctaatctatgcatgttatttctactcagctttactttttatatgtgacatatatttattaggtgtataaactttaatgactatggcttcttttggaatttacactgtaacataaaacttaggttattatgaaatattatctttgacttgttcactgctttttagtttaaattctatttctttgcaattattgctatacctgcattttttggttagcgtttgtgttttttcccctcaagtctgtttttgaattgtgtatgtcactgtgcattgtgcatatatatagctgctcctgtgttgctgtaaagaaatacctgttgctgggtaattgataacaaaaagaggtttaattggctcacgattctgcagacagtacaggaagtgtggtgctggcatctgcttctggtgagggcttcaagaagtttgaaatcatttagccaggcgcggtggcaggtgcctgtaatcccagctacttgggagactgaggcaggagaatcgcttgaacctgcggggcagaggttgcagtgagccgagatcaggccactgcactccagcctgggcaacagagtgaaactctgtctcaaaaaaataaatataaattaaaaaaaaaaagtttgaaatcatggttgaaggagaagggggagcaggcatctcacatagccagaacaggagcaaaggagaggggtggagatgccatacacttttgaacagccagatcttgtgagaactcactcgttatcgcaaggacagcaccaagccatgagggatttgcccccatgacccaaacacctcccataaggccccacctccaacattggggattacatttcaacatgaaattttggcggggacaaatatccaaagtatttcatttatttcatattatatatgtgtacacacacacacatacataaatgaagtctgtagtaatatgtaaaatatgtatatgtgttatgtagtatattttgcatgttttgaaagttgctatcttttactagagaatttaacctatttacatttgttatccatggacttgaatgttagcttaacagacattaaaattttggttttaaataattttttataggcctagaaaaataatgattttttttgggtttctttttaattcagtattgataatgagaactgatgcccgattcttctttttttgtaatgatctgttttcttttttatgtggctccaagaattttccttttatccttgttatttcaaagtttctgggaagtttttacctgaagctgccattcagggagtttaaggagacattgttacagatcaagagtgggtatttttgtaaggatatagaaataagtggaacagtgataatgactctttcggttttaggttcctcatctgttgaatgaggattatgcttaattaaatgttagcttttattattagatatttacataacttttcctttagaattttggtgattataatccctcccattttctcccattctggtactcatataaaacagacattgcaccttctggatcagattttcatgtcattctacctctttctcttactttccatctttgttctttattactgcatcctgggagaatcctagttgcctaatactaaaaaaagactggtgaagattaaaaacaaatttggagcatggggagccttataatacttatttattagagcacgtagcctaaaaccattgctatagttggtacagaataaatactggataattaattaaatgaactgtggaatatttaacttcttggtatttttttatgatacaactttaatctcaaattttgttcattctgttttgttttatggatacattttgacagattatttcaaactattaaataaaagtcttgaaaattcctcagactcattcttaaaattggtaatacgagttctcactgagtttttgttgttgttgttattgtgttcttggattaatatgggaaaatattattataacatgttacttttttccttttcttactccctgtctttttaatgatgaataaaagtaaaaagaaaaaatgctgtctaggaattttcattattgattcaaataaaccatttagttgatacaccatttaagggcctttttttttttgaattttatagactggttctcacttttgtttcccaggctagagtgcagtagcgtgatcacagctcactgcagcctcaacctcctgggctcaagcagttttcccaccccaggctcgtgagtagctgggactataggtgcatgccaccatgcccacctaattattgtattttttgtagagatggagtttcaccatgttgcccaggctggtttctaactcctgagctcaaatgatccacctgcctcagcctcccaaagtgctgggattaaaagcatgagccaccatgcccggccaagagctgtttactttatccctcctccccaaatgttaattagcttcgtaattgttacttatgtattatatattacttattgtattattaatattttaacttgcttgatttcttttatgtgtagtgtataagagtgttgacatttgagaagttccctgtggaaatccattctttgatattgtctacgattttacaagtactttttacttggtttaggaagatacattccagactgtgtatatatagtaaacattttcttttaatgccgagtgctcttcattagctatttaattgtaacagatgggtttgaagcgttctcctaaatgtagtgttttattttccttcttttattcactgatatctttatatgatattgtaaattagtatgttagatatattccagtacttctcatagtagtttagctaatataatatttttcattgcagatatgattaagagaacatattggtgtttctaaaatgagaaagacattgagaagctggtcaatttaaattactttctgttattatatacttacctctcattatattttatctgccaagattatttttagtgtaaaaggcttctgcaaaacttgccatatggtatcaaaataagcgattttagattttaacaatttagcagaaattagttatgttaatgagttgttataaacatttttcaacagattgattgtacttttcctttcgacatttacgtggtctttctattcagacatttagactaccgaggtgttgtatttgtagttaattctgggttctgttaatgcactaaacatatttagataccttgggagttataaaaaattacctgttttgtaaaagctggttattacactttatcaatgaagaaaaatatttattttctgtgtttctaatgcattaatacccttgagtgccaaaatagcactgaaatgttattctgtatacttataatattatataaaattaaagtgtcacaacagtaattactgtttatgagttatttagaagcttctcctgcttcagcctcccaagtagctgggactacaggcgcccgccaccacgtctggctaattttttgtatttttagtagagatggagtttcactgtgttagccaggatggtctcgatctcctgacctcgtgatccacccgccttggccttccaaagtgccgggattacaggtgtgagccacccggcccagccaaatttttgtatctctttcttttcttctttctgattcagccctcaggagtcacttagctttgttatgttgattcagtgcagtagactgatgacagtgaggaagagtttgatagtatgtgatatacagatttacacataaaacattgaaaacaattataattttaactactgtagtccctggttaattagcagaatataaagtcagtgtagtaacatgtgaagatatccacagtaatgttagcagggtccaactgtctgtgttacatgaggctccagttatctcagctaagctgtttatgagccacactcacaaaaaagatcaccaaaagttaagtctttttggtatatgtataggaacacctttctattagggcctgtttcaagcagcatttttggtgctttggatacaaagatagtatggtgcctcaattgaaggatcttggactaggatgaggaaaagataaactgatcatgtaatggcataagcaagtaagtaccatgtaatggtgtaaacaaaaatttatgttagatagtcatttcccacagagagatgtcatactgtatagtacagggcccatcaaactctcttcaaagaaaatgatgctcaaagtggacttgggagaatgaggaagagtttgtgaatcattctaagggaaaactgaataagtaaatgcaacattttacataatttcttctgacttcttatgtgttcacttgccctagactgcccctcttgtttggggcttatttctgtgcgttttaccacttgcaagataatggaggcaggttgaaatgggaaagataccagatgactaattttttttcgcccacatttccatcttttgttaagaaatttgaagttgattgctacattgaagtatgtagttttgtgtttttttctgtgagtctttaaccatttgtgtccctgttaacttacaattgatgagtttattttgtatttatttttaggcagggtaaaaaatagtaatatgtctcataaataaaatatatgttcctattactagttttggtgggatttaaaaactttataataatcctcaatatagaaacctgcccttttaaccatattactatttgctttaaaaaaaaatctttaggttttgtttcaaaaatgcttcaaaatttatttttgaaaatataaggaatgaaattctaactttctaatttgaatggaaggatgagttggtagcacacgaagcgctaaattgagtaatgtagattttattatttttaacgaatcctttgtttaatattttgcaggttcaatttgttttacttgtgatatacagagagttttttataccttcccagcttatatttgaatattccttttcaaggttttataaagagatttctctcctttacccctttcagcgatgtgcattttgtaagcaccttggagccactatcaaatgctgtgaagagaaatgtacccagatgtatcattatccttgtgctgcaggagccggcacctttcaggatttcagtcacatcttcctgctttgtccagaacacattgaccaagctcctgaaagatgtaagtttactacggatagacttttaaacttcaaccaatgtatttactgaaaataacaaatgttgtaaattccctgagtgttattctacttgtattaaaaggtaataatacataatctttaaaatctgagggatcgttgccagggatcgctggggagggaaatgttatcagtggtttcattgaaattaaatccaaaaagttatttcctcagaaaaatcaaataaagtttgcatggtttttattcttaaaacattttaaaaaccactgtagaaagatgtaaatagggactatgcagtatttctgatttatactataaaataatttattaaaaagtcaatcaacactaaaaagccatccagttgaagaattagaagacagttcactcaggtgttatttcaggatttacgttaataagaacaccaaagacttctgaaattcttagaaattgtgtttccctgataggtataatagaaatctctgctagtaccttttcatgattcatctatcttagtcttctgtaatctgcagttgtgctgtttttcttttccaaatagtattttataattcaatgaaaatgtttaaatgcgtgaaatttacattatacaggaaattataactctttactattgtatcattaaatagagatctctcctttttcttactatgtgttttccctatgagcatatatgttttgggatcttttttctcctagtctattgaatttccaatctcattatgaaacctccatgatattttattcaatcttttttatgtcacctcttagttacctaatgttagcttttatctgttccttagcaatgttaataaaagcttttttcctatcttctccaggtctgtgaaacgtaagtatagctaccccaggcttaaactaatctcaaatacagttagtctacatgatcattacccttttctttgttgagtaccataatttcattttccattaaaattattttgtgtccacatatgtaatcatatcaccattagtaacctagtgtacaaattataggtaaggcaaactagaattttaaattatatttaggctaataagggatttaaagttttaaaatgcgttagattgtacactcttcaatctggaagagaagaacttcatgcactgcaactgttacggctactatttatgtactgagttacttcagcaagtgcataaactggcagttatcagagtggattatattctgggtggcataataaatatactttgtcatctcaataaaacaattttgtgtgtatataggaatctgaattttattcagccttttgtagttaatcatgctttagacctcagcaaacaacatgcaaacttttacaagaatgttgttgtagtgttagaatattttattacttaatggcagtgctactttctactgaaaactgtgttctaacagtgtataccttcagttacatgttagcaatcataaatcagtttgtaaaataataaatactgaggtgagataatatgctgttgttgatcatgtatataatgaaaggtttatggcaacataaagctaaaagatacactaaaattatgagtactctgcctttttccaaaatagacttatggagactcataaaaatacatgagcaataggataaaactaaagtaaggaaatttggcaatggaaaatttagataggataaatatgaaggtaatagagagaccccccccaaaaatatataactccagacgtaaccacaaatttggccccataccttttcagcagtcaatacaaagaaggaaatatgagcccttaatctgattcttactatttataacaagacgtcacttgatataatgatataataataacaagacatcacttgatacaatgcaatgaaaaattatcttaaagtagccaccttgcagtagaaaaatatcagtttcatagggctgtttcttatagcagccttcaaactaagtcggtggtgtaaaatcaaggcctaaatgactaaattagatttctttggggttttttttttttttttttttttgagatggagtctcgcactgtcactctggctggaatgcagtggcatggccttggctcactgcaaactccgccttccaggttcatgcgatttctcctgcctcagcctcccaagtagctgggattacaggcgcataccatcacacccggctaattttttgtatttttagtagagacagggtttcactgtgttggctagattcgtctcgaactcctgacctcgtgatctgcccgtctcagcctcccaaagtgctgggatacagaggtgtgagccatcgtgcccggcctccttggggatcttaagcagtgcattctaactacacagcgttctgacccatctgttaagacgatcataatcttggattaagtaccaaggatataatttaaagaatattgcagataggatgttttgtcacctttttaacatgttttataaatattttttcctatcctaattgtgtgtcatggcagaagttaatttttatgcttttaaaatgatactgtcttaaatcatagtgttattatgagggttaaatgaaaacaatgaatggaattcacataacattgtgccttgtatgtattaattgctttaaaaagggtagttattttacctcctatctaaggattaagttatgagaatgataatacatattgagtatatgtattttctgttgcttcctaaggggcagagcagtagctgtgatagttgactgagttaggagtaaggttgacatctttttataaaagttgagaaatttaacaaaagcatgcatctcattataaagaaattcactaaagagagtatctgtgaagaaggccaagattttcttcaggaaacacttttagggtgctctgtcataggtaaatggctggtcattgttgcaacattattttcatgatgatacaaggatacattaaccttgtctggaaattttaccctaaaaatccatctagtagatacaaccagatatacttcctgaataggaaaactgaatggcacaaagccaatcatgcaagataagaggaaagaacattccagggagagggaacagaccactacacagaccttgaggaatggatttggcatgattcatgaacaggcagcatgtcattttacttggagcatagtagcctactaggtgggtagtagagacatcatcaaggcgaacaaaggctagatcatgtaggccttgtaagcaagggaaggagtttgggttctattcggtctgcaatgagaagtctttgcaaggtttaaacatggaaatgctacatatcctaattcaccccctgttcctcaatgtatttactcatcatttagctttaattccttttacttcacttaagctttaactccagcctcttttctttggttatctttgtatttcttgacattaagtcctgttgcttttcttttaccctaaattctgtcagtcctctgacctttcttatctacctgccaatgatacggtctagcctctttggatgacatccatgatttattttttcttcccagagattctcttttatagacaaatcactcagcacagtgtcctgccagtgatgaaaattggcagatgatagggtgtgatggaaattagaaagcaatgctgatttggtccttcttaaattcacactgtatgacagctattttgacttttgttgctgttcaccaatgcttttattcttatgtgttgtctggattttcttaagtaatagtttcatcaggtttaaggatctgtgataagctctgttctaatttaagctcaatgtttttgtcttttttatttatctcttctctttttacggctgtcttttaggaaatgaccttctctaaagatgatcattttgtttcctctcacttttctcctgccataagaaccttgctccctttacttcatttagcttcatcttatgccactgttggcatttcatgtctacttttgtgtatactcaaatactcatcactttcattgatcagtagtaaagtttgctgaggagtcaatttgattagtagtcaagagcctgatcttagaatccaaatagacctggaatttactcctctgcccttttaaattatctttagttatagcctgtctttgctttttcaactgtttaaagaaaaatttcttagttgattattgctttaaacttagtgtctctggcttacagacatgtgtgtctaaatattcatatttaatttctgtcatgacaccaaagctatccagtagtatcgataatcttgtacatgacctccaaaaggttgtttcagtattcccacacatcttctccctgactgggagggttggaaccaacctcatttctttgtgtagtgcttttaaaaattattgtgtttcacataaggcatattaagtgtttttgcaccagatgtatgtattacatggatgtttttctttgactaatttattaccaatgatccatagtaatcaaagaacacagcaaggttatcagtaaggaattggtggaaatcatcatagtctaaaaagtgatttttgtgacaatgacagttgtcttgttgcagagcgaactttgttgtgtataacagtgctgtgcagtataaatacaatgtgagcaacataagtaatttttctagtgggtatgttaaaaatttgagtaaaaggaaacattgggaataattgtagtaaattttatttaattcagtaatccaaaatagtaatatctcaaattttgagatactttttctcctgttaagattttggaatccagtgtgcattttatgcttactgcacacctcgatttgaactaattacatttcacttgtttggaaaccacatgtcgctagtagctaccatggcaacttgaagtgtcaggggagcaaactctagaaagtttcacagaagcattttagtgttcctaggaaagtataatagaaaaatgaattgtttatctgataattagtttattatttcccccaatttttaaaagttttacggtgagcaaaaagatcaatttttaaatgtacatattttgaaagataaatactggtactgtcttaagaaacataacatcccagttatgtcctttctatcaaaaatgaactaatttatgatgcttccattgttagattaatgatttattttaaatgcctatcacttaaagagccatttaaaagtgattttagcagtaagtccttcacttaaaatatgttcaataagacttgattcatgttaggcagttggggatacaaagttaaaaaagttaaggcccctgtccttcaaggattcacagagttgtgctgtaattaattgattatgtaacagaagtttcttgtaagcatatgggtaaaagtaatattcaacaactaaaggtatttgggtgtggtaataggtattcaggaaataatgtgcagagtttttttttgagacagggtctcactctgtcccccaggctggagtgcagtggcgcaaactccagtcacagcagcctccacctcccgagttcaagcgattctcctgcctcagcctcctgagtagctgggactacaggcatgtgccaccacaccctgctaattttgtatttttagtagagatggggtttcaccatgttggcccggctggtctcgagctcctgacctcaagtgatccatctgctttggcctcccagagtgctgggattacaggcgtgagtgtctgtgcccagccatgagcagagttttgaaggctgggagcacagcagaaaaacaaaatttcaagcagagggaacagaatgtgtaaaagcacacagacatgaatagcatgttatgtgaggtgcatggcagacaacccaccatgaccacgagatagtgagtggttctgagattcagttggaaagggagataagggcctttttgcctcatacttgaaaattctgattttcttttaggtgaaaaatgaggtattggtggagttttaatttatacagaggttaacaattagatttacatttttgaaagattgttctggatgtgcagaaaatgatttagacaggatgtcagaaccataagtagagatgatttgatgcagaagatactgcagttagcgagacagagtattaggtaggtacaaaggtaattgcagtcttcgccattaaaagtaatgtcaaaaactgcagttacttttgcaccaacctaatatgatagactaaactataaacatacaaggaagaatgatgtgtaggaagtttaatacataagaattgggatctggctggatgtgttgggtcagggctgagttcagagtgaacagtgatactaaggtttctgcctttatctattcttgagaaaaatggatgatgtttcgggtttttaaaaaagtttcactttagagcagttgagattgagtgtttttagaacatctggctattgagatccagtaagacttgaagaataaaggtttggggtttatgaaagaattctagggccaataatacagatttaggaatcatggtggcattttatggcatgagagttgatgtgatcacaaagggaaactatgggggattaggaaagaaggaaaaggatgaaatcctaagaaactccagcatttagaaagattgtataggtacaaaagccaacaaaggaggatgagatgaaagtaagggaaaactaaggagaaattaggagagagttgccatgatagaaactaaggaaaggggcgttttaatgtgggagtggctagcaatgcaaatgctacaaagtgcaaaaagccaaagactaaaaagtaacaatcgggtttcctatgggcattggcaacctcactaatgtagcttcagatgagtattaggtgctaagccagccttcatgaagtacgtcagaggtccagccagcgtccacattttgaagcctgtttttgtactgccctcaagcgaggaattatttttacatttttaaaagagtgcaaataaaaacaaaaagtctgactttttgtcagagactgctatggctcacaaagcctaaaatatttactatctggcccttttcaggaaaagtttgcagactccggtacaaataaaagaaatatatttttactctgtttcaagatgcttgactggaaaagaaagaacgtgtgagtcagagagaaattgataggattgaccaaaccttcaaaatggaaaaaaggctgagtgtggtagctcacacctgtaatcccagcactttgggaggttgaggcaggaggattgcttgagctcaggagtttgagaccagcctgggcaatgtggcgaaacaccgtctctactgaaaatataaaaattagatgggcatggtggcacacgcctgtaagcccagctactggggaggctgaggcatgagaatcccttgaacctgggaggcggaggttacagtaagccgagatcgtgccattgcactctagcctaggtgacagagtgaaactctgtctcaaaaaaaaaggaaaaaaaaaaggttcatatactttgtgatacttgttaaatacaggcatatttatatatattatctaaggttggtatgataggcttgactggaaaagaaagaacgtatgagtcagaatagtagataggaatgatcaaaccttcaaaaaatgaaaagattcatatactttgtgatacttgttatatacaggcatattttttatacattatctaagattggtatgattttagaatacattattttccttattttgcagtatgcataagtttaactgtatatttggcagggcagtttatccttatattttctgttttatatggtaaaagaactgttagtacattttcttttaatccacatttagggatggatgatgtccataattatgtggattttaatgcttttacaactagaaattaatatagatgaatatataattagtatattaagtaatgtgtttgtgtatgaatatgtagcttctgtctttaatgttcttccacataaggcattttccagtaattaaaaaaaagcccttatatgatttgaatagtctgtttatgcttaagaagcatcttagtctaattgatattaatgtttcttaattttgtctcttatctgattttgtaatttcaaaatatatttaacattcaaagaaaatgtttatgttacactgcaaagcatttcttaatttgtattttccttgtttggttctttccagtaagcatatattgagcattaattaggtatccagcattatcattggcattaggaatagaaaattaaagaagacctgcttatggtctcaagtagatatagccacaaataattgcaaaactatacgattaaatttaatgtggttacatttagattaaataccctacagtgtttttattggtacctctttctgattagatgacaattcaatgtgaataacttcaaatgtctgaaaggttcatgatgcaaatcctttcaaatgattttactgtatagtcagaaaaaatttaaattcttatacaacaatttcattgtttcactgttaattatagcgaaggaagatgcaaactgtgcagtgtgcgacagcccgggagacctcttagatcagttcttttgtactacttgtggtcagcactatcatggaatgtgcctggatatagcggttactccattaaaacgtgcaggttggcaatgtcctgagtgcaaagtgtgccagaactgcaagtaagttttcatttcaattcaaagctgtgtattgggtttaagagggaccctattactaggtgctaaaggtttgtgtaatataatagaggttgttcatattttagctatattcattcagtgacttcatcatacttaaaaaaattactggatattataacatttatccagtatatatccataatataatttgttattatattataatataaataacatttatataattttgaaagaagtctaaacaaaactgattttaatcatttaaattgctctggtcgtctaaagagctaatttaaatttgccaacaatttaaaaaataagcgatattaacaatttaaaacaaacagaagaataaagtagtttttcttaaggggtactggggaggagatttaataggatttaaacgtctaactacagaagtagaagaattagagttgagccaaaaaatcagtcatgtgtttgaatttccattccaggaaggacaatttctactattattttaatgtacatctgcatctctctaaaagccaccttgagtagatcctggtcagcataattccaaaacgaaatatgtggcatttacaaatttgtaagggggttatattttcctatggtatttcatctcttggtcatttctccagtcttttctgtgatttccgcttgcacccccatgattctaatgagcatgataatttggggatgttaccagtatcttcatttacaggctgagaatttttgttgtaaccagcaagaattatgcccaactgccatgatcagtctgtttttattatttagtttgataagaaataaacgtcagtatcttagagttacgtgacataaataggactatgtacctccatattttggtaaaaattagataaaatattcagtaaacatttattcgataccttatatctgcgctcagtttcttgggaaggattaaaagaacttgaaggaagagtacttgtcctccaagatctttccacgtagctgaggagataaaacgtgactttttatggagaggctgaactgaataataattggaggctaactgacccatcttcctgttgacatctatttatcccccagatttcattcagagattcctctctcagctcttcttgctttccctgttgtttcttttcccctcctcttgaatttaaaatcatagtatctgaaagtgattatagtcaaaaatctcaacagagataaagctgtaggacaggggcccaatctttgggggcagaagagtgtttagagaaagattttaggttttcaactataattcttaataattatgacaaggttcgtattttgaaataattattcagcatttaattgcttaatagacattctaagcacttgaacccgcattacctttaattctcgcagtaatctttattattcccattttatacctggaactcagagagctttagtctaagttgtttagtgacacagctagaaaacagcagcctgaatacaaatagagatctgatgccaaatttgatcctctttacgttatacgacagtgtcttttcaattcgctgtgccaagatttgttcctttccacacagtagcacctatcagttatagcaccttcctctcaaaaattctattttaaaagtaaagatcagaggctattcatcttgccttaacccttcctcctttgcaggaatcctaaaatggctagagcaagttaaccataggtgagcattgagtaaagatcaccatttaggaggtaatccttatggcagggttacctctgttactatctgcagagacaaaacagatactgaggtatttatgaactgtgcagttcccaggactgattattttcatgattacttatgttacaaaacataagtttaaagataaggcatcattaatgctatcttattttttagacaatcgggagaagatagcaagatgctagtgtgtgatacgtgtgacaaagggtatcatactttttgtcttcaaccagttatgaaatcagtaccaaccaatggctggaaatgcaaagtaagttgtttatttatttatttttttaaatcctctctatgttttatatggagaccagacaaatcggatacctattcaaatctgtacatcatcaccatcagctttttaaaaacagctttattgacatataactgacatataataaactgtacactcttcaagataatgaacatagtcatcaccctcaaaagtttcctggtgcctcttggcttgctttgtggctgttcaaacccaaactctgtcttcctagtctgctttttcactatagattagtattcacttcctagaatttttaataaaagcttcatatactatatactcgtttttggtctggcttctttaactcagtgtaattattttgaaattcatccatattgctgcacagatcagtagtgattcttttttattactgagtgctggagataccacaatttgtgtattgaatcacctgttggtgaacatttgggtccttcaaaattttgagctattacaaaaaatgccgatgagctcattaactaacttcctacctcacttggcttctgccccttcagggtgaggcgttcagagccgggttgggggcagtggggtagtggagatagcccttggaatccaaggtgcggtttagcttttaagcttagtcttcctgggctgctggtgttgcgaggttgagggatggagatgaccctcaggtgctgcatgggcctggagcgggtttttcctggagctggagagggcatgatggcccgtgtgcgggagtggaaggcacagcattgtcattgctcttcttggaactgctttttctagtgaggaggtggagggcctgggaaaggagggtgatgtggccagaaccccaggtccccagctgggggaggaggtggagcagacgcagggagattctgtacctgcaccctgtcctcgccagtgaggtttggcacctagaactgcaagcagtattaccaggttcttttgtggtcttcagcaagtcctattaggcatctgcctgagtggtgggggttgaggggaggggctttctctcctggggggaaaaagagctgctgggtaactgtgctcagctgtggctacctgggaagtggggtctgagggctgaaggattgtgatgaactctggcctgcttcctcaggtagttcagattccttctcttgctgaatgacttatcattggaaaggaaaaactctgctatttgactgatttgtatatttacactcttatcttcactcagttcctctacttgcctttttatttttaatatgaagttgaatttgtaattcattttctttcctttcctaaggaaaaaggacatttaagactataagtttaccttcggctgtagctttggctgaagccaaatttattgtatttgtaactttatgtatgtatataccttaccgaatatctttatcttttttttaagttgtgctgaagtatgttaatttatgctttcatttcatttaatcagataatttaactaaggtaggttttttaaaataaatgtgttgatacttgtagtgactttttaaaggtgtagcatttgtgtttattaatttcatttagttagatgaagtccttttaccttattttttgacttgttgattcaacaagttgttacaattgaccactattaattgttcctatcaatttatcatatttttaaacaaataccttgtggctgttatttagcaagtaggtcacgccagtgttaatatattgtgctttttaccagtatgaaattgttctttattctatgtaatgtgttttttgttgagggatcaggaagggcaggtattttgctttgcctgacactatggccacgtagggtgttagtttaacagttgaatggttatcttttcacatctttttattttggattcttttgtgttataaaaatgttatcttttgaaaagcttaatagaggtaactgtttggattgatggttgtaattgaaatgcttggctgttttgaggcaaaattgttcttataattcctttctacttttctcttcttttacttcctgcaatgatttataattcagaatctcattttgtgaatgtaaatgattataaatgttaaagatataaaatttctcccattccccactgaaaatgaagtttttattccccttttctctgtttgatttgattaacctagattataaaccttgtcacaattttctttcaaaaatatatttcctctgttaattccaactttaccctcaatctttcggagtcttggttatgttcctttaaaaataattataaattttctgaaaccctacatgtctgaaagagactgttccctttaggctataagaacttggcacagtataatgtttcatattacaaatttttctttcttatactctgaaaacattttcttcagttttttcagtttatgctgtcacaagaaaaatcttaactttaaaaaatttaatcataatcctttttttcttcctgaaagctttgggagatgtgtgagtccccatcccccacgccaccccagcacctttttaaaaaaatatatttacttaaaaaattaccttctttacactctctaataatatctagtaactactggataatttttgttcttgctcttgatcttctttattagggttttcattatcttgagaactggtagagaattctgggtgtctttctcagcttgttctgtctcccctttggtgtgcttctttctaatttgctctttgtaatctgctattctcttttgagagtgacagaattacataatttctgggaatactattggatacttaatctttttatcctgttctatgaagggactatagtgtggtggttcaaagcttatgctgtggagtcaaaatgcagttttttcagttactaaattgatgatctttggctacctgtttaacttccctaagtcagtgtatagaaggttaacggtacttacctcacagggatgttggatttaatgaagtggtatctataaagtgcccagcacaatgcctaacacaaagtaagtacagaaatagttaccagagtttttcatggattgaaaggtttgtcctttgaaccatttgaagagtgatcatctttctctgctgttaaattcttctgtagttctctctgtagtcttgagtcataatttgctcatttgtttgcatttaacttttgagtgtttactgtgtgtgaaactgtagtgaaggctggagatgttgggacaaatcagtgtgcccccacagggctgtcagtctagtttggggctgctccctggtgagctggagtgggggtaatcttttcaggatctttattgtaaaccagtcattgtcagataggtttctttttcctatttttatctcaagaatgtctgtttgttggtatgttatgtgtttttagaaagtttttacttgaaaataagttcaaactctaaaagttggagaaaataaaaataatacccatgtcgcatttacttagatttatcagttgttagcatttcattgtcactgggcatgccctctcttgctttctctgtgtgtgtgtgtgtgtgtgtgtgtgtgtgtgtgtgtgtgtgtgcgcgtgtgtgtgtctgtgtttttgtctctattccccctaaccccctactatttgagggttaattacatacgttgtgcctttttaccaccatttcagtatgtatttcttaatagtaggaatattcttaaaaaatcacaatcctgctatcaacttcctaaacttacatcaatgtagtatgtttatctaatgtactagccatattccagttatgtcatttgatcttatgtccttcataacctaccccttcctccaagtaggttctaggatttagtttttgtcattggtatttttgaagaatagagttcttctcgatatacttgtttttttctttttttcaaacaaatttccccattttgtctttgatatccccttataattagatgagaggcatgcattattggccagaatactgcaaagtactgatccatcctcagggtatcacagctggaagcacacattattccactttccctcatgggaatcacctggtcaggctgttgtccaatttcttttccccctcctttgtatctaataaagcagtatgtaaggacactttaagaccatgcaaatatcttgcttttcctcagaatttccttctagatttgaaaaacttactccctaggctgggtgtggtggctcatgcctataatcttagcactttgggaggctgaagcgggtggatcagttgaggtcaggagttcgagatcagcctggccaacatggtgaaaccctgtctgtaataaaaatacaaaaattagccaggcatgatagtgggtgccatgtaatcccagctactcaggatgccgagacaggagaattgcttgaacccgggaggcagaggttgcagtgagccgaactcatgctactacactccagcctgggtgacagagatagactctgtctcaaaaacaacaacaacaacaacagcaacaacaacaacaacaacaaacttactgcctgatgatgccattttaacctgctttgttttggttgcaaatgatgcatttccagctctagcactcccaccgcatttaccagttagccctctgctttcttttgtaagcaagaacacttctttcacatgttaaacttacttattaatactgactcatgagctcctattatcttcaatcatttacaactcattacctaattattttttggctgaaatagtcccatacttgctgtcagttgctccttcaagctggcgctggtgttgtgccctcaccacttacttgaacacttcatactttttggtgtaacaagatgttacaagctcatcttatacctcctgtgccccagccctggaataagtccattgttaaataagtaacccagattcctttagtggggaatgggtgctgggtgtgctcattgctactgaagggtgtttgcttcttcatcctttcagcaggtggtgtcaggaaatacatgcgtgtgtatacacttacagaagtttgtccaacccatgacccgcaggctacatgtggtccaggatggctttgaatgtggcccaacagaaattcataaaatttcttaaaacattatgaggtgttttttttgtgtgtgtgtgtgtgtgtgcgtgtgtgtgtagctcatcggctatcgttagtgttagtgtatcttgtgtgtggcccaagacaattcttcttctttcagtgtggtccagggaagccaaaacattgaacacccctacacttaacgtatatacacataaatattcatatacatatgcataacttagaaataatgaatttacaccagtacctccagttcttgtccttctccactgaattctttgccttctcattcttgcatgtctgttcttctacaataaaaattctgggttgtagcaacatcagcacatttattcagttgctcaatctaaaaagcaagtctgcttcagtttgctctcagtaatagattttattcccctttcttttcttagtgatttaattttttaaatatagaagatattagtatactttcaaaactcaatactatatgaagttttactcagaattgtcactgcctcttgtttattatttatactccatttctcccaacctcttggaagtaactaacttcattgttttctgttttaaacctcctgttatttttcgtctaagaataagaagatatattgctcttattttcagtgaaggtagcatgttgtgtatgttcttttgcatgttgcttttttcgtgtaataaaatctggaaatcacttccaggcaagttaggcaagttcaagagatctcattctccttttaaacagctgcatagcactccattgtgtatctgtgctatgggttactcaaccaatggcctgtgctttggtatttcagtagtttacgatattttgcattataaatgattttacactccctagctttgtgcatgtgtgtttttgaattctcagggacaaatctgtagggtaaattcctagaagtaggattattgcctcaggagtgtacacatatgtagctttgttagatactgtcagattccctttcttggggcttatggtactttgcattgccaccagagatgtgtgagagaacttttcttacgtctttgctaacaggatgacttgttcagcttttgaatgtttgtctgtcttctgggcgaaaagtggtgtatcaatgtagttttaatttttgtttatcctgagtgaagttgatcgttttttcatgtgtttaagggtcagttttaatttcttctcgtgaattgtctgttcatgtgttttgcctgttattgaagattttggcattttcccctaaatttaagagttctttataagttagggatgtaagcttttatctgtgttacatgatgcagatactttctgccagcttatttgttcttgttttttttgcttatttgtgtgagacagtgtctcactccatcaccccggccatagtacagtggtatggtcatagttcactgtagccttgacctgggctcaagcagtcttcctgcctcagcctcccgagttagctaggagttatgtgtaccaccaagcccagctaattttttacttttgtagagacagggtctcactatgttgtccaggctgtattatgtgtcttttgactttgtttttattattttttttttgccatgcaaaagtttctttcttatggagttagatttattaatcttcttttgcttctggatttttgagtcatattcagaaagcctttccctacactgagggtatagaggagttcatattttctgctaggatttgcagtttttatgtttattttatttttgagatagagtttcactctgtcgctcaggctggagtgcagtggctcaatcttgggtcattgcaacctccccctcgcgggttcaagtgattctcatgtcttagctcccccaagtagctgggattacaggcatgcgccaccacgcccagctaatttttgtatttttagtagagatagggttttgccatgttggccaggctggtgttgaactcctggcctcaattgatctgcctgcctcggcctcccaaagtgctgggattgcagttgtgagccaccatgtatggcttgcattgttttattttttacatttaaatctctgatctatttggagttgatgtttgtgtatgatgtgagtatctttttccaactggctattcagttttctaaaaaccattcattaaaaagactgtctttgccctagtgacttgagattccagactacaatgttagatttgattgaacttatatctggaacctcttttccattccatcgatctgtctattcattcaccagtacgacactgtttttgttatagagcctttgtagtatctggtaatgttgggccccttcagaacttatccatttcacaggtttcttatctgtgcttgtgtatttgtttttctgtataaactttaggatcaccatatgtagccccaataaaaacctcattggaatttttattggaatcacatttaatttattgagtgtctgggtgcagtggctcacacctgtaatcccagcactttgggaggccaaggcaggggtgttgcttgagctcaggagtttgagacaaacctgggcaatatggtgaaactgcctctctacaaatacaaaaaaattagccaggtgtagtggcacacgcctatagtcccagttactcagaaggctgaggtgagaggatcacttgagcccaggagttcgaggctgcagtgagccatgatcatgctactgtattccagcctgggctacagagcaagaccctgtttccaaaacacacacacacacacacacacatatatatatatgtatatatatatatatatatatatatatatatatataagtgagagttgattgacatcttgattttaagacatcctaaccaagaacaagggatgtctttacaagtttgttaaagtctagttttgtgtcttttaggagtgttttataattttcttcatactgattttcaacatttaagcttattcttgaatatttatttttctgctgttataaatggggttttcttaccatcctttaactcgttatttgtgtgtgtgaattctattgccttttgcatgctaattttatatcctagtactttgttgaattcttttattgaatttttgaacaattttctaggatgttccaactctgtttacaaattaagagttttgtttcttcttttcctggtcttatgtttctgttttcatttgtttcaatgcttgcattggctccagaaccatgttaaaatagtagtggagataataggcacccttgctttttcctgtccttagtgggaatgcctctcgggctctcccataaaataagatgttgcctttagaattgaagtatttatgttggtcacattagagaaatacccatccatttttactttctcaagagttattagtaatgggttttgattcttcccaaagacttctttctttaatcatctgttgcattgaaataattttttctcctcagaccttttaatttgttaaactttattaatggatttttctaatattaaatatctttgaatttcttgtataaactccacctgggcatagttattattttcttaatgtggtattagagtctgtttgatagtattttatttaggattgtttttcttttctccttctcattagataaaggataatacattcttttaaaaaatatatgtgtatgtatttcaaaagatggggtctctgtgtgttgcccaggctgaattctacctcctaggctcaagagatccttctgcctcagcctctcaagtagatgacaccacagttctgtgccaccgtgcccagctatttaggatttttgcatcagtgttgttaagtgcattcattttaatctttaagactagctgatctatggttcctggtagtttctctttttaagtgagcatccctttcatatcaacctggtagcacagaaagataaagttcccttttattgatattttagattcaaaatttggggtgggtaatgagagccccacaatgtattaaccttacacccagggatacccagggttttaaggctgactagctcacaggcacagaagtagttttggctggcctctggttggccttttacttcataaacaattctaatttggtaaggataggacactctctctattctaaaaacatgaagggccatcattggacttttgatgtggagcaatatattttcacattttcagacaccaagtcacatggcgttgaccgtgctctgtgtttccccacccaccatggcagtctcacattgttgcccaggcttgagtgtagtggcgtgagctccctgcagcctcaaactcctaggctcaagcaattctcctgcctcagcttcccaagtagcagggactacaggtgtgcaccaccatggctaattaaatttttttttttttttttttttttttttttgtagagaaagaggtgttttgccttcttgcccagattggtctcggatccctggcttcatgcgatcctcccatcttggcctcccaaagtgctgggattactggcatcaaccatcacaccaggctggccatgctattgttttagagttgagcagacttactccacaaaaattacttcctgctcctagcatatgtttctttttttgaattttgagttgctgtctttttggttttatctcttccacctatatgttttcctggatatccccattcccttatttaaattttcctggagattttagtgcagattttgtgaggccacatcagacattgaaaacagctttttaaaaggtgtataccctaaggccaggcgcagtggctcacacctgtaatcccagcactttgggaggctgaggcaggcagatcacttgaggtcaggagttgaagatgagcctggccaacatggtgaaaccctgtgtctttagtaaacacaaaaattagctgggtgtggtggcacacacctgtagtcccagctactcaggaggctgaggcaggagagaatcacttgaacccaggaggcagaggttgcagtgagccaagattgcgccactgcactccagcctgggcaacagagtaagagtccatctcaaaaaaaaaaagcatgtaccctaaattagtgtcatgaaaataaaagcttaatgtataatccacaaatgattcatgactttttaaaggtttacatcagaactacaattacaaatgcataacaaactgtttttgtttttatttttcctggtgtttagaattgcagaatatgtatagagtgtggcacacggtctagttctcagtggcaccacaattgcctgatatgtgacaattgttaccaacagcaggataacttatgtcccttctgtgggaagtgttatcatccagaattgcagaaagacatgcttcattgtaatatgtgcaaaaggtaagaagatagttattctattcagttgttttgtcgattgttttattcatgtggtcatttgctctaccatcttacagcttctaagtttttatcactctagcaattccatcagtactgattgctgttatagatggaattaaatgatgtttttgagtctcaaaggcataaggaagtaaatgggcaaaagataagaccagaccacatcagaaatgagcactaatagggaaaagtaaagagaaaatagcttaaaaatgtcaagtaaaaatacggcagcatctctagtgacatgcacaaatgtgctttaaaaaacctttgtcagttagcaactcctctaacctctctcctctcatacttaattaactgttttcatatccagcttttcagcaatgccttctctttacctagataataactcgatgttagaaatttttatttaagtatacttatcactgcaggtgggttcacctagagtgtgacaaaccaacagatcatgaactggatactcagctcaaagaagagtatatctgcatgtattgtaaacacctgggagctgagatggatcgtttacagccaggtgaggaagtggagatagctgagctcactacaggtaaatttgagaatgatttttttttaaattttttgtttttgtaatgttgtgccattgtatcaccaatatattgctttaatcaggaagagaggatcctgtattccagattccatcttgttctcagtttctcaacctttaaatgtatttgttatcttggtcatctctgaatctgatggctaaaatctaatctaacttaagatagttttttttagtatttgaattccgggtctagtgtgctttccttcacttgtgttcttcaggccgacagtggaagttccccagtctttgggtttgcttagtttgttctttataatgtgggttatttttctctaagcatgttgtagttttgtaatgtccttcttaagttaattatcaccttttcagcccaagattttgttcaggtatggaatatttttagtagtatcctactgttaaaaacatgagtcttagagagtaaaggaaatagaactgctcgccagattgtttttcattttcatcattatgagtggcagcttttgtaaaacttctctttatcatcttcaaggataactaaacatcttaattactaacctttcatttccagaatgccatcagtatttagttttgaaatatccttttaaaataatgtgccagttaccttttaaaaaaaattgttttagagatgggttctcactatgttggcctggttggtcttgaactcctggcttcaagcgttccttccgtcttggcctcccaaagtgttaggattacaggcatgaactaccacggttggcccaccttttgatgcattataattttcatgttttttaaaaatgtaaatatacatgtggttcaacagagaaaaatctgaagaaaaacttaaagcatttttggtgatgatttgcccttactcatacaaaatcataattgttgacttaatgaacaaagaaaaaaactcattctgagctaaagaattaataattttttgttaagattataacaatgaaatggaagttgaaggccctgaagatcaaatggtattctcagagcaggcagctaataaagatgtcaacggtcaggagtccactcctggaattgttccagatggtaagaatgtttaatggatatactctgtttttgaagaaaatgtgtatatacaataaatatgtgaatattgactaaaacttcagtaaaagccaagatgcagtcacttaggaagagttttttagtaaaataatcttagacaaattaataggagaaaggacatgcgtgtatttgtagttcagctaccatctagacttaatcataagtacttacttggttaagggaccaagtgattttctattaaaaagcaattcgtatttttatttctttagttgtagttgctaagtagagctgttgctgatgatgagatgtttcatgctgagataatgaaaaatttactgtattggatcatctcagcagtcctattgagggttatttcacttatttccatgatgtttcaattaagctttttgtagtaaatattgataagagctattattgtacttgcagatctggaattaataagagaccatgttgggggaaaactacttgttacatttaatcacaggctcatctgaaagtctttggtgttgtatgtgaagttgtatgttcaattatatagtatacataaaaattataatgtatacataaaaagccactgagatgttttgaaatttattaagtttacgtataataactctcattaaaattattttctataatctttcttgtgaggtctagttgttaaagaaaaagagaaaaagacaattaaaaaatttttaccatagtgcaaagacttctaattttgtcttcataacttactaataagtggtacaatgtttcatgcttatattggaaattgacatttagtagaataaaactctttactcaaattactgttgagggaacagtgttacagaaattttgactccttagagattttataaatgtgttactcacagcggttcaagtccacactgaagagcaacagaagagtcatccctcagaaagtcttgacacagatagtcttcttattgctggtaagcagtatgttcatattgtctaatttgattgagttacaagataatgtctttatcccaaagacatttttgcgattgctgtatgtatatacattacggtaactaaatcttttagttaagagattctggaaaagaattgacaatggatctaaagaaggttagtttctcttgaaaggttttttttttttttttttttttttttggaggggggaggtcatgattaaaaatattttgtactttcagatctgttacttggtagttttcttttatccctacctgtagtctttcaataaagtgggaaagaagatgagatttcagtttgatatcagaacatgtataggcctgggcgatatagtgagaccctgtctctacaaaaataaaaaaagtatctggggatggtgacacatgtgtgcagtcccagcagcttgggaggctgaggtgggaggaccacttgagcccaggaggttgaggctgcagtgagccatgtttgtgctactctactccagcttgggtcacagagtgagaccctgtttcaaaaaaaaaaaaaaaaaaaaaccagataaattttagtcactgattggtaaatgaggctagcagtgtctttttactataacttaaaaattaccttgatgagattgagttaaaggtttaacatactggtatcctgatttaaaatttaccagtgactatgtttctgatatctaagtttatagatttcctgagattagtcttttaatttatagacagtgatgaagaacaaggattatatccaaagaatattttgggtaggttggcaggtatggttaagcaaaataaatattggtggttagtaaatcttttctgtctgtgcttttgagtctatagtaactttgttacatctgggtatctactattagaaaatgcctacacattctagatcactctttactttttaacttaggtacctcacataacatgattgatcctcattttcttaactaaaaaatgagtatgagaacttttcctgtgtaattttcaatccatttggaaatccttaagttgtaaaacataatgttttcattaggttttctggtgtgtggctgattctaatccataaatccttgtgtactttggctttcattcacttaataattgtctgctttgatgaataccttctgatttaagttctagtgtagccaaatgttttatatatctatagttagaaaatttaaaatttgtttgtacattgccataacaaatgttctgaattttgtagtatcatcccaacatacagtgaatactgaattggaaaaacagatttctaatgaagttgatagtgaagacctgaaaatgtcttctgaagtgaagcatatttgtggcgaagatcaaattgaagataaaatggaagtgacagaaaacattgaagtcgttacacaccagatcactgtgcagcaagaacaactgcagttgttagaggaacctgaaacagtggtatccagagaagaatcaaggcctccaaaattagtcatggaatctgtcactcttccactagaaaccttagtgtccccacatgaggaaagtatttcattatgtcctgaggaacagttggttatagaaaggctacaaggagaaaaggaacagaaagaaaattctgaactttctactggattgatggactctgaaatgactcctacaattgagggttgtgtgaaagatgtttcataccaaggaggcaaatctataaagttatcatctgagacagagtcatcattttcatcatcagcagacataagcaaggcagatgtgtcttcctccccaacaccttcttcagacttgccttcgcatgacatgctgcataattacccttcagctcttagttcctctgctggaaacatcatgccaacaacttacatctcagtcactccaaaaattggcatgggtaaaccagctattactaagagaaaattttctcctggtagacctcggtccaaacaggtagggtgattttaatgatattgacagaaaagatattggaacaattctataaaatcagaaggtatatgtgtagctttggtgtggatggcaactttttctgtcttcagatagaacttcagtgtaatgttgattatgtgtttcagccattattttttaaatgctgttaatgaagaatgccatttattaaatttgaagtgatcttatttggaatttcaactcagttgggccataaagatgcaacctattgataatagtttctaatagaaagaactttaaaaattcttttagttctgtgctgcagtaaatatagagcctaaaatacagtatagttttgggtatacagtaactaacatctattatttccttctaatatatttatttattgatattattcattgtatatatttttaactggataaacatcaacatttatgacaggaattttccatgctggggaatttctcattttgatgtttttattaattgctaactcttgtgggatttcttttttcaagtaggacttatttcagtagtttcatggaaaaaaatcttagaattgtactgttgattttcagtaagtaaagataaatcttcctttgtctgctttacatcatgtacattctaccctttaagaatgagttccatttctttttaagtgagatttaagtaaaactgcatggcaaaatgaagatactgtaggtacgaattatttattgttttacaaaattgctgctttctgaagtgttttttaaaattgcaagataacaaatagtggagaagtgttaattcacaatagtaatttggagttttaagtttcatgattgaaattgcttcaagttaagttttaagtttcatgatttaaatggattaaagtttggctttttataggaataatatattgattttaatcgtataatttttaaactgtaaggccaagcttttaagaaaatcattttttaatgtgaaaattagtctcctctatatcaaacccagatatattttattctctaaagacaaggtacacgaaagggaaagtagttgtcagatgggatttagctgtttctgcatggcaaaagacgtgtgcagtaaaactaggccactctttatatatgcctttttctaagtattttccttgacagttatttctgctctaccatgaaaagtttttcttctcaaaccagttgtgctcctttctagtaagtttttttttgttttgttttgaatagttatataataattatgttgttctgactctgaaaagactttaccaatggaaatttgaatctcaaatttacttttggttgatatatttacattctttaaagatactgcttcatatgtattcctgttaaattttacttatctctccttccttgtagacttttgtttcaattgagaaaccaggttcaatacattaggactctttttctgtagactttatgttccgaaatattggggaggggggtgtatttccaggcttattccatcttatatgagccatgtcctagtattttgctgagctgtctttgattcccaaatccgatgataatctttctatttttctgcccctcttgttactacttcatcatttgctgctactcttgtaagtattttgtaggctgtgttttccctccctccagctttttagttttccaatcttggttttagttatctagcaaacagccttcacttgatgatgaacctgctaatatagtgctgttattagggagagtatgaattgaatagtacaagatagatcttccattggtgaggcactgggaccataacttgcaggaaatattctacagttagcaggaatgtgtatatccgtatattagaaatactgaagttcagtattctgttacatgaatttctttggtattaggcatttctgtattatacttctgtttttatttactgtttcttctacatattcttcacgttggggattggctgtaaaataagctgcattttcctggctgtgattgtgatgtaagcaagattctttggtttccagctattttttgttaacatcactggcattttcatattttgttgaacattaccaattctttggtctttaccagtaaagtaaatactaaccaaagaaatgtagatttaccttaagttctgtttcatggtgggcaaattattaagttgattttaatgattttctataatagtattatatgagcttttctaggaattcacttcaaaattaaacgaacattttaataggaaacatctgaaagatctagtttgtgatagctagtgattggattatcagatgttatctggaggtacaagctagccaactagtagaacggtaagccagtgctgtctaatataaatataatgcagaccatatgtgtaattttaaattttcaagtagttacactttaaaaaaacaaaaacaggtgaaataaattttaatctattttatttaacctggtatattcaaaacaatatttcagcatttagtataaaaatgaacaagatgctttatacttaaaacatcagttctggctagctgcattagaagtgctcagtggtcacatatgatggtggctgccttattggacgatgcaagacaaaacattttgagaaatataaaaacagcagttccggaattattggtgaaattaaaataccaaaagaattcaagatcgacaaactaagactgtggctgtgctttcacaatttttaaggactgaagtagaaatattctttttctgttgttcatggaacacattttaatgcagataattgctaaaccatttgttgctgcaacaaatctttcacattttcaagtatattcagttttaaatatataatccaaataacccaatattggagattttctgaaggtgagatgttaggacacagaaaatggaatttatatctcaggtattggacatccattatcaaatatcaaatcatatagaattattttcctttaaggaggttagtaattaaagtttagttttttgtatttttcctttcatatggaatatttcaggtgctatttagtgagaaatatgatgcttattttctttatgacatgtttcaaatatatctcaaatgtatgatttagaacctaactgactacaggaatagtaacacatttttctgatggctgtgaatagaataagattccttttgttttttgttttcttgcctattgtagacgcaggatttcacaaagatgaggaaaaattagacatgataaggtaggagaagtaacagacagcaaattggatattgtttcatacaaattgtcctaatgacctagttgtattttctcatcttttattgaagttatctattcataaataatttagtatttcatttttcagcatttaaaaatattttttatttttttatagagatgggggtcttgctgtgtagaccaggctggttacgaactcctggcctcaagcgatccttccatctcgggtctcccagagtgctgggattacaggtgtgagccccacagcgcctggcccatttttcagcatttttataggtgtatgtactttgcgacctgggtttaagaaagtgattattgacactgccacatattgtaatcaactcggtagattttagaacatcaagctaatggccctaccctagaccaattaaaatgcacttctaggatcatctttaactgtaaccctgaaagcggagttctgaactagagaaatgtgctacttgtcttactgatttttaaaaatgcattaaactgaatactgtaaggaatgctctttaaaaatggtggaaaataaagtggaaattttaaatttgtcatattaaatcataacatttgtttttatttctgtcttcagtccatttctctcattgcacagttgtattcccattctaattaggaaattctgagataataatcttaggtcttcttgtattatttaccctgtatgtatcatcacgtcttatagaaagatattgaatgtaatcacactactatgatctagttcagacaccttcatgttctaattgctttcatgatggtattgaaagtttttattaagcattttatgaaacgtattatttgcagtagacatttctttattttatttttacttatttatctgtttattttgagattgagtcttgctctgttgcccaggctggagttgtggcacgacctcactcactgcagcctctgcctccctggctcaagcagttctcctgtctcagcctcctgagtagcggggactacgggcgcacgtcaacacacctggctaattttttaaatatttttagtagagacggtgtttcgccatattggttaggctggtctcgaattcctgacctcaggtgatccacccgccttgtcctcccaaagtgctgggattacaggggtgagccaccacgcccagcctacagtaaatatttcaagaaaatttcataaatgaaaacataggtactgtattttgatatctcttggacaaattataagaagtttactttatattataagaagagtactttcagttttaaaagtagccagagaaccatagtgttaaacctaaaaaatacctacccctttggaacaccaagctaacaacacagccgattagaagtaccagactttccttttagttcacttgtgcttgttgtggtatttttggagatattactgttgctagtgccacctaatttgtattgtgaaattattgaaggctaaagctgataatagctgtttctgtagttatcaaaacaggattaggtctaatttcttgttctacttgatatcgaactcaattttatatatgagacttcttttaagaattccctaaatagtgaagtgtttgctgctgtagctccactgtatacaagtgattatatttaccaaaaagacaaactgtaaactcttttgtttcttttaccagttatcttcctttcggctctctctcttcattgctttcacttttcctaaattagacttactgtttataagcaaccttggttttacatagtatgttggaagagtgtggggctggggttgatttaggatttggaggtgtaaagtttgccagtgagacaccaaaccttctctggctgcttttaaaactgatagtactcttgggctgtaagagtgactttgatcatatttaacaaccagcaatagaatttgacttttaatagaaagttgcttctaaatagcctatcctccacgtgtcattattgttctcatttccccatcccacagtccttgtataacttactagcttggacagtttacctgagaaattggcctcaaaacagaaagaaacttaatgctaatattaaactgtttttgggttaaattatttttcttgggttcaaattcagtccctgccaggtagtgtttttttagtttctgtagtatttgatagcaagttgattctatttacaacttaataatgattacattaggaactattttgcttttaattcagtttgtagattaaggaggcattatatagattttttagtaatttttagtaactttttttaagtgaagaaattcaagattctaggttattactggtggaggcattagtgtgtttcatatcatagttcattgtttattgatgaattcatacacatatgcaaaaaaagataatagatgctcagcagaaaaaaagttcaataagtgctgaacagggtgcttaacatagcagtgaacagaaaggggcatgatctttaattacagtgtaaaaagtgctgcaactggattgtaggggaagagcccatacattacaggggcagctaaccttttctgagtggtttgtgtaagttcttgatcaaagctaagatctgaaggataatttaaactttggtaattatagctatattttagttttaaggtctaaggaatatactagataatttgtcagaatatctaagtataatgataatttttcttcagaactataaaattacacaaagtctgtcttctttttgaagtgagataaaattttggcatcaaagctaacttttaaattatgatgaataatacataattaccagaaaattcttacttctgaaataaaattattcaacattatttttatcttagagtacgactttctgtctcatatttttgagaactgtctactgccaacataatattaaactatcgactaaaaggaatttaagatgtatgttagccaaatctcagagaaaaaccaatggaaatattgagagaagtaatttaggtatcttttgcccccactgcctaccactaaataaaattacaaacaataaaacgtcctaggtggtgatgcaatgagaggcactaatggtgtggtaagagagatgatggttcaccgggagcactaaggaaaggtctgctgttgagaaaatatgtaaggccatacctgaagggttagaaaacgccagacatggctggccgtggtggctcacgtctgtaatcccagcactttgggatgccaaggctggtggatcacaaggtcaggtgtttgagaccagcctgaccaacatggtatcgctcctaaaatacaaaaattagctgggcctggtggcgcatgcctgtaatcccagctactcaggagacttgaggcaggagaatcgcttgaacctgggaggtagaggttgctgtgagccgagatcgcaccaccgcactctagcctgggtgacagagcgagactccatctcaaaaagaaagaaagaaagaaaatgccagacatttattgaggggctggaatgatatagtgaagtgttctgagtcagtcgggctctgattgataaagagcttggcatgtttgaaggacagcaaggaagccagaatagctggagcgtagcagcggggagacaaatgccacaaggttagttggagaaaggcattgggaaaggtttgtcttttaagtgctctgagaagcaattgaaggtttgaaatagaatagtgacttgcttgatcacatttgtacttttgaaaagtttctctggctgctgtggggaaaggcttcagtagatgcagggtcggagaagcataaccagcagtagactcttgtagcaggttaggtgagagatggtggtggccacgactgagctgctagtggtggaagtgacaagaagtagaaggattggagacaaaacttgaagataaaaagtcttgaatttgctgatgatttgcattgatgaagtgttgggggagaggactgaaggagcaaaggagagtgacaagggactggatgccatttataaggatggggaagactgggatgaaaccggttaagggagaaattttaaacatggcaaacttaagaggggttttgtgtgagaaaatggaaatgctaagaaggaagttgaaaatcctgctaatttggagatctttgattaaaactagaaataagaatatgggaagcatcaacttccaagatgccctcattgtagataataccatttaggatctaggctcaagccctgggaaactccagggctttggaagtcaaatagaggaagaacacgtacaggagatgaagaaagattagcgaggaaggcagtgaaatatccacaggtggactgctgccaaatccagcagaacagtatgccagatgtcaggagcatgagtaaaatgagaaaagagaaatggcttttgacaacacttccttactaatagtagggaagaagacataggtacagattcaagttgattggaaattatgaaagtgaggtaattgacctgcagtggttgctgctcagtgaaatcagcatagtgattacctgagctaggttagagatttgatgggtaagaaagaacacctaacggtaatcctggagggaaaaaaataaagtgtttgctggagagaatgagttggattgctggacttcaatgtgtgtggattcagtttgtgacttaaaaatgaaaccagtctattgcttgtgtggcttttctcaaaatactgttattccattacctatctcttaccccaagagtagtcacattcttatttctggttattttaattcctggtggtatttttatgtgattaatgagatagtactttttaatttgatgatattctagaaacctggtaagtactatgtaccttgtcttaagttttggttacttaattggtaaaattatagcatgcaccattgaattacctaattcaaaatatattcttttattgtttgacatttgtcttgtttttctttaaaatgttatctttgtggagtaaacatttttctttatgctgtttagcatcttcatcagattagttcagggtattgctgaatgtggttgtttggaagtaaaatgctttagttttagttatatagattttaataagatactactttctatataatttatcaggtactttaggcattttaatttgcaaatttaggacaatttgctttaacgtttcttcacttttgtccattggatgtaatttccataaagtattcatttccctaagtaaaaaccaaaaccaaaccgacaactaatggtcactgaagaaagagtgattaaatgcttagattataatggtatttgcattttaatgttaccagctctctacagtttaacgtgtatgcatttatcgattgcttatgtttctccttgcattctttggcctactggttttggttgtttatagctatagaatatagaattccttatggttatccatttctccttttaagtagagtgatagttgttagaagaaaaataaccccccaatactttcttctagtgttaattcttaaagtgtgattgacttttatttactttttggtgcagtaattgcagttcatgagtcaatgttgatgtcctataaaccttaatttttaatgtttcattgtagtgatgtctcaggcagaataaaatatttaatgtaaattgtagcagcaaacatttaagttatacttaaatgtttaaatcactgttagtgattaacttattttgccttccttgaagcaatttgtcctaaatttccatacgtttgcatttgtttttgctgttctaaaattccttagttgctggctttgaccttttatgttgctgagttttacacatctattttctcaactgccatatcctagggggcttggagtacccataatacagtgagcccaccttcctggtccccagacatttcagaaggtcgggaaatttttaaacccaggcagcttcctggcagtgccatttggagcatcaaagtggtaaataaaattgcatttacattcatatatcatttctgtctgatttgttttgccctactggatgttaagaattaaatctttcttttctagattgagcttccaagaaacactttttaaatctaaaaattttaatgtaaagaaataatatgcttgcatttaaaaatcaagtatacatttttaatacctctttttatggttaattccttttgttgtgattactactgtttttatgagggagaagtccttgacatgtagaccaaaaggtaattaaggaccttttcattcatgatatcataaaaccttgttgcttagaaaaaagcaaaagaaaaagctccattaatttattatgttctcatggagaagaaataccaaaattgtggcatatttcattgtctggttaataccttaaaatgacaaggctttttcccccatgacattggttgatggctctgccagtccttgaagtgagttaagtagtgtgatgcattttgaagagaaaaaaattaatttgaaaaagtattaactcaaaagttaaaatacttcattgactggagatgacagtttttcttcatattctatatttaatattctggaatatggctgtttaatttagactaatcaaggattttaaggaattctagattatactttattttctttcatgactggaagaactattgttttttaacctccctacctccccctgatatcatccaagatattgaggtataaatatacctcatttgacagtttgataatatagaccaccaattttcacttactttttttctgggtcagcatttcatgttcgagaaaataaattgagagattactgtagtctcgatttttaatcactaacttaatttttcaaaaatcttttataccaatttaaaaacaaaacaaactcggccgggcgcagtggctcatgcctgtaatcccagcactttgggaggctgagggggcagatcacttgaggtcaggagttcgaggccaacctggccaacatggtgaaaccctgtctctactaaaaatacaaagaaatttagccgggtgtggtggcatgtgcctgtaatcccagctgctagggaggctgaggcaggagaattgctggaacccaggagacggaggttgcagtgagccaagatcgcaccattgcactccagcctgggcaaagaagcgagactccatctcaaaaataaacaaacaaaaaaaacccccaaaaaactaacctgacgccatccatctgttgtgcaaagaagctgatgcacttctcaaaagggatctcaaggagagcagggtaagagaagacaggagtggcagtttgaaactgggagctggctgtatttgttacatccaaagggaaaaaagccattcctcccgttccttttgttcatgtgtatctattttatgcttacagtatcaccataaatttttgacttggaaaccattctgctaaatagggaataagttcatttcaaactatgataagggacatcagttgaagatatgacatattatttaacttaactgtgagggaaacatctaagtattttcctgagcatctggataattttaaatatacataattcatctacttagggaggtgccaggttttttcaaggagtaattaattagtacaaacaagggtgagggggcagggaacaccatactctggtacttaatgtctgaaattatcagggaatttaacacattttcccataggtttatttcttgtgtaagaagtcagataaattatttccatttcaagtatttattattcagattatttaaagcaaagctttcacaaagccttttgtcagctttcctataatcctcaaataatttttcctggctggacgctttggcttactcctgtaatcctggcactttgggaggcagaagcaggaggatcacttgagcccaagagttctaggctgcagtgagctatgatcacaccactgcactccaacctgagtgacggagcaagttcttgtctcaaaaataaaagtaataacaataatgataaattttcctctaaatacaatggtgaatgaggtagaaatgttgagttcataagagaactgttgaatagtgaaggaaactgacttaattttaatgagaggaagaatactgttacacaacactagcaaaaatgaactttcacgctgatgtagcagtacagaatatgcttccaaccccgggacgctgcagccagacttgctagctaagtgaccttggacaagttacttaacctttttattcctcagcacactcatctcaaatggggataataaaacctactatatgggattgttgagagtaaaaaatacttagattagtacatagtaagtactcaatagatgttagctattattgtaatcaccgcgagaccagttaatgagagagttcttccttatacttactctatattgaatacaatttgttgcacttcgaaatatctggatcaggctatagttgttgtcgtcaccaagaatgtaggagtgggaaagagaaaaatcatgcaaaggcttgctgatagcattcacagtgacaggcctaaggtatgattctaaggttgtaagcattttatatttagatttttaagttgtggagtatacgtttaaagataaaaataataagccaggtctcttaatacttatctaaggaagtgtttgtgtaacatttaataaaatgttttatctcagtggcatttggatttaaaaattattttggtctgtcacagaatgttgacttttcccaatctgttacatagggccgtgggtctggatttccaggaaagcggagacctcgaggtgcaggactgtcggggcgaggtggccgaggcaggtcaaagctgaaaagtggaatcggagctgttgtattacctggggtgaggcttgcttcatgtatattttctctaatctaaatgtcagttaatgatgaaaatctcatagcaagttattttgatcttaagagtcatataaataggtcaaaatgtttattttactgtcctactttgcttttttttttgagcctctggttatgttttcttgtatatttactttctcatcctttctcttttcttaccttcctctttgactccttatctttctatgccaaccctctctaaaaagtcagtatgtaatatagttgctcttttatttaaaaaattttaagattgatagatatttgcttactatcatgttatgaggctttatttatatgtgtattgcaaatatatttgctaactagcaaatattttatgtaataacttcgctattttattaaaattctgtttttaaaattctgaaatgtcattttaagtataggagacaggtgaaattgttcaagtttactactaaaccaggaataaggaagcttagattcttgtccttttttcaaaaagaaaaattttaaaaccaggcttattgaggtacagttgatataagctatatttgacatgtacaattccataagctttgatatatatatatatatacacccttgaaaacgataccacaatcatgatagtgaatatattcatctcccaaagcttcttcatgcccctctgtaattttctgcattccccctgccatccgtccttgtccccaagattagtttgcattttctagagttgtatataagtggaatcatacagaactgtacactttttggactgatttatttcagcacaattatttggagattcatctgtgctgttgcatttgttaacagtgtactcccttttcttgctgagtattaataaaactgtggatgcaccatggttgtagacctgtgcacttttttttcttctttttttttctgagacaggttatcattctaattcctggctggagtgcagtggtgcgatcatagctaactctagcttcgacctcccacctccgtctcccaagtagctgggcccataggtgtgtgccaccacacccaactccttttttaaaatttttgatagagacagcatctcactatgttgtccaggctggtctcaaacttctgagctcaagcagttttcccaccttggcttcccaaagtgctgggattacaggcgtgagtcaccatgccccagcctgtagtcttacattcttgtaatgtcttcgtctggttttggtatcagcataactacagcttcatagaatgaatcaggaagtatattctcctcttcagttttctggaaaagttgtgtagtagtggaaatgtatcttcttatattatacgttaatttattagtgaaaccatcttggcctgaaattttctttgtggggggtttttgttgtgttttccttttttttttcttctttcttttgagatagagtttcgctcttgttgcctaggctggagtgcaatggcacaatctcagctcatgcaaccactgcctcccaggttcaagtgatttcccctgcctcagccccctgggtagctgggattacaggtgcctgccaccacgcctggctaatttttttttgtatttttagtagagacagtttttcaccatgttggccaggctggtctcgaactcctgatccacctgcctcggcctcccaaagtgttggaattacaggcgtgagccaccatgcccaggctggagtgcagtggcgtgatctctgctcactacagcctccacctcccaggttcaagcaattctcctgcctcagccttctgagtagctgggattactggcgcgcaccaacatgcctggctaatttttgtgttttgggtacagatggggttttgccatgttggccaggctggtctcgaactcctggcctcagatgatccgtctcccaaagtgctgggattacgggatgagccaccagtgcccagcctgtgggacagtttttaacaacaaattttatttctttaataggtacctatttaggttatctgtctctccttgcataaatttgcatctttcaagaaatttgttcattttgtctatcttgacaaattaaaggaatggagttgatcataatgtttcttattattttaatacctgtagaatctgtaatgatttcaccttcctcattcttgatactaataatttgcatcttgtcttatttttttcctgatcagtctggctagagatttatcaatcttattgaccttcttgagtcagcctttgttttcatggacttttgtctattttctttcccctttctgttttattgatttttattatcatctttattttttcctatcttctcactttgagtttaatttgatcttctttttttgtttactcttacgtgtccctgcttggaagggacacttgtgaagtttaggtcagaactttctattctccttggctcatatctgtggtctaggaaaatgaaatttctatcaccttctggataaatcacactattatctatgcaggcaacaatagcacgtattttctcaaagattacctttgccctcaaggtaggttttatttttctagcagtctaacggtcatgaaataaattataaaataaaaacagtgggtcttcaagctagatgatactattttctttcttgcatggacaattattttaaaatattttggtttttctgcacttattatttaaatatgacagtatgactccccacccccacttgaatctagggacattgtagttttctactgcagactttgtttctggtttatactgggaatatattgtttatcattttcagtgaaagcgttcactggttaaatttccttttaaaaataataatggatctttacaatttctttgagctgctcagtgggtataatgtgttgaattttctgttagtggttgggaggtagaaatagatactttatctctattttagccatttccataattatatatctcaatagtcttgtcaatgcatcattagttctatgactgaattaatgattacttttagtagtcacttaatttcttactgatgatgatgattctacttttgtgaatcatcttggatgattctctaaaatcttagaaagctgattttgttaatactatgcatgtaacacatcaatacattttctctattaaaaaaaattaaagcattataggtagatcagaatttaccattactaactcctcagtccttcttatttccctgttatcagtttggtatatttatatattaggttgatccatatgaaattgccaatattatttctgaactgatgaaaagcagcaatttcttatgattcaacctattatatatgcccatagactacatataatgactttgcatgtttttatattatagtgctatacctcaaatactgttctgcaatttattttttcactcaacaacgtcttttgataatttctttcatggcagtctatacaagtttctacctccctacttttaaaatgttgcgtaattttctaatgtttggatttgtcattgctttacttactccctaatgatgaatattggcattattaacacttgtagtcattagggttcatatgactataaattgctcttataaagcattagtactatccattaaaactgcctttaggctgggtgcggtggctcatgcctgtaatcccagcactttgggaggctgaggtgggcagatcatgaggtcaggagatcgagaccatcctggctaacatggtgaaacctcatctctactaaaaatacaaaaaattagccaggcatggtggcaggcacctgtagtcccagctactcgggaggctgaggcaggagaatgccgtgaacctgggagacagagcttgcactgagccgagactgcaccactgcactccagcctgggcgacatagtgagactctgtctcaaaaacaaacaaacaaacaaaaaaactgcttttaaatgtatttgtattgaaaaatactgagatgtagtccttctgtttagttaaccaaccaaacttccttccttcttttttttttttgagacagggtctcgctctgtcacccaggctggagtgcagtggcgtaatcttggctcactgtaacctctgcctcctgggttcaagtgattctcctgcctcagcctcctgagtagctgagactacaggcgtgtgccaccacgcttggctgttttttgtatttttggtagagacaggatttcaccgtgttgcccaggctggtctcgaactcctgagctcaagcgatccacccactttagcctcccaaagtgctaagattataggcatgagccaccacacccagctggttaatcttctttcagttgttcctcaagaaaagtaattcagttgttttatgttttgaccttgaacataacctgttgtgtttcaactctgtctttccaggcttaggttgtaagctttttaaagaaagaggattgtattttatgattttggcaatgccctccttgtcttcttctacagcttctagttcagagctttgttttgtttcataatcactctagaaattattaacaaaccagtgggtacttagttgatttagtcaaatagaactaagtccagactgagcaatattggttgataatcatatggctaatactgaaattttgatgttattcaaaataatattctaaagcagtgctaatagaaatataatgagaaccacatatgcaatttaaaacttcctagtaaccacattaaaaagttacagtgagctgggtgcagtggatcatttgcggtcaggagttagagaccagcctgaccaatatggtgaaaccccgtctctactaaaaatacagaaattagctgggcatggcggtggacaactgtaatcccagctacctgggaggctgaggcaggagaacagcttgaaccaggaggcagaggttgcaacgagccgagatcgcgccattacactccagcctgggcaacaagagtgaaactcctctcaaaacaaaataaagattatagtgaacaggcgaaattaattttaatgccttccatttcgaccgatatatctaaaatattaccatttcaacacgtaatatgtaattatgtgctgtattttatgtttgcaggacatctcagttcagactagctacattgcagatcccaagtgtgtgtcattaaaatagtgatagatttgtgtgggtacatacatatattatcatttatagtttcctgattagaattctgcataatcaagtcttactaagacaggtttattatattttctcattacttcttggtctataggaattctacctctaaagagagaattaggtgaataataaaatgtcacgactccattttacggtagtatcttagcattaatatttggaattgttattctagaccttagccaaaatatatgttttgattatgaattttctgaagctttccagttaagtgtaaaacaagtgaaaaatataacttcgtattctgtgtattttgctttttataggtgtctactgcagatatttcatcaaataaggatgatgaagaaaactctatgcacaatacagttgtgttgttttctagcagtgacaagttcactttgaatcaggtttgaacttgacaatttactgtcttcctcattgaattcctccttgcacatttctgctttatctcatatacacagaagtcattcaatatttagctatagagctatattagttaagaaggtatttttaaagtaaaatttgtaggtttttagcttagtctccatttaaaatatgttctgttttcttaacttcaggatatgtgtgtagtttgtggcagttttggccaaggagcagaaggaagattacttgcctgttctcagtgtggtcagtgttaccatccatactgtgtcagtattaaggtaaacatccttaaattgagttaacaaatatgtattgaatttttatttggttttagtagtaacatgagctcccagttctcacaattaagtattatgattattaaacatatgtgacagtatttaaatacttaaaatactgcttttaagggtttcctatctcaagaaatttgctcctctataaatcttatattgtacaatatacttgtcttgaaaaagtaaaacataaaaatatatgcatttaatttaaaagacaatttatagtattcacaaagattttaggtttagctaattcattttgtctgctgatttaaaaagctgagaactggaatatttagtaaaaaattattagcccattctgttctttcccgcattctctctcctctatgctcactcgtatacaaaatgacattttctccttatagccaaaagaaacaaaacaagtgtcatatttaatgcaattggtaataatcgagagtcagcgctgctcactttgaagcatttcaggatagaggctttctggggaaccttttaagtggtatcgtgtgcttggttttaaatatggacaggtctcaatacttcactagttgtatctaaggttcttggttttttctttttaagaactcagtcttaataaaacttacatatttgaataaagtgtcatggccactggaagcaagcatggaggtatagctgtacagcagaggtcttaaactgtatactccacaaggaaatcttttctagtactgccataccatgtaatataaatactaacctcagtttcagtaacaggttgtgaaccatgagtgatttttatacctttctcccctgcccttcaaacatcactgtattatatcattgtcagtaaaatgtcagtatagtaagcaaatcaacattatctccttcagaattctttgttgataactacactagtatttattttatagggtaatacaggtttttgtgagtttaggaatcaaaatgaaagattgtaattaatactatccaaaatagaagactagtacggttaatttatgtagtcttttaaaattagttgctcatggtatgtgactgaaaaacacagagtatataaagccaattaaaaaatagagttatatatgcataaaacatgtttcttttcttctttgtactttatattctgtataaaagttgctgctatcattagattttgttttttagaatacttaatgttttggacctaaggaaattgaataagatccctttcaagatagtaatgtatttcttttaacccatccaacaattaccgaattcccattttacagatgagtacgacttacataagttaagattggacaattagtgcactatcaaacacatagttactggtagagctagaatttgaattcctgtttttaaaaattatgtatggttccttttgcacgatgacactgttttggacagtatagaatactgcagtctcattgagaaatacagcagtatctagaaatatactagggatatgtgaattggctcagcttgcatttttattgtaggaggcaattgtttgtggataagtttgatacctttgaagcttctttttaagcttgctggggcaagtctagaaagtcttcactctaaggtggatattttcaaactttatggttttagaaccttaacactctttaaaattactggggactccatagtttttgtttatgaggattttaactatggactgttcagcattttagaaattaaaactaggaacattttataacacaagactacagaagcacaacctgtacaatatcaatgtaatattatgatacaacatgtagcctctataaacaccactgtataattgtgaatgaattaaagtgaaaaaaggcaaattaaatcttagtattatttaaacttgttttaactttacagactcactggggttccctagaccacattttggtagctgcggtcctagcattaatttaaccctatacttaagacttggcctttctgggatcactactgaattctgctccctgttcaccagtgtctttgtactctgactggttgtgcttcacttgtctttgagccttttgcaagctgtggtaattgtgcagcttacaaattcccagtagatgtactttcccctggttgtgggtctttgggcttctagaagtacggcttggtgttccaccaaagacttcaggggatcctttgtagatttctggagctcttagtcgttattgcttcttcattttgagtactgtgtcctgcaaattccactgccttgccttccctaacctcagcgaggccattgattgtactctgctgaggttctccctccctgggcagcattctggaaaatgtttctaggcagaatatcataggactccctgagtgtttccttcctctcagagaccactgtctcctgtactatgtgttgtccaatatctgaaaacagttgtatcatacactttgtcccattttctactatcttatgggagaacaggctggtcccacctactccattatagttgaagcgtgtatccgtattagattataaaacatatctgtaacaactttggacatggtaccatggatggaatcctggatgacatcttatttgaaaaaacttttaaaactaaggctagactggttcaacggaagaaaaaaatgatagtacaaccccagtacctaggttaaaaggaaatttcaaagagggagaaattgttgaagtgttgaagtactagaagtcaagaaacacaaacactaatgtttccattagatttgagaataagaaggtcttgacaagcctggcttaagcagttatgagtggatgtgggtgtagagaccagactgtagtgttttgaagagtgaatataagctgagaaacttgagagtttggttataaaagggaccacaggtatctgtgaagaaaacttagtaggaatgaagataaatatttttaaaattctgccactgaacacctcagatctgtctgccactttatcttcaggtcattgtttaagccagggtcacgcagactggcccatagactaaatctggcccatttcctgtgtttgcaaataaacttttattgaaatatggccatgttcttttgtttacatatatttgtagcggtttttgcattacactggcagagtttttataaagttgcaacagatcatatggccctcaaaactttctgtttactctctggccctttattggaaatgtttgctggctactgccataagccaccctgatcttacccctaggccatttccttcatttgggcaaataatacattaacttggtaatctaagacaaattcttaaaaatcaataagctaatcaaaataataaatatacatgtttaaaaatcaaatgacattaaaagccttgtaatgggctgggtgtggtgcctcacacctgtcatcccagcactttgggaggccgaggcaggtggatcacttgagggcaggagttcaagccagtctggccaacacagtaaaaccccatctctactaaaagtacaaaaattagctgggtgtggtggctcattcctgtagtcctagttactcaggaggctgagccaggagaattatttgaacatgggaggcggaggttttagtgagctgagatcacaccactgcactccagcctaggcaacagagcagagcaagactccatctcaaaaaaaaaaaaaaaaaaaaaaaaaaggccttgtaatgaacaaccaactcttgtcttactctacctccacgtctgaggcagtcgcttttaatcttttcaggtctttttttcttgtggttaatgctatagctctaaataatcaactggtttactgctttatcaatgctagattttgttgactttctgctatgaataaataaattctgatttaggtcttaaaatacacctccatccttctcccaatatagttgtattactatgtttagttcaattaataaggtgttggttatgactcagtaaatgttcactgcaggtctaaacagtatactatgagtttcttttgtctttcatggagttttttataacaagaaagtaatagtgactctccattcgttctttgtttttgcctactctagaactatcatataagattagtttttaaagtactgtttttttctgggagaagtcctaccctccttctagacattcccttctcctgctctgatatgtgccagtggcttctaggtatgttgttctcatccttaaacttcctggcctgatgtcctttgttggatctgttgatttatagatcccaagtcttcctattctttataatacatcctcattctgttccgcatatctctaagtaactttattagaaaggagaatgagggagctgaattttgagtcttcctgtgtctacaacgtgttctgtcttcacacatagttgcttgtgtagctaggttgagaattgtactttgaaaagtattttcctgtagaattggaaacttatactcttctagcatctggagttgggaagtttggtgccattctgatgggtgttcctttgaatttaactcttttattttcttctctggtagcttttaggctttcatgtacctcatgatctgaatttttattctgtaccctcattacttgctgttttattataatgtgggcacttgattggttctgtctgaggatcctagtcttttgagatctttaagaagttccacaatcttaatattacatggtgtggcttccttcaggagtttattagggatttggagattcccaaatattctactaacttatacccttgagagaggggagaataaacagaggagtgaatgtgaacttcagaattcctagcttcatagtctaaatagaaatcctctaagatcataaaatgtccctaagaactcatgccttacattaatttttttggtattttttctattgattctaagcatggaaatgtagatggagattttgttgatgtattttcaaattatgtatcaataatagggaagcttacttgatttctttaaaatctggtcactatatctataaatatagtggacattaaatgtacagcataaggtaattatgtggactttaaaaaggcgttaaaatatgtgccattttctattattctgctcagtaggcttctaaaagcgtgtatgaacatgcccaacccagtattgggcctccgtaggtgctcaataaatgttagttgattgcctcttttctgcttctaggtacataagcaccatattaatttatatagtatatttgattatgttaggttaatgcataaatcacatggattggttgtttcttttacagatcactaaagtggttcttagcaaaggttggaggtgtcttgagtgcactgtgtgtgaggcctgtgggaaggcaactgacccaggaagactcctgctgtgtgatgactgtgacataagttatcacacctactgcctagaccctccattgcagacagttcccaaaggaggctggaagtgcaaatggtactctagggtttgtttgccttgttagtctttcaagttcagagctttctcataccactttggtttttaaaaattagccacacctatttaattgaataatacacatattctatgatagataccagtaatcagaaaaattttcacatacacattaaatcatttcccccattatgttcgtatgtagcttcctgaattacagtaactgagtaactaagaaaataaaattgagacttttcggggggatttggatttcaggtgtgtttggtgcagacactgtggagcaacatctgcaggtctaagatgtgaatggcagaacaattacacacagtgcgctccttgtgcaagcttatcttcctgtccagtctgctatcgaaactatagagaagaagatcttattctgcaatgtagacaatgtgataggtattgtgctattttttcatctttttaaagcttttctctttgaaatgtagcaaaaaaaaaaacaaatggaaaatagcttttccttaatcacaagttttaggtacagaactttttgccttgtagatttttagtcacctagaaacttacagaagcgatttcctgttttgaattctcaactccggactaaaattttgttttgttttgtttttaaatttagagacagagtcttgctctgtcaccaggctggagtgcagtggcgctatcttggctcactgcaacctccacctccgcctcctgggttcaagcgattctcctgcctcagcctcccgagtatctgggactacaggtgcatgccaccacgcccagctaatttttgtatttttagtagagacagggtttcaccatgttggccaggatggtctccatcttttgaccatcttttgaccgcccgcctcagcctcctaaagttttatgattataggtgtgagccactgtgcccgcccaagactaaagatttttaatttaggcctttttgagggtttaggaatcccttgaaattagatggagaattattgccttcatctatgccgtttcttatgaagggtttctgaatcttctaatagattataaaaaatatctaacacattctgttctccttaaaccactttttcttaaagctctagatactagatatctagatattagatagcaccttctgccctccctacgtaattatgtggaatttcataatcaagaatgtttccttgctttcattggtatattgttgtactctttagaagttaagaagtgaacatatattattaatagtattattttatcagtagtacagtattcttgggactctggctactaattatttgttccattgcaagacaactttttacttaatttcccgattaccattcaacatcgctttccgtgagatatgtctacttcaagttagatgcattacctggagcacatacctgctagcactgccatttgcagttttctgaatacctttgtgtttgccctaactagcttcctttctgtctttgaaatatttaatatatgatgataaaataattagcttccttatgtaatgtgctttgcttcctctctaatagttgttctcattcctttttatttccttcttagctgtatgaaagtttttctgttaatagagatagttaggagaaaagggcaaggtaggaggagcatgtgaggcttagggcttttaagtttgaagactcagtgttacaggttttaaaaggtagcagttctcagtatattccattttttaaaaaaaatgtacaaatatggtctttttagatggatgcatgcagtttgtcagaacttaaatactgaggaagaagtggaaaatgtagcagacattggttttgattgtagcatgtgcagaccctatatgcctgcgtctaatggtaagagaataatttaaactgtgagtctgcactcttgtaccactcacttgcaccttactgtccataaccaatgaattagcttagctctactctattttgtctttgtgaaacttactttgacaagtattttatgaaaaatattatttttggttatacatgacttatcacaacttgttataaaacaatttacatgaaacaataaaaagcatatactttagatgtaaactataattttgcttccaaggaacatgatcttgtagttattgacaatatgtcagaatccaatatgttgattgtttcttagccaggttttcctccatgacttgagtatttccttcatcacttcttgttttgttgttgctttaaaaagcacttttaactttagtgttcaaacatttattttaataaaatgagtatagaaacagaaattataatcatatataagtatttaaatacactttaccttttctgaaaagaattacctggatttttttttttcgtttcagtgccttcctcagactgctgtgaatcttcacttgtagcacaaattgtcacaaaagtaaaagagctaggtaaaatttgaaatgctttacttgatttaattaatttactttgcttaatttttacataattggcttaccacttgtcaaacctgcttcaatcatatgggtgttctatccaaattctgtaatgttggtaatcatttccacaatgatatataaaatgtcatccagctttactggggcagtattcctataaatttcagcaagtaggcaacaaaaataacagctcttagaataaccattaatgccatacttgctttagtttcattgatatattactgtgcttaattatcagttagcagaaaacacggcctagttagcgaacagatttcttttagaattaattcaatctcttaatttttaaaataattaataagcctagtatggtgattcatatgatattcttattaaacagtcattcttttgaatatttgtatttaatagcacctgatacaaaaatgtttggatagtacaggaattgttctaaggaacaacagttttgtacatttaaaattaaatctgcaggatttgtacttatttattacttctccctattagtaattatgttgatactctgatttttccagatgagcttctggagtattctctcttctcttacgtaaatagatccctgccttttgatcttttctacgaagaagctcatagtggattagctgagcattgcatttagttgcagtgcttctaactctttttattgggacatgaaaatagaaattccaggaagacttttttgagacagagtctcgccctgtcgcccaggctggagtgcagtggcacgatctcggctcactgcaacctctgcctcccgggttcaagcgattctcctgcctcagcctcccgcatagctgggattacaggtgcccgccaccacgcctggctaatttgttgtatttttagaagagacagggtttcactgtgttagccagcatggtctcgatctcatgacctcgtgatctgcctgccgcctcggccccccaaagtgctgggattacaggcatgagcccctgcacctggcccaggaagaccattttttaaaaacatgcaacctttctgcctgtaatccaaggaaatttgacctattgttcatagtttttattgggtatcatgaagttaattattcatgcatttcatagatacgtaattgctttctagaactacagtcacattcccttgacatgggtattttggaacagtaatcagtcaaatttgaaatgaaagtttaaatttgtatccttgggattttgtaattttagacccacccaagacttatacccaggatggtgtgtgtttgactgaatcagggatgactcagttacagagcctcacagttacagttccaagaagaaaacggtcaaaaccaaaattgaaattgaagattataaatcagaatagcgtggccgtccttcagacccctccagacatccaatcagagcattcaagggatggtgaaatggatgatagtcgaggtaatactaatttattttccatgaaatatgtgtgcaagaattaaagcatataaagtaacttttgaaatatgtgtatgatttaccaaagggtaaatcacactgacttagttaacccctgatgtgactgacccttgccatttccaaatgagtgatcttcttagaccttgccttttcaggttctcttcctttcacacattttagaacagacctaccttacagaaatctcaaggagcaccatatctttgaagatcacaggtggggaactacagagggcttgactttagtttgctagataacgacacaaaccttctcagatactgtgagcttggataataccatgtttcagttaaggtagttgatgcatacattctagaaatggaaaagctgtcatttaatgttacttcaggtataacttcatattcaccagtgtgcatcataaagtattggtttataaacattttcttgatcaaagtaaatataaggtttttctagctgaattctttttttttttttcagttgggagacagggtcttgctctgttgcccaggttagagtgcagtgacacgatcttggcttactacaacctctgcctcctgggttcatgcgaccctcctacctcagcctcctgagtagctgggaccatggatgcgggccaccacgcctggctaatttttgtatttttttgtagagatggggttttgccatgttgcccagactggtctggaactcctgggctcaaaccatctgctctgctcagcctgctgagttcttgagatagcaaaatattttaatagtaacccaaaatccaatatgagttaaagaggattactgttggtttgctcatttttggggcggttatttattttcaactgattcagaaatgaagtgataattatttgtttgattatattttatttcatagttttttgttttttttttttaaggggcagtgtcttgttacgttgcccaggctggtttccaactcctgggctcaagtgatccttctgcctcagcctctcaagtagcaggtactataggcatgcgccactgcagctggctttgagacaatagaatttattgaatatctactgtatgtcagatgttggaaatcatatcagtgtacaaagcaggtagaattctctgcatagagtttatattttaatgttaggtaacccaactcttaaaaaaaatcagttaattataatgtgtttggcaagtcccatggtaaaaataaagtttgataagaattgcctggccaggcgcagtggctcatgcctgtaatctcagcactttgggaggccgaggtaggtagatcacttgtggtcaggagttcgagaccagactggccaacatggtgaaacccattctctgctaaaaatacaaaaattagccgggctcagtggcatgcacctgtaatcccagctactcgggaggccaaggcaggagaattgcttgaacctgggaggcggaggttacagtgagctgagattgcaccactgcactccagcgtgggtgacagagcaagactctgtctccaaaaaaaaaaaaaggaattggaagtacagatgggtgtttagggtccatatgaacagaaagcagtatttgagcacagattttaaagaggtgagtgagtgagccacttgattacctgagagaagagcatcccagacagtgaggaagccgatgtaaaggctctgggtgagagtgtgctgagcatgtttgaagaaagagtgttgtggagaccaacagagtgagcagaggggacagtcagaaggtgagaagattagagatgtgaggacaagaaggacggctcagtatatctcacacaaccataaggtgatgtgtcagtagtttgtgcttaatagcaatggaatgggaggccattgaatgttcctgaaaagaagaacaccatgatcttatttatattttaagaggaacactctcctatgatataaatagatgattaggtgcaagagttatgacaggtagatcagtgagaaacaatggtccaggtgagaggtaattgtggctttgaaaaggtatgtcatttgtggccgggctcggtggctcatgcctataatctgtaatcccagcattttgggaggccaaggcgggtggatcacctgaggtcaggcgatcaagaccatcctggccaacatggtaaaacctcatctctactaaaaatacaaaaattagctgggtgtggtggcaggcacctgtaatcccagctactcgggaggcagaggcagaggattgcttgaacccaggaggcagaggttgcagtgagccaagatcgagccactgcactccagcctggtgacagagtgagactccatctcaaaaaataaataaataaatgaaaagatatgtcttttgtatgttcttgataatttttgttttgtagtgtgttttgggtctatgttactgggagaaacactttctgatgcttgtatgtaactgattttcagatacaattgaacaggtaatttgatttgggcagttggagtttgcaaagaagtagtccatatacttaggaggaattgatcagatcagctttaacaagaatttccatttctgaggatgttaaaaaatgtctgaaaaaggtttccatagtctcttaaatttgggaagtgctccatttcacaaaatatgaaaggtttcttgataatagtacacattgtttcccaaattatgagattataataccttttaaaaacaacacaaaagaccttggaaggttttccttgtgactaccacttgtaaactgagaaatggtgatatgtttcaatttcatattttctcattgactcgtatcagggtaaaagaaaatcagttgaaaaattacccttgcttttttaaaatttacgtgataaaatagcccatctgaatttactgaatttgtccttatttttattgaatatgaaaaaagattgtttagtgtgttggatgttaaatgctaagacaattttagaatttaaggaattgaatatacagcattttcatgactagtccctcatgttcatttacgtgccaggatctcacatcctttgcagaaggaaaggtacattcctagggataaaataagtgcatgttacttggacaacatttttgctttctgtttgctaaataaaaatcccttttaaaaattcagtattgccacactttgccatattaaaaatgttttagattactatattatcctgaaactacatgtacacacacacccctaaaataagttttatggtatttcatatgcctgtacaggagaaaaaatagggaaagaatacaatcatcgtaagttcttattattacattatgctgagatttctaataacactgcccttttctgggtattttgtattaaacctaaaatttgtgatgttttagactgtttcactaacgtgttttgataatgtctcagtacccttgggaaaacattataaagtagtgggcaatgatgaaacctactctgggtgtttttaggcaaattttttaacttctttgatgctagtgttctcatttataaaataggtgaaccaggatgagcccataggatagttgtgctgatgaggtgcaaggatgcatgccaggcacccagcactggctcttcccacacatggagtgctcagtaaccgtgagctattagaatacaagtgctcaaccagtgcttgagcaattgtgtcttgtgtccaacagaactcaacagaatcccatgcttgtctttatatgtgaattcagttccttttgagttagtaagaaattatgcctgtgttggggtaattgaacttttaggatgagggaattgtctgccacaattattctatgagcttaatgtttccatgtctttttcttcattttggaagttgtggaaaaattataatgaaagagtatataaacgttttcctctgtattatagcatatctgacagtttcctttattaaaaagtacaatacattagggagagacttgatgaatttaaaattaaagtttgaaaagtattattgactataagtgatcttcagctgtgcagttttcaacttgaggttgtcagaatgtaatattacacattatattacacacatctacagaatccaaactgtgatgttcctggagtattggaacaatacctatgactttttgtttctatttatttttaactcttctaataaccgcttccttaagaaaagtcatacatcatcactttggtgtatcagaaacaaattccttatgcaataaaagcatacttctttctcattcacctcctgggatctagaaaccctgttaatgcaagaaaaaaatcccatacctcaataaaataacactctgtttgtctcaagagtggaaacacaacacatttcctctcaactggtggtcccagatcgaccatcacagtgtatggatgtgttgggaggtgtgggaataggactgcactgaggctctagaaggccagcaggtggggcagactgaatggagggaggggactggcattcagtaactactggagagtgggaagagtgaggtagactatccatctggtgaaggtggctgcttccttgaggtttgttactttctgtaatgttaattccctcaacttttaaaatttgatttttagacaagttatacattcaaatgatttaaaattggaaaataattaaaaggtaaacagtgaagtctctccctttcccctgccttcatgcccccagtttacatctccagaaacctcagaggtttcttgtgtaaccttccagatgtgttttatgcatgtataaggaaatgtgtgtgtgtgtgtgtgtgtgtgtatatatatatattttgtgtgtgtatgtgtgtgtgtatatatatatattttgttccttttgtcttactactatttactgtccttcatttttttatggctgcaaatattcctttgtatggaaatataagcaatttaacttacctgttctttcccctgttgatagacctttgggtttctttcaatctttttttttttttttttttttttttttgagacagagtcttgctgtgtcgcccaggctggagtgcagtggcacgatctttgctcactgcaagctccgcctcctgggttcacgccattctcctgcctcagcctcccgagtagctgggactacaggcacctgccaccacgcccggctaatttttttgtatttttagtagaggcggggtttcaccatgttagccaggttggtctcaatctcctgaactcgtgatctgcctgcctcggcctcccaaagtgctgggattacaggtgtgagccaccgcgctcggctttctttcagtcttttactgtgaatagtacaatgaatcacctggtatatttataatgttgtatgtaagtgggcctgcaaaggtgaattccttgctaaatccaaagacataatgcatttaaaactgtttttggcaggtaggatacagttttttttttcatttatttttattacacatatctgaggtatacaacatgctttgtatacatagtgaaatgattactatggtcaaacaaatgtctgtatccttcaccttccatagttactctctgtgtgtgtacacctaaaatctctttcagcaaattttcattacaatattattaactgtggttctcatgctgtgtattaatttgatctctagaattactcgtcttacctaactgcagatttgtaccctccgacctacttctgcccatcccacccatcccctacctccagacccttgataaccaccattctactctctatacgttcagcttctcaccccgctgcctaccattctgcttattaagtgagatcatacagtatttttctgtgtctggcttactttatttagtatactttcctcccggttcatccatgttgtcacaaatggcagtgtctcctttcttaaagctaactattccattgtataaagtcctcattgtcatcagtaagttcttagaaactgtggttaagagggggaaaaaagtatgacaaaactgatttttttttcattttgcattatgccaaaattagattgaaggaaacagtgttacttgaggacctgctgtatgttcatttagcttaacgtctcagttcccaagaacctattgatgacattaagggaggacttaatatatgtgtatacacacgtcacaatttctttatccattcatctgtccttgaatgggtaagtaaattgtccatcaggacacttagtttgtttccatatcttggctattgggagtaatgtcgccatgaatatgggagtgcagatgtctctctcagatgctgattttattacctttgaatatatgcccaacagaggcattgttggatcttatggtggtagtttttttttttttaaggaaactctatactgttttcaataatggctatactaatttacattcctatcaaccatgtacaaaggtttcgttttctacacatcctcaccaacacttatgtctttgcctttttgataatagtcattctaagagacatgagatgatatctattgtggttttaattttcatttttctcatgattatgatgttgagcatcttttcatataccatttgaccatttgtgtgactttggaaaaatggctattcaggtccttgcctattttaaaatccagttatttgggatttttttgctactgagttgtgtgagttccttatatgttttggattttaaccccttatcagatgtgtggtttgccaatattttcccctaatccctgtgctaccttttcaccccggtgttttttttttttttttattgctatgcagaagcttatttgcttgatgtagtcccacttgcttatttttgcttttgctacctgagcttttggtgtgatatccaaaaaatcattgtcaaggaggatatcaaggagtttttctcctatatttccttctaggagttttatggtttcaggtgttaggtatttaatctattttgagttgctttttatgtatgatgtgtaagataggcatcaggtccagtttcattcttttgcatatagatatctagttttcttaccactacttattgaagacaccatcttttccctattgtatcttattggacttgtcaaaaattagctcataatatatgcttgggtttatttttgggctctgtattcagttccattgatccatgtgtctgtttttatgccagtaccatactgttttgttaactatcactttgtaatataacttgaaatcaggtagtgtgataccttctactttgtttttctttctcaagattcttttggctattcagggtcttttatgatttaatacaaattttagaattgtgttttctatttttgtgaaaaatgcctttggaaatttgatagggattgcattgaatctgtagatcactttggatagtatggacattttaacaatattcttccaatctacaaacatggggatatcgttatatttatttgtgtctttagttttttttctgttttttgagacagagtcacgctctgttgcccaggcagaagtgcagtggtgtgatctccgctcactgcaacctctgccgcctcctgggttcaagcaattctgctgcctcagccccccaagtagctgggattacaggtgcctgccaccacgcctgcctggccaatttttgtatttttagtagagacagggtttcgccatgttggccaggctggtcttgaactcctgacttcaggtgatctacccgccttggcctcccaaagtgctgggattacaggcgtgagccaccatgcccggctgtgtgtctttagtttcttttgtcaatattttatagtgtttagtatataaagctttcacttccttcattaaatttgttcctcagtgttttattctttttgatgttattttaaatggaaatgttttcttcatttttttttcagatcattatttgtataaagaaatgcatctgatttttgtatattgattttgtatcctgctacttgactgaattcatttattctagtaactgtggaatttttgggggtttctacatacaggatcatgtcatctgcacacagggataattttacccgcttttttctgctgatgccttttatttccttttcttatgtgattgctctggctaggactatgttgaatataagtgttaagagtaggcatccttgccttgtagcagatattgaagaaaagctttcagtctttccctgttgtaggtttgtttttgaataggcaatacctgtgcatgatacaagaaatacagaggtcttaaaaagagtgaacagtgttaagttagcctaccttttgaccatcccttccttggaaagaaccagtgttttcttatagctttccagagattagtcatctagatacaagtatgtatatatgggagaatttctcatatttgggtgatatggtctttttcttttctttctgtctgtctttctttctgtcctcgtctcgtctcttctcttctcttttcttcgtttctttcgatggagtcttgctttgtcgcccaggctggagtgcagtggcgcaatctcggctcactgcaagctctgcctcccaggttcgtgccattctcttgcctcagcctctggagtagctgggactacaggcacctgccaccacgcccggctaattttttgtatttttagtagagacgggttttcactgtgttagccaggatggtgtctatctcctgacctcgtgatccgcccgcctcagcctcccaaggtgctgggattacaggcatgagccaccgtgcctggccgatacggtctttttctttatttcagcctgtgggaatcagaaggcccttgtgaagatgttggttagaagagactttagcctacagtgataccacctgtgtgagggcactgtatgtgctactttatgccatttgtctcaacatgtatgcttactggtgtcactatgaacctcatcaataaaagtgctctcttggtttttactgtccttgtgtgcattgtttcaggtgaaaggtggcctttgtactagatccagtgttatccttggccacaaaccattacatatgattaacttggggatttcctcttcatcatcctggagatcatcttctgttctctcctgtgttacatgtgttttctgcaatttcatgaatttctctttattttttccctctatttgggtggaacgtatattccatagctccctgacagagaatgtgtggaaggtaagttttgagcattatatacttctgaaaatgtctttattttaccttcctacctgactcatcttttccaggttggaaatacattttcatttatcaattttagtcaattgatccactgtcttttagtttctagtatatgaagaactcggttctctctatgtgacctgcgttttcttggaagctgttaagattttgggaaattctttgtcctcagtgttctaaaatttcatgaggataacgtctgtttttgtctatttttgatttttaaaatctgttttgttaggcactgagtggtctctttcagtctgctgtcttatatccttcagtggtaggaaatgttcttgaactatattattgataacaattccctctgtttttccagaattctgcttttcagatgtgaaacatactcagtttttctctgcttctttccaattcatgtccttattttatcttcctctactgagttttatttctatttcagttatttcaagagctttctttcctccctttgaatgtttcttttgtagcatcctattcttgcctcatgggtatcttatattatccctcagaggattttaatcttttttaagattttttttcttcctacttagtctgttaattccaaattgtcttttatgttctcaggtctctgtctttcatgttacagatcaggggtgttgcagatcttctggcttccatggcccacaatggaagaagcattgtcttgggccacacataaaatacactaatgatagctgatgagcttttttaaaaaaaaaaaaactcataaaaagtctcataatgttttatgaaagtttatgaatttgtgttgggctgcatttaaagcatcttggctgcaggttggacaagcttgttatagaccatagtcggataatctttatggtacatgcatgattaaaagtgaagaactaaagatggagactggatagatagtatttttattttttaaaaaaggaattaagtagttgattagaaagctttctgtatgtggtggtgcttgtcgatttgtaagtttagtggggtgatttgtgctgaccatttggtgaaccctctggtttccgtatctttagatgttcttcttgaactgctcaggttccccactgcagtcttttcaaacctcatacttggaggctagagatctggctgctagctttctgagaattcagtggggaaacgtggggtctggcagcgggagcaggatggggttgtccacatttagtatgcccatattttcttggtcctattttcagtcttcatcccattgttccatttaaggtcacccaggaatcctgcatcccacaaatgagagtagcagcttctcagtgtgtaaacctaggaagcagatgtagggagtatgacttctgcagataattaaatctcttgttgcttgggttttctcccacttatttccaaaggtggccagttttcctagtttctcagccttctgaggagtgttataaactggattctttttttcagttctttctgctctcaactgagaatttgcctttgttaagttgtttttctcctttcctattgtctttttttttttttttttaaaggagattgggtctttctctgttgtccaggctagaatgcagtagtgtgatcataactcactgtagcctcaaccttctgggctcaagcaattctcttctcccacctcagcctcccaaatagctgggattaccggcatgccaccatgccacagcttgattttatcttttaaaaatagattatttcagtgtgttttttagtagggtttcaggagaatgtaattttaacatatgaatttagtctgccatcttaactcaaaattccctgtcattttttttttttttttttttgagacggagtcccgctgtcgcccagggtggagtgcagtggtgccaattcggctcactgcaagctctgcctcccaggttcacgccatgctcctgcctcagcctcccacgtagctgggactacaggcaccagccacctcacctggctaattttttgtattttttagtagagacagggtttcactgtgttagccaggatggtctcgatctcctgacctcgtgatctgcccgcctcggcctcccaaagtgctgggattacaggcgtgagccaccgtgcctggcctttttttttttttgagagttggaatttcactcttgctgctcaggctggagtgcaatggcacaatctcggctcactgaaacctccgcctcccaggttcaagcaattctcctgcctcagcctcctgaatagctgggcttttaggcgtgtaccaccacgcccagataattttgtatttttagtagagactcaccatgttggtcaggctggtacggaactcctgacctcaagtgatccacctgctttagcctcccaaagtgctgggattatgggcatgagccaccgtgcctggcctataaacttttcttttcatggcttagtcataagccgatagccattatcagattgttatggaattggcctcaaatatagaccaaatataataaaaaacaaaagacaaataccctgttcatgccattactgaaatatgttatctctaatactgagaatattgaaggagttaacaacttgattttaaaatgtatttgataaacatgtctttttcctgtaatacaatgtaaagcatatataacttggaaaagtttgattaccatagtgttaaaatagcattctctaaaatagcattctctaagcattccatttacctcattcagtgaagtatttattgaacatgtattaggtatcctactaacaatacatctgttactaagaaaatctgtgtacctgttctcatggagaatatagtctagcagggacacagattttaaagaaccaataaaaataaagcatgacattaatacataggagcatacaactgtttgacataatcttttctaaatatcaggaattctttaatacagtgaagtttagaataaatcctgaaagataagttaggtagaaggcagaaattggggaagatagtggaagaaagagcttgatacattcaaagaactgagtgtagttcactggtgggagtgagatgaagctggaaagtttacaagagactgttgtaatgggccttgcaatttaaagtttattttgagggcattgggaagacatgaaaggattttaagcagaaaatggatacatatttatagaaagatcatttatgcagtaatttaaagaactgattggagagaggtaagctttaaggtggggaactagataggagcatgttgtattaatagtgagtcatctgaggttggactaagatggtagtagagagtgataaaatgcatttcagaggtattgagaagtcttggttgtaggaggaaagagattaggaatgattgaggtggtcttccaggcctctgtcttctccgggttacatttccatgccttttaatgatgataggtaacatgggaaaaaggagaaagtttattttaaattagtagttcattttggatatacagttttcagtaactaggtaatattcaattatagctgtggttgaagctcagaagagagttctagtctagagacctggacctgaagacataattaaaagcaagtgaatttgttaagtgcaaatggattgcacttaacagaactctgagttctgtgttccccttctctgattatgttttatttcatgggaacactgcactaagcagcacaatttctacaaccatttggggcttcttctatctcctttcatactttccctaccaacagggatgtacaattaaaatggctcagcaacaaccctactttttattccccattatgtagggattatatatttgataggtttttccagttttgtgtatacatttacttttttccagaaggagaacttatggattgtgatggaaaatcagaatctagtcctgagcgggaagctgtggatgatgaaactaagggagtggaaggaacagatggtgtcaaaaagagaaaaaggaaaccatacagaccaggtatagtgcctgaggtagacatttcaatatcatcaacacttggttaattaaagaaaaatacaatactgaagacttcaattaaaattaaatattcaggcttcagaactgtctaaacaaaaatatgtgcacataaattaaagaactaaactatttgaatacgactttttagctctagagttctttattttgaatgtgtgaatacttcacaatgaatcattattgaatgccttgtcccaaatgttaaccattttattaaaggctttactagattggcttttgttcatacttggactttgaaggccatttatatagttcctctggatgtgtacttctgtaacgcttttaattttcagtattcactttctaatatctttttttgaaaaaacttatttcagtgtttatgcaggagtgccagtaagtatacagtgtgaaggggaataagacagagttattatggctcctagaatttatagtccagttaaaaaccatgactgattaaacactcatttcttatctgcctcaggagtggagagaaaagcggtcttgcttgtcagttttatttgccttattggaaaaaattattaaaattgtcacaatacagaagttgtaggcttttatgtatttatttaaaaaatttttttcccgcttatcacacgtgttgagtaggctttccttaggcagtttattaatatcttgtttaccaatgaggttttaaattggatttgtacaatctttatgcttcttattgcttatattttattggtaagagtgatctaaatcccttttgatatggaaggaagaactttcttacttcattcgtattccatgagaccttaaaagataacctatcttttaaataggtcatatctataataaggacctaagattagttgcttctgaattgttttatgaaaatgatttcatttcttcctgatcatgaggcttataagtgtacttttttagacattgcagatttcttccaggaacttgtatttaccgttttttttttcttttcctctgcctcacatggaagtcaaccctctaattgagggacccattaggtcacggagtaaattgctagacaacgatatcatttcacaaaagcttatagtgttgactgtgtaccagacctctattctaagcacttcacttatgttatttgtccttttaacatgtgtatgagaagctgctttgcctcacccccttttttaaccagtgaaagaactgaggcattgagaagtatttagtaagcagaattacatagtctgactccagattccatgctgttaaacacagggctctatgtgtcccatgtataaatgccctcataccttggagtaccagacaccgtccccctgaaatcatatcagtcaaagaatatttgtgtcatctaggtagtttgtgccttctatcctccagctaatgtaccagttagccggttaatatacagacagtcatccatcacttaagttcagagaaatacatcattaggcattttcatcgttgcgtgaacatcatagagtgcacttccacaaacctagatggtatagcttactacacatttaggctgtatggtacgctaaattcatttaaaaaaataaagtaattgtgctacggtgttataactacggtgatgtctgtatgtggtgggaatttttcagctccattataatcttatgggaccactgccttgacatgcagccctttgttgaccaacatcattatgcagtgcatgactgttatgtgatgtatgaggcactaatatttgtcaaatagataagccagcgtaatttagtgtttgatatttacactgatactgttgagaagaggaagtgcacacaggtctttttgtattctgtttgataagtgataagagtggctttgccttttttttttttttttttggtcgtttttaacttctattttacctaaaaatcaggttattgatttagattagcacagatttaattttggaaaatgacttactattcaagataaagcagttttatcctgtgtactgtggaaatgtagggagaaattacttatcagtttacctaatttcttttttggataggtattggtggatttatggtgcggcaaagaagtcgaactgggcaagggaaaaccaaaagatctgtgatcagaaaagattcctcaggctctatttccgagcagttaccttgcagagatgatggtatagtactgacttaaaaaaaaattttttttttaatgtaaccctttggtcttgatatttctattggaaaaaactatcctaaataatgttacagtcaataagagccttattgcctcttattgttactcaataagagtcttattgccttttattgatgaaaggatttgagtgcgtatagagttcatatctgtaatacagtaatcaggttttataaggaaatggtttaaatccaatagactttattcttttgagattttttgacaagctcttttttcctgtatcaaattattaaatatattttctatatttaaatataaatggtttagggactgaataacttagttacataaggtactttctggtcatctccaaagcctttctttgactgccttagctacttatcatataatttgaaattctcaagtgacagtgcacctcagtttttatctatttatgtatctgtctgtctatctatctatctatctatctatctatctatctatctatctatctaggggtctcactatgtcacccaggttggcatgcagtggcacaatcatgggtcactgcagccttgcactcctgagctcaggtagttctcctgtcctcaacctctgatgtagctggagaccacaggcacacaccaccatgcctagctaattttttggctttttgcaaagacagggtctcactttgttgcccaggctggcctgcaactcctgtgctcaagcgatcctcctgcctcagcctcccaaagtgctgggattacaaatgtgagcccagctgatatctaaaaaaaattttgtttttgagacagtcttcctctgttacccaggctggagtgctgtggtgccgtctcagctcactgcaaccttcacctcccgagtccaagcaattctcgtgcgtcagcgtcccaagtggctgggattacaggcgtgaaccactgcatccagccaggagttgttttttttttttgctattggtggtgagcaggaggtggcaagtgatggtttgtgtgaaggtgtatttcttattaaactgaccctgagctttatgcaagtcacctctggcctgtctgccttggagagaggccttaagctttgtcttctattccctattcctcgcaatgctctgaaaattggagtttgaggtcattggatttcagcaaatttcggagagcttttacttttttgcttacttctgtggttccttatttatcttaatttttgtttttcatggattccttatgttctggctaggttactggtgcctttaaaaagattgttgtaaaaaatgtttgtctatttctagttttcagaagagtcaattcacttacgtagtctggtggtagagtgcccatattgattttcagaagggatgtgccatttgccctgccattatgaagcatctgagaatatcatttgattgtttatttgtcaaatttaagctgtgttcttgtttctttgctagtttcatagtccccaaatttatttccatttctgatttcaagaataagtgttcattgcatatttattagcatattcatcgtcatgttttcacaatgtgtatatcctacaaataatttataataaatttctgaacttggaattgctgtattaaaggacacactttttctttaaggtttttgttgagtattctcaatacaccctacaaaaaagttacacccacagaatttctcttaatagtttataagttgccatttcgtcatactcatgagctttgggtatttattattattattattattattttactctttaacaaaatatgtttaaataaatacgtttttgctttgtaatcgattattaagaaaataggaaaaatgctaatactaagtagacatgaaatcaaaattttatggcacttaaaagtaacaaacttgatttgagatttttttgttcaaaaagcttgtttgtttatatgaaactgtgtgtatgttggtaaggtataaaattaccttcagtgggtttgtctagaaattttaaatgtcacatatttataaatgtgactgttgtttcaggctggagtgagcagttaccagatactttagttgatgaatctgtttctgttactgaaagcactgaaaaaataaagaagagataccgaaaaaggaaaaataagcttgaagaaactttccctgcctatttacaagtaatattttgctttacattattttacatggtttgttaattgaggaaataaaatgtattgagttttaaaacataggtttgttgtttttgttaatgttttacttgttttgttgtcatttagtcatcataaatgccatttttacctttcaggggtccataaaaattaaatttactttttttgtgtgctttgatacttgtcataaattgcttttttaataccagttgttcacttctaagcattctataagatgtaacaaggacactttgggataggaaaaactcaatcttccaagtcattgatagctatgtataccccacacccaagttctgttgaaatttcctttgccaatacaagttacattaattatattcattgattaaagataggcttttcagccaaagttatagctttaataatcgttaccacttttagaggcctggagaaccaaagatttaagcagtattctttttgttttccaaaatacacatcagaaaaatacctttcagtacgaataaattatgtttgatagatgtagactacaaaaaaaatttttttctagttcatcttgtaaacattaagtcagagtttaaggccatgtgatacggaaacagctcaatattagaaattgtactgagattaaatatctggctctgcatctaactaattgtaaattcctaagcgtgttattcatccttcctggcctctatttcttcatgtgttaaaattgaactggaacagactatcattgagaggccatcctcatttcattgtagacaactattcatctgatctgttcctcctaagaaactatggcttacacagataacccttcattgcctgagttgcatttattttttacatcaattttccagttaggtattactagtttaattggttttaaaatacattgcctttcaactagcatacaacttcctcaattttcttttttgtagctactaacatcttaatggcagtattcatgttagagctcagcctataaagtcaggatttaaacaccattccactaccagttagctgtgtgattttgttctgtttaacatctcttgtgtctcggtttcctcatttgtgacatagtggtgcctctcagaaatgctcagaagttcagtgagagtatgtatgtaaagtgcctagcctgtgccttactttttgtatatccttcatacatgtttttcccctcaatctcttatatcctaggtttgcacctttgtttttttttaaacgatcatttaattggtcaggaaaaaaaatccatttataggttggcttaccttttttttttttttttttttttttttcatctttgttgttgttttctcctgggattccctttacctcccttcttaatagtcctttctaggaatattgtgatggcaacctacttttcctcctattgatccttctgtaaagtgtaatataaatttaagaagctttctttaggtgtttctgcaagtatgaaaactagccatttaatactttggcaaaagagtctttaaaattattaggtctaatttcccaattactgctgtgatcttagtctcctgggccgtcttgttcccctgttgcacatcagtaactttcagcgtgtgtgtgtgtgtgtgtgtgtgtgtgtgtgtgtgtgtctgtgtctgtatgtgtgacatgagggaggcctttttaatggtagttttcttggacttttagagacgatatggatggagccccctctttatgttatctacagggaatgtaaaacacactaaattaataagggtgacacagtttttgataaacaccagtaaagtcatgagtcattagacagaattcttgctgatgatggtgtaagatttctcagatttatactgaaggcattaaataaatgacctctaaacttctaaaacgctttctgctgttcatcattttttctaatgataaaagcattgcttattataagaaatgaatcctcttctacctggtattctagttttgtgaatttttagatttttcatagtgagatgactttttcatttaaaatgtgaacatttcaaatcagatatatcattgcctccaccagacttcacacactcccaatctcttttctcaaagggtagtattgttaataatttggcatttgtccttcagaaacttttttataatttatttttgcaaacttataatagtcttgatttgaactttctaatttttttttgagacagcctcactctgtcactgaggctggaatgcagtgatgtgatctcagctcactgcaacctctgccttctgggttcaagtgattctcgtgcctcagccttccaggtagctgggattacaggcatgttggcgcatgcctggctaatttttgtgttttgtgtagagtcaagagttttgccatgttgcccaggctggtctctaactcctgggcctaagtgaaccacctacctcggcctcccaaaatgctgggattacaggcgtgagctactgcgcccgacctgtattttataatttactgtatgtgtaattcaacttactttcttttagtaatgtattttagggctttttctttgataacatagaactatatacttttaaaaaattgttgtattttgtaatataagtgtctataatttggatagttctatgcctgttgatagacattaaggccatttttacttcttgacattacaaaatatgctacagtgaacttttttgtgcatgtttggcaagaatgtgttaaatgttgtattgcaaaattgtcctgtatggaggatcctttttccagatagactacatcataggatatagactaaagcagagttcctgggttgaagcagggtaaaggggtggaactgtgcttcccttttgtctttggtattgatttttgagaaattttggagagatcttggagttgcaaggaacccagcttgaaagtatattgaaatggaaaaatgttaatatgcctaaataaatagaaaaccacaagcctttagtagctgtaaatattgcacacatagtatggctaaactgactataaaaccgtctttcagattgatgatgtaagtagtcttatagtgtaagtgtggttatatgaatcaatagattacaaatctacctgaagtaaatattaaagccgtagatcaaagtcttatgctgtcctctgcaagtaatctataaaaattaataatactcatgaagctattctgcagtttctagaaacctttggtataattgtgtggttttatttccataattttgtctctagtaaagctaccaaaaaatcttatttttaaaataaggagaatctatataaaataattgacaggatatttctattttttaatacttctgtattcagtttctatattgttaaatataaaccttttctgttatttctgcttccttgtcaaaaaccatgacagaataatctattgtctttttagaattttctaaccatttttgtatgtgcttatcttcatctaggaagctttctttggaaaagatcttctagatacaagtagacaaagcaagataagtttagataatctgtcagaagatggagctcagcttttatataaaacaaacatgaacacaggtttcttggatccttccttagatccactacttagttcatcctcggctccaacaaaatctggaactcacggtatgtagaattattcacagatattttctttatatcatataacatacatcttcctttcagttaaatctttttgaaatgtttttgtttggcctcatatgcattttaaaaatcaacagcattgaagtataacttacattcagtaagtggaactattttaagtggacaggtgtataagatgtagcaaattaatttacctgtgtaactagtaccaacatcaagagttgtgaaggaaaacatttggtttacactttgctgagggcaatgtgaggggttataatttggccaacagtgactttttgactaaaaatctaagatagatttttgttaatcatacagcttaaattcaaaacagagaaaccgaaatggatgtgggggtacttgggaacttgctggcatactgtgttactacagtgaagtctgttgccctaggtcatggtttcttactgctgacagtttgcaccagtaattctttgttgtgggagggagcctttctggtgtatagaaggatgtttaacagcatctttggcctcatgatgatcaaaaatatctccagatattgccaaataccttttggttttggtgggcaaaatcacccccggttgagaaccattatcctaaatgcaggaactattaacaatcagagaaaggtatgagaacttgatgtatttacagagttacagcaatgtcagcaaggctctaggagtttaactcattgggtaggtaagtgtcttgatcagtgtttctcccacttctcccctatggttctgtcaattgtaaatcattgttcttttggtaagcttcctttttttaccattaattgcatttgttactcagttaattttataaactcattttgaaaaacaattttaaagcaatcttccactgaaaaatgactttggatgttaagtagttaatgcttcattaacttggcattatcctgaattgaaatactgacaactatttttgattttgactttttgaaataattagaagcaatcttaccccgtgttggacacatgtgcatgtccagtctgcctcattgttggtagtgaggtcatgcttcttgtttgttcaatcttacatattttttacctcctactttaattctgttgttttaagtatgacctgctcttgtccttgtcagtatgttgttaaaaataatgtataatgaaagacctgtgggtccttcaaaggatattttacgataaagtttatcttataactctcataactagccactttgaagacttaaataggagctctttgcacttgagttttaaaagcaaaaggattgaaattggacagagaacatataggaaagatattgatacaagtttttttttttctttatttatttttttccacaaaaatactgaagagagaacagttttacaataaggccaaaacttggaggactagaaaaatatacccatttcaaaacctagattaattgttctttgcaattgaactactcttttcactttataatggaaaattaatgactaaaggcttttttttaacatgtcattcattgtagcctattatatcaattttaatgatttattcagatataaaatcctttaggtaggggcaaacttgtaaaacagtctttaaaaaattagttataattgtatagtagaattccattactttaaaacaaaaaactgctatatgactcctaaaaaaattatccagattttttttcattcaactacagtgttgtcattattgaaataattttctctaaaaagttcctggatatttgggcacgcaaaacttaatgtgatatgttacatatgaattacattttgaaaactatataatgggaccaagactgtttgacagaagtatttgacctggaatattacatttatgccctcctcccccttttaagtaaaaataagcttgagatggattaaaaatttcagtttctctttactgaatgactaatataattattaaagctagcctaaacaagagttccaatagtttcttggttaagcccaaacccgtagaatcctccttgacttttctttccctttcattcatccacgtttgtgtctgccttcaaaatacgtcccaaagccgaccacttgtctcagctttccttagaaccctggtgctgtcatcacctcacctctcagactgcaccagtgcccttttctaatcttaccagcccctctctaattcccacccctcatctgctctacatatagcagccagtatgttccctttaaaatattagtcatctcctatctttcagcctcccagcaacttctcattacacttcagaataaaacccagtcttccccataatctctaaaatcttaacataatcttgccctagctgcctcttttttatccttaccacagtttttcttactgttaacactctggcctctcgttggcaaacccggcttgccccaggggctttatgtctgctttgccttagtttggagggttatctccatctttgtgcatataacttactccctcatttagttttatgctcagtcatctcctaaaggtcttcatagaccactctgtctaatacaacatccccgcagcttatttttaatcctttttccttgttttttctttaaatagcacttacagcgatgtcgtttatttactaactccccctgagaaagtaagccctctgagggcaggcactttgtttcagtcattactgagtgggcaatgcctgatacgtgatccatagacacagttctgtgggtagtgaaatactttttaaaataaatgagtgagtaatcagtatgaacagcaaagctgcaagtagttactagatggtacctggcttgtgctccatatggaatttctggcttgtgctccatatggaatttctaaagagtgacaggtttgtctttcatattttaacttttcctactgtgttttaatttctcaatgtcacttttagacatgccactttcttaatgaaaaacttttttttctttgctttgtttcttacagcatttattctgtttcacttttattgcctacaggtctttaaattttgtctcaatatacattagtcacaagacaaaatcgtctgaatttttagtaaatttttgtaattcaaaacattatctcctttgctatggaaaatttttactgtaaaattaagagtctcaggtttttattccagtacttgcctcactcagtatctgctgtactctaggtttttagcaaatggcttaatatctgagaaaatactgaaattttaaaaaacatatttactatatttaggtcctgctgatgacccattagctgatatttctgaagttttaaacacagatgatgacattcttggaataatttcagatgatctagcaaaatcagttgatcattcaggtatatatgaatactgtttaccctttttctggtttctgatgtgagcgagaggtgtatgatgtgtggaacaagtttagccttttgtctgtttcccagtaactgtgtttttgtttttggctttgttaaaggactcagcattttctttgatctgcctcagctttcctgctttaggaggggtatagcaagttagttaatttctgtcgtctttctaattgcatcacatttaaggcatgttgccttaaagtcttgctgtatcttttttcttcttttgtttgtattttccctcacttcctgctcctgtggtaatcatccattttatttggtttgggtcttataggtcttgatttatgcactttccaggttgagagctcaccttttccatttggtaagaaactgagcaatggatgacggctgactagaagtagtcttctttttttatagtgatttcagctgaaacaacctgtaggtgcatgctgtttatcagtagtgctaatttgtcactaatccatactttgcttttccctttttgtgtgtggctaaagcatagtatagctgtactgtacttcgggtgactttctcagtagtttttctttaatgaataattttatttttgttaatatgtggtttacaatattacctaaatgtcgtagagctagttcctaatataagatcaaataagaacagactaaatttttactttttaatagtaataatattgagaaagcatgaaaaaaatgtagatgataaaccacttttacatgtgactcttacaaatttgagctgcagcatgttacaattttataaaatgtaatgtacataatcagaatgtgcctatagaatactttaaaaatattacctataattgaagttatttacaaaggataatattaaacactgagcattttagggcttttcattaattcatatgaaacatattcctttttacatactgtgcataataattgaactgtacatttgataacactattttccaaattaaagcaattatttgcatatcgatttctcataaactcctatcttaagcttttttttttttttggcaggagttggcaagttaaaatcagatgtattcttttattcctcaggaaatgtttttacttgaaatagaactttacatggcaccgaatacaaatatattgtgcctaatttttactgagcgactctccaaattgatatgagaattctgattcagaattacagactttatttctctattttaatcatattgttatatactaagtacaggtaaatagtgctatacatttttgtgtgagtattctgaatgtacctttaaatttattttccttactcttgtagatattggtcctgtcactgatgatccttcctctttgcctcagccaaatgtcaatcagagttcacgaccattaagtgaagaacagctagatgggatcctcagtcctgaactagacaaaatggtcacagatggtaaaatatttgccctacatctaggctttctaaaagacctgagtaaatatgatttttaaagatttttgcatggttataatttaacttctaattatttctgtcagttaaatactattttatatcagtatattgaattagtagctgttaatgtttcttttttttttttaatttattctaggagcaattcttggaaaattatataaaattccaggtaaatgtgttttgattttctagttaatgaaaatggcgttccccataccaggaccctactagtcttttaatcttgttactattattgttttatctcctagagcttggcggaaaagatgttgaagacttatttacagctgtacttagtcctgcgaacactcagccaactccattgccacagcctcccccaccaacacagctgttgccaatacacaatcagggtatgttatgactttataattctacattatattcacacacatgtgtatatatgtgggtacatatacacacacaagcaagttttgccctattctttagtagccacgtatacaaactgatagggagaaaaacccttttgtaatgattgaaaaatactgacttcacatagcggtctccctgaaattctctgtaattctgtaattatccttatgtccagtggggaggatgtaacagtgcctgccctcttccctccctgcaagtcccattcccagctcactccactctagtcatttgccacataggcacttgctgtgtgtgtgtgtgtggaactgtccccgctcacctggctgcctgtactcattgatctgccctcggtttcactgtcatctctcagaggttagctggtcaccaccccacccccatgtttttcatttgtagcatatggcacaaatataatacctgtttgggtaattatgtcttccctttagattgtgagctctttaaaggctagagttgtccatgtcttgcttatatgccctgccacagagtatgtgttcagtacatactttcatagtaaatcagtgacctttctatccctgtagacactatgaaattttgtgaatgtttgcctattttgttcatttttcttctgcctacttacaactagctaccaatttctccccttttctgtagagctgaaatttgatagcctaggattaaggtctgtatgagtagatagggaaattggtacaggtatgggaatctataggaaggagtttatggagttgcatggtggcgtgtatataactctatctatatgtatttttgttttgttttgaaacggtctcgctctgtcacccaggctgacatgcagtggtgtgaacacaactcacgtcagctgcgatctcctgggctcaagcgatcctactgtcctcagcctcccatgcagctgcgaccacaggcacacgccatcatgcctggctaattttttgattttttgcagaggtgggggtctcactttgttgcccaggccagtctagaactcctgggttcaagtgatcctcccaccatggcctcccaaagtgctgggattacaggcgtggccctctgtgcgcagctagtatatatttctgatgatttgagcataggaacatctctctctatcctattgtcactgcctcatgactataccctgaattgaataacatgaggatatcttctccttttcttgtgtaagtgccaaagtgtgtgaataatttgtaacctttactaacaactttgtatatacatgaaaattccataatgcacataatggaaatatttgtgtttttaccagtttagcctctaaacataaatttaccttgatttttgctaggctaaacatgtgatttacatttgggtaatatacttatcatataactattcttgccttaattgttcctatgtgctttttttttttcttttttttctgagacagagtctcacaccttcgcccaggctggagtgcagtggcgtgatctcggctcactgcaacctctgccctctgagttcagcgattcttctggcttagcctcccgagtagctgggattacaggtgcctgccactgtgcccggctaattttttgtatttttagtagagacggggtttcaccatcttggtcaggctggccttaaactcctgaccttgtgagccatctgcctcagcctcccaaagtgctgggattacaggcgtgagccaccgcgcccagcccccatatgctgttttaacgattaagaactattcagtatttctcttttcaacatataaaaatgacctgtctttatgttttctgaactgaaagtgcatattttaaaaatcaaagatgtatttctttataaaaaacatcttacaatcattatgaaaatcacttcattgtgcagtctcatttttaaaaggtcttgggaggatgacttctttttctttttttttttttcttttgcaaggtgttaatgtgtaatacaaggtgaatcaggttgcctacccttaggagtttgtaattctaatactgtagactttcaggtatacaactaatgtgtattatagtacagtataattcaagtacagccttgtgaatcactaagatttcattgttcttgtttgaaggaatagtagttctaatgtaagggcaaagcatgatcaagttacatatagggcgacacatagttattcaagaatggcaactttaatgttttccagagcaaagggagtgggcattgtttaaggaagcaaaactagaagtggacattggtgctgattgtaaagggctctgagaaataggcagaggcagctagccttttccctagaggcttccaagagcctttgaagaccttacaccactggtgtgatctgatcacttatgtgttttgctaaggtagctctggtgtcaatattgggaataaatttgggacgagaagaattgtactaatgaggttattgtggttgagactaagttaaaaagtaggttccatgtaaagatacttccgtgctgattgaaaggaaggaatagatacgagagaaaatgacattagaacaagtaggactgtgctactgaatggatataaggtgtgaggaaagggggaaattaaagtgaattagactatgtataaaccaggggcccagaggataatcatgaaacagaggaagacttagtgtgtgtgctggtagaaggtagtggaggtacaatgaatttagttttagacctcttttaggttggtagaaatgggacatatacactattttgacttacaggcagttgcagttagtcaaggagatggatgaaaatgtaggaattatctgtgtaattgtgctaattgcacatgtgggaaggatgagatttattaagagaatatactgccagtagagtatagaatctcgaggaatgctttttaattaaatgtaattaagtatatgcttaactcatctgatttatattaggtgtgcaattacatgtttcttatctttcttccttttaaaggttaggtgaaagtaaaaaaagtggtgagagatttgagacattgagtgagaggtataggatcttggaaatgaatgatcattagagacaggttgtacagttaagtaacatgactacttgaaaaacattgtttcattggaccatgggaaggttgttgctaatcttcagtggagtaacttcaatagaattgatgagaaaggggaggcaaagtgtaatatgttattatgtaatatgtaatatgctttattgtctgatggtaataaagttcagaaagtagagaatagaattttcaagattgagatagagtaacttgaaatacctttatgtaaaagttgtgaagtaacttttgaacttttataaactaatatgactagtttgggtagatatggtagacttggaaaaaaaaaagaccacttcttgaataaaataagaagaaatactttgcttttacttatttgtccttgaacaaattatttaatttctgtgggtcctctttgcttaaatggagctgaacataataacctatttcagtgggttttcatgaagctgtaaagcttttaagacagtgcttagcatagcataaagtacttaacaaataatagctaatattactattgggaaaagtttcaatatgttaatattgtagattattacaagattattattgtaatatcggtagatggcactgatacctagctacagtatggatcacattctccttgtcaataaactcttgtttctcctaattacatgaaagacatttgatattgtttattaaaattgcacattccttaacgcagcagtccccagcctttttcgcaccagggaccagtttcaaggaagaccattttttcacaaacccaggttggtgggttggggaatggttttgcgatgaaactgttccacctcagatcatgaggcattagattctcataggaacatgctcgcatgcacacttcacaatagggtttgcgcttctatgagaatctaataccgccactgatctgacaggtggagctcaggcggtaatggtcacttgcccgctgttcacctactgtgcggccgggttcctaacaggtcatggactggtaccagtctgtggccccagagttggggacccctgccttaatggaacctgcttttcactgaagttgaaaatagatgtggcattctagtttgaaaaaagcagaaatcttgccctttaatccttggagtaaatgtaagtgtcatgagatatttgtcattgtgaaaacctgatccagtggacccagctgtggcatttagtagggtaagcccgtttgtgaaagtcagagagttctaggaagtctttgagacaaaatcttttaaacttgtcagtgatcatccttagtatctgcacatacatactggagctatgtaggttttagtgttgtaacattcaaatgatgtggtttaagtgaaagatcattatacattgtaaaatgtacgtgtatgagactttttttttaatctaatggaatgacattagataaaaaaaaatcaagtgatcaggttaggaattctctagttataccaagtattggtcaactctgtattgccatttgtgtaattaattggtgatgtggatctcctgtaatagtatggctctaagtgttgcaacaattaacagaggccttgtgtatttccacaaatcatcaagtttaattgggagggctttttgaaggtaaacaaagtttttgttgttgttgttctttcttttttctggaaactgctccaatatggacagttggcttagttccaaatagtttagacaagtagactttcacaataaggactggagttacatgcttaaaggagtgttgtaaagaagcataagatggtccttttatttgcctaatgtctattcagaaagaaaacgataaggtatttgatgtttgtgaataagctcgaatgagaattcaaatgtgtttgggggctgaactgtaagttataaaaattaggccaaaaccagagtgtatgtatttttaggaataatcatctgatttttagtgatagatatattgcttactcaaaactaatttagagaaagtatcaatttaagaatcataggtggggtggacacagtggctcacacctgtaatcccagcactttgggaggctgaggtgggtggatcacttgaggcaggagtttgagatcagcttggccaaaatggtgaaaccccacctccactaaaaatacaaaaattagctgggcatggtggcaagtgcctgtgattccaactactcaggaggctgaggcagaattgcttgaacctgggaggcagaggtggcagtgagctgagatcttgccactgcactccagcctgggcgacagagtgagactccatctcaaaaacaaaaaaaaaaaaaaaaaaaggaaagaatcatagatttttttttttttttggtattaagaggaacaggaataaaatataagaaacatctgtttgtaaatttttaatgaagagaaagaatatttgataaaacttactagcatttgctgtgattcattagtgttttttaggagttaattgtgtcgaatagttactgcataccaggaactatgtttagagctgtacatacattatctcaattaacccaaataacagaatacctacggtttacagaaatagaaattgattctgcttctaacaggtaaaattgaggttcacaccctgggcttttggactccagaacacttgctatttctagtacacaataatgaaataatcacagctgtagagatcatatttcaaaatcttatagccaaaagtcactctttaagtattataaaatactgaaaaaaatcctacttttaaattgcattaaaggttttgatttagaagtataagcatctcttctgtacttggggctttggttccaggacccccaggtataaccaaaatctgagaatacagaagtcaaatgttggccctatggagcttggcatacaagaaaagttggtcctctctatgcatgggtttccctgtgttttctatccacattcagttgaaaaaaatgtgtgtttatgtggacccatgcagttaaaaaccatgttgttcaagggccagctttacttcaactccttgttacttgtgaatatcatgccaacggaattatttttttctctgaagatgctttttcacggatgcctctcatgaatggccttattggatccagtcctcatctcccacataattctttgccacctggaagcggactgggaactttctctgcaattgcacaatcctcttatcctgatgccaggtacaagccttattttctatggaaacttaaattgcactaatttctgtttgatttatatataaattagtctgcttaaatgattgtgtatgatattattgtatgttgcgtttattgtggcttttgctataaatatgttacttttaactgttttgtaataggttttaatgaaagctatacttgaacatatattaagaagttattttatgttcataaagtaaagatatttattttttcccagggataaaaattcagcctttaatccaatggcaagtgatcctaacaactcttggacatcatcagctcccactgtggaaggagaaaatgacacaatgtcgaatgcccagagaagcacgcttaagtgggagaaagaggaggctctgggtgaaatggcaactgttgccccagttctctacaccaatattaatttccccaacttaaaggaagaattccctggtaagccatgaatatattatttctgttttaccaacattttcacatgtgcaataccttttttttttttaactgcaatagaaaggtagcttaactaatttttgtctatgatgacccacaacatgaagattccctagatgtctagaaacatcttgcattttactttgtcctagaccctgcatccatcctcatatttcccaaaaattagtttcaattagtgaaatggtccgtttttcagctcctagcagtacttattaatatgcagaaatccgtgttatgtgattctttaaaaaatttctagaacccaaactatcatttaatcaaaaatactgctaggctaaatcagtgaatcctaaatagtgtttttatgaaacgaattcaatattgtcttcccttcttcccctctcactttccctgactgcccagctattaccactgcctcttgaaaaaaacagatgataatagtacagtttgtgaaaattctgattaaccagtgaatgagaaatttggattaatgaaatgtcaattattgaatatatgcaagcaatgcggttttattattttgagttcatggtatcagacaaactaggattgaaaaagttattcaaactcagttttgcaatagtttcccagctatctatcaatacacaaactcttaaattactagaggggtacctggaagtgacttttcatttggatgacccctgtatttaggtacctttttggattggcgtcttcatgggactttattcattatgtattgtaataaatgaaatgctttttatctaacaatagaaatcagtggtttgatgcagggagacctgtgaaggcagtatcccattcttcagccactttctttccatgcttacatttgctgtttatgaacgtacatgggtatgttgtcattttgtgtcagcacaaattgtccttacagcagagctgtaacttttttaaaagtaattttctttaataattttactttgtgattcaagaacctcatgaaatactgtgttaaagctgttggtctgtgaactgatttttcattttcattggctttttggaagcttgctttctttttgtaatgtggaataaataatttctgtatttatcattaactgttgatcttacccaggcttcttcattttgtataccgtcatgacactgagtttcatataaatggtttgaactcattacttttccatgtgtttgttgtccacaaatgctagtgagatgcttatttatgactttgtttacttctggtaggtcaaattgatagatttctgtttagcacagatgttttacaaacttgtactttggttctggtggtgtcttaccaccagagggaatttattatgtctggcttgcatttttgctactttgtcccttgaatctaaaaacttcccaactttacaagctacgttgttaataaggcagcacttcatttagaaaacgtttgtttggcctacagtgtgccacgatctttgttctttgtaaaaaacttaatataggtctatgacctcatgagaatacggcctgaataagattaactgtcagcagttcatcaacattctttattacaacacatcattagcatggctctgagaaagtgttatactctgttcttttgttgcagattggactactagagtgaagcaaattgccaaattgtggagaaaagcaagctcacaagaaagagcaccatatgtggtattttaagaaactcctctatcttttaaatatttaaatacagtgcttgaaccttatttgtattaggttaataaaaaacaaatttccatttcagaaaatgcttgttagtacctgtacaacaagcaactttatttttaaagtgattttctaactccttatgtcttaatagagagtgtgacatttttataagcaagttaatagaaccaaaacgttgaagattgaaaatcagctgttttaggggggaaggagtaattcatttcactttaaaattgttttatctcttcagcagaggtacagttggccgtctgtatccatgagttctatatctgtggattcaaccaaccatggatcaaaaatattttggaaaaacatctatactgaacttgtacagactctttcccttgtcattgtttttaaaacaatgtaacaacgatttacatagcatttatattgtgttaagtattacaagtaatctaaagatgacttaaagtatacaggaggggccaggcacagtgacccacacctgtaatcccagcagtttgagaggccaaggtgggcagatggctttgagcccaggagttcaagaccagcctgggcaacatagccaaaacctcatctctataaaaaatgaaaaaattagctgggtatgatggcgcatgcctgtagtctcagctacttgagagacttgagaggttgaggcttcagtgagccagaattgtacgactgcattccagcctaggtgacagagcaagaccaccctgctaggtcaaaaaataaaaagggagaaagtatacaggaggatatgtgtaggttatatgcaaatactgtgacattttctataagggacttgagcatctgtggattttggtatctgcagggaatcctggaaccaataccccatggatacagagggacaactgtactaaatttggagactggattggcatgcctcagtgtcttccacagtcacctcttttcttgttaggtttcatagagaatctttgtgcatcttgaaagagaaatatttagacatgtttaaagagtttttgacacatgatctttgccatgaactattaggtaattttataagattcgcagttcatatggtaaattattttctcccaaagagccaaattaagattgtcagctggaaccaaatccttgctttcgttttaaagcatattaaatctgtattattgttggaaaatatatatagttattttccagcttgttccccagtgcacatattttcagttacagtgattattttggatagagcatatatgtgtgtatatgctctatcacatatatatatatagatgtgttaatatgctgtgttttattttgacttgaattaggtaatgacagaatttttaaatttttaagtgatttctttaatgatacgtttcaaatatccagatttttttttttttaagactgattggatatttttccttttttctaaatttttttttttttttttttgagatggagcttcacagttgttgcccaggctggagtgcaatggtgcgatctcggctcactgcaacctctgccttccagattcaagcgattctcctgccccagcctcccaagtagctgggattacaggcatgtgccaccatgcctggctgatttttctttttctttttcttttttttgagacagagttttgctcttgttgcccaggctggagtgcaatggcgcaatcttggctcaccacaacctccgcctcctgagttcaagtgattctcctgcctcagcctcccgagtagctgggattacaggcatgtgccaccacatctggctaattttgtatttttagtagagatggggtgtctccatgttggtcaggctggtgtcgaactcccgacctcaggtgatccacccgcctcagcctcccaaagtactgggattacaggtgtgagccactgcgcctggcctaattttgtatttttagtagaggtggggtttcaccatgttggtcaggctgatctcaaacacctgacgtcaggtgatccacccgccttggcctcccgaagtgctgggattacgagcatgagccaccatgcctggccccagccccttctttctaaattgaaggagacataatttctaaggatatgttaagaaaactaggagctaaaatattaaatcacacctaggatctttaagcttaattcaaatacatagaaatatatcctcaactgataggtactatgcactgtaaagagagaagatgagttagtgtccagatccttttttgggaggtgccgtaagtatttcagctattttacctgacttttttttcttttatttgagaaagttcatgatagttttattttattccttaaaacatttaacataatctgggaaatttttttctcttcttttgtcaaagcaaaaagccagagataacagagctgctttacgcattaataaagtacagatgtcaaatgattccatgaaaaggcagcaacagcaagatagcattgatcccagctctcgtattgattcggagctttttaaagatcctttaaagcaaagagaatcagaacatgaacaggaatggaaatttagacaggtatggaatttttggataatctactttttgaagttgcatttttgttttgagaagggaggtctttgcattattattttagaatatagttcttagaccatgaaaatttgatttaggatagacttgtttctcttttcagtaaaatatatttaaattgatttgagaaatttattgaaatattataaacaatatactgccctaggcacaaatggaacataccatgatgagtaatttctcttcttcaggaattcataatctaatatgggagcaatctggtagcgctgacatcaaacaaattaactttctgttgctttttccccccatgatggtagttttcttccttaacctaaatatgattgctttttcttttctattttaatagcaaatgcgtcagaaaagtaagcagcaagctaaaattgaagccacacagaaacttgaacaggtgaaaaatgagcagcagcagcagcaacaacagcaatttggttctcagcatcttctggtgcagtctggttcagatacaccaagtagtgggatacagagtcccttgacacctcagcctggcaatggaaatatgtctcctgcacagtcattccataaagaactgtttacaaaacagccacccagtacccctacgtctacatcttcagatgatgtgtttgtaaagccacaagctccacctcctcctccagccccatcccggattcccatccaggatagtctttctcaggctcagacttctcagccaccctcaccgcaagtgttttcacctgggtcctctaactcacgaccaccatctccaatggatccatatgcaaaaatggttggtacccctcgaccacctcctgtgggccatagtttttccagaagaaattctgctgcaccagtggaaaactgtacacctttatcatcggtatctaggccccttcaaatgaatgagacaacagcaaataggccatcccctgtcagagatttatgttcttcttccacgacaaataatgacccctatgcaaaacctccagacacacctaggcctgtgatgacagatcaatttcccaaatccttgggcctatcccggtctcctgtagtttcagaacaaactgcaaaaggccctatagcagctggaaccagtgatcactttactaaaccatctcctagggcagatgtgtttcaaagacaaaggatacctgactcatatgcacgacccttgttgacacctgcacctcttgatagtggtcctggaccttttaagactccaatgcaacctcctccatcctctcaggatccttatggatcagtgtcacaggcatcaaggcgattgtctgttgacccttatgaaaggcctgctttgacaccaagacctatagataatttttctcataatcagtcaaatgatccatatagtcagcctccccttaccccacatccagcagtgaatgaatcttttgcccatccttcaagggctttttcccagcctggaaccatatcaaggccaacatctcaggacccatactcccaacccccaggaactccacgacctgttgtagattcttattcccaatcttcaggaacagctaggtccaatacagacccttactctcaacctcctggaactccccggcctactactgttgacccatatagtcagcagccccaaaccccaagaccatctacacaaactgacttgtttgttacacctgtaacaaatcagaggcattctgatccatatgctcatcctcctggaacaccaagacctggaatttctgtcccttactctcagccaccagcaacaccaaggccaaggatttcagagggttttactaggtcctcaatgacaagaccagtcctcatgccaaatcaggatcctttcctgcaagcagcacaaaaccgaggaccagctttacctggcccgttggtaaggccacctgatacatgttcccagacacctaggccccctggacctggtctttcagacacatttagccgtgtttccccatctgctgcccgtgatccctatgatcagtctccaatgactccaagatctcagtctgactcttttggaacaagtcaaactgcccatgatgttgctgatcagccaaggcctggatcagaggggagcttctgtgcatcttcaaactctccaatgcactcccaaggccagcagttctctggtgtctcccaacttcctggacctgtgccaacttcaggagtaactgatacacagaatactgtaaatatggcccaagcagatacagagaaattgagacaggtaaacacattgtatgttctcagttttaaatgtattatttgaggaagctgttcatttcatcaaactgagtaatttctacacaggagttaatgttttattttttttattctgtagagtttgtcatactgcaaaaaagaaaaatgaaattgatgaaattaacaccagtttaatttattctgtatctgatttcagttttcacgaattcgcaggggaatccttaaatattaaagctttgttttgtgatagttgtctggcaaggaaaaggacccaaatcatcaaattatttttcctaatatattgaatagttaaatgtaactggtatttcatcaaactttgaaacattaccatagccacataatgaaagtatcaggatttaaaaagccactaacctgtcaggcacggtggcgcatgcttgtaatcccagctacttgagaggctgagacaggaggatcacttgagtccaggaatttgaggccagcctgggcaacatagcaagatcccatatctaaaaataaaaagccagtaacctttaaaaagccattaattaccacaaatcccagtgatttttgtttcttcccatttagcggcagaagttacgtgaaatcattctccagcagcaacagcagaagaagattgcaggtcgacaggagaaggggtcacaggactcacccgcagtgcctcatccagggcctcttcaacactggcaaccagagaatgttaaccaggctttcaccagacccccacctccctatcctgggaacattaggtctcctgttgcccctcctttaggacctagatatgctgttttcccaaaagatcagcgtggaccctatcctcctgatgttgctagtatggggatgagacctcatggatttaggtaatgcttttaatttcctgccgaatttaaattgctattagaagagggaaacagagctgggtgtggtggcttgtgcctgtaatcctagctactagctgaggcaggaggattgcttgaggctaggagtttgagaccagcctgggcaatatagtgagaccacccccccccccccccaacctcttcaacaaatttaaaaattttttaaaagaaatagacaaatgaagttagtattaatcaggaagctgttactgctttctacttctttctcccctttgaaatatatataatctgctatttagtgctaatgagaggtcatagacatttttttcctctaagaactctacagactctgaaaacattacctttgtttttaagtattaactgtgttagcattaccttgcacccttaatgatgcagtttatcatatgacatcctcaaaatgtagctattctgcgtaggcaaagcctcctacgatgtgatgagacttgtcctctctccaaatttctaccttttaactttacattctaaattaattttaggctgggcgcagtggctcaggcctgtaatcccaatactttgggaggccgaggtgggcggatcacttgaggtcaggagttcgagaccaacctggccaacatggtaaaaccctgcctctagtaaaaatacaaaaattggccggctatggcggcaggcactgcacctgtattcgcggctactcaggaggctgagacaaaaggatcacttgaacccaggaggtggaggttgcagtgagccgaggtcacgccactgcactccagcctgggagacagaacgagactctgtctcaatttaaaaaataataataataaattttagagatttccgaactgaaaggactttccctttaggaactttccatggtgagatagggttgtaagttagtggtgatgaatcataagaatgtttcctttttcaaagtggctaaagtcaaagccaaacctatgccctagttataataaggaaatagttctttaagatatgctttttagttttatgtcttttagtcttatatctctacctccatgttatattcttttagtttccttttcttctaccttagttgtaatttatgcctctttctgcattttatattttgtgtaagttgcctgtaatcttactcttaatttcccttttttcttccaccttgttataatttatgcctcttgctatgctttgtattctgtgtaagttgcctgtaatcctgtctagaaggaagtacaatataaaatagtccaacaatttatacatttacttaatctttatagatgaggcctacttgtccttttctctaagtttattctatcccatcatcaaacctgtgcctttgtagtctcatgtactgaggcctgtaagtccctcaataggtatgaagacctatcttcattcaaacatcatccccgaatcagcttcctccatcgaacctccctaaatatagataaaagaaactcttcctgaaaaagtccagtagtattgttcttatctctgaacaattgatttcatctgcttggttgttcttcctttgtcttcatttttgttatctgttaaatcttaagcctttagagctcagatatggtgttcattataggattcttagcaaaatcttacttgcatatgaatactgtaaatactttttaatggtgatagctttgcttttgtaagtcatagtatttggcaacattttgtatgtacagtttaattgaagacttttctttttttcaacttaactctaaatttaacataatacctatttgctttttttttttttttttttttttttttaaaagatttggatttccaggaggtagtcatggtaccatgccgagtcaagagcgcttccttgtgcctcctcagcaaatacagggatctggagtttctccacagctaagaagatcagtatctgtagatatgcctaggcctttaaataactcacaaatgaataatccagttggacttcctcagcatttttcaccacagagcttgccagttcagcagcacaacatactgggccaagcatatattgaactgagacatagggctcctgacggaaggcaacggctgcctttcagtgctccacctggcagcgttgtagaggcatcttctaatctgagacatggaaacttcattccccggccagactttccgggccctagacacacagaccccatgcgacgacctccccagggtctacctaatcagctacctgtgcacccagatttggaacaagtgccaccatctcaacaagagcaaggtcattctgtccattcatcttctatggtcatgaggactctgaaccatccactaggtggtgaattttcagaagctcctttgtcaacatctgtaccgtctgaaacaacgtctgataatttacagataaccacccagccttctgatggtctagaggaaaaacttgattctgatgacccttctgtgaaggaactggatgttaaagaccttgagggggttgaagtcaaagacttagatgatgaagatcttgaaaacttaaatttagatacagaggatggcaaggtagttgaattggatactttagataatttggaaactaatgatcccaacctggatgacctcttaaggtcaggagagtttgatatcattgcatatacagatccagaacttgacatgggagataagaaaagcatgtttaatgaggaactagaccttccaattgatgataagttagataatcagtgtgtatctgttgaaccaaaaaaaaaggaacaagaaaacaaaactctggttctctctgataaacattcaccacagaaaaaatccactgttaccaatgaggtaaaaacggaagtactgtctccaaattctaaggtggaatccaaatgtgaaactgaaaaaaatgatgagaataaagataatgttgacactccttgctcacaggcttctgctcactcagacctaaatgatggagaaaagacttctttgcatccttgtgatccagatctatttgagaaaagaaccaatcgagaaactgctggccccagtgcaaatgtcattcaggcatccactcaactacctgctcaagatgtaataaactcttgtggcataactggatcaactccagttctctcaagtttacttgctaatgagaaatctgataattcagacattaggccatcggggtctccaccaccaccaactctgccggcctccccatccaatcatgtgtcaagtttgcctcctttcatagcaccgcctggccgtgttttggataatgccatgaattctaatgtgacagtagtctctagggtaaaccatgttttttctcagggtgtgcaggtaaacccagggctcattccaggtcaatcaacagttaaccacagtctggggacaggaaaacctgcaactcaaactgggcctcaaacaagtcagtctggtaccagtagcatgtctggaccccaacagctaatgattcctcaaacattagcacagcagaatagagagaggccccttcttctagaagaacagcctctacttctacaggatcttttggatcaagaaaggcaagaacagcagcagcaaagacagatgcaagccatgattcgtcagcgatcagaaccgttcttccctaatattggtaggagttttcttgagtctcaacgtatattactatgggtattagagtggcatgcgatatgcttataagattttattattagaattacagttggaataaagcactgagtttttctattcctccttgaggagtttgtttgttttgttttgagacggagtctcactgtgtcacccaagatggagtgcagtggcgcgatctcggctcacagcaacctccacctcctgggttcaagtgattctcctgcctcagcctcccgagtagctgggactacagacacgtgccaccatgcctggccaatttttgtatttttagtagaggtgcggggtttcaccatgttggccaggctggtctcaaactcctgacctcaggtgatccgcctgctttggcctcccaaagtgctgggattacaggcgtgagccaccctgcttggccctccttgagctttagaatgaaagcagttggctgggcacagtggctcacggctgtaatcctagcactttgggagaccgaggcagacagattgcctcagctcaggagttccagaccaacctgggcaacacaggacatggatgaagctggaaaccatcattctcagcaaactaatgcaggaacagaaaaccatacactgcatgttctcactcataagtgggagttgaacagtgagaacacatggacacagggaggggaacatcacacactggaacctgtcgggggtggggggctaggggacggatagcattaggagaaatacctaatgtagatgacgggttgatgggtgcagcaaaccaccatgacatatgtatacctatgtaaccagcatattctgcacaagtatcccagaatttaaagtataataattaaaaaaaaataacaaaaaattagctgggcatagcagcgtgcgcctgtagtcccagttattcgggagacagaggcaggagaatggtgtgaacccaggaggcggaagttgcagtgaggcgagatcgcaccattgcactccagcctgggggacagagtgagactctgtctcaaaaaaaaaaaaatgaaaacaacgaagagttttagattctttccaggtaaattaagagattcaaaactgagttacaaacttccctcaattctattatttatggaattgtttaatagaaactaattgtcttcttagttcctacattccaaccattgttgccatatgttttcagtcatggaaggatgaatttaagaaaattatgatggaaataaagcttcttactgtccttttgtgtatgacaaatgcttggcgattttttgctatataaacctctttaacttgtttctaatggtttactgattctaaaaacaacaaaagcaatgcagtcaaaatgcctcagtgcctctaagaataagaattagcaatcaaagggcacgtgtctaagcagtgtgccttattctaaataataaaattgacattccattttatatatccccaatttcatcattttgctccctttttttcatttagatgcaaataggttttttcgtagtagcttcttattgagaggttatacccttaagaaattggtgcatttttcttttaagagtgataactaatttagtagaattccttagtattgcaaattcttatttgtgatgttatatttactaaagaagccattctgattagcattgcaaaagtttggatgaaaggaaattaattgcattgctttagattattgcttataatctcccttaaacttgactttttgttttaattcctgcaggactaaggtattaaagcatgattcagttaaggactactgagatgcgattaaacccaggataaggttgccatctcagaaatctgtaatgattattaaataataaaatttaagagcttgtaatatttgaattacttcttagtgtacgttgaactaattactatgaaataagtaactttatatttcttttctagattttgatgcaattacagatcctataatgaaagccaaaatggtggcccttaaaggtataaataaagtgatggcacaaaacaatctgggcatgccaccaatggtgatgagcaggtaggtggagtggctgcttgtttctactgggcatctagacattcatgaaatcattactagtttttagaaaaaacatacagaaaatggaaagcccttgtctaggaatgaacaacactatttaagttgtcatggcatcagctcgatatgatcagatacaaaatgctataccaatttaagaaattagtgtaagaaccagtttaagagcattagtctcaaggatggtaaatgtaaaacatcttaaaaagatttggaagattggatttcctgattactcaagtcaaagtatttaggtctgtgctcttttaaatacctttagaattgttcatgttatctaagatttttttcagttaagacactgagtgattaaagcaattataaattcagttctaaaataaaatgttcccaaaccggttttgaatcagaaaaagaaagttacaaggaatagataagaggacagttggaagttggagttacagagtttgtcttttctctcttaggagaaaaacagaaattacgcattaaagaagacagtaggggttatttcaatatctgaatttttgaaattatgccctctaagggttgttaaccacatggcactgtttcttaaattttgatcatggaccaccatgagaattatggggtaatttttttaaaatgcagattattttgctctactgcagacctactaaataagaatatctggagatggttgcctgtgtgtctgtatttttagcaagcgtcatgaatgagtcttacgtgtattactatatgagaacctctgtcaataaagtaagcatagagcctcaatttagtctagttatcttgttgaaaaacttttatataaaaaatgtggatgattatagaattgaatataaaatttgcacgaatttaagatgtatatatttcaaagaaatttgaattcttaagggtataattcttttcaattgttgagatactttggacatggttaagaagcatttttgagatcaaagtagagatagtggtttccaatgattttcattattgagcaatatttattaacactatttctctatcatagagattcctaactgttttatgtcttgaatatttttggattccagtgaagcctttgaaattctcagaatgttttatatgcagaaaatttaagacatagcattacgaaggaaatgattatacttgaaatatagttattaaaatataattaaatttatgtatatatgttccttaaagtattaacaaatttagcaataaaccataatttgaaagtaatgatgaacataactaatctattaggtgcctgcaacactcgataggaaaataatctgtcttctattggtgatagttgtggtacttgctaataatattgtagtttctatgtatattcaaaacaaggaaatgctgagttttatttactacttagttttgttttggtttttgtttctgagacggagtttcgctgttgttgcccaggatagagtgcaatggctcactgcagccttcacctccaaggttcaagcgattctcctgcatcagcctctggagtagctcggatcacaggcacgtgccaccatgcgcagctaatttttgtatttttggtagagacagggtttcaccatgttggtcaggctgttcttgaacttctgacctcaggtgatccacctgcctccccctcccaaagtgctgcaattacaggcatgagccactgcacccgaccagcacttagttttaaatatggacctcagaatttgaggcctttcagcatctgatgctcttttagcatcatgcatctgccggttagatacattagtcatgtatcaggtatatggcttagtattctactgactgctttttagaaatggaagtgatagtcccttcttagagtagtgtgatatgttgagttaggatgatagaccatgtgtgatattcagattagaagatcatttagaccagacctgtagcagtgggtagggtgacagatcaatgaaaaacctgagtaaaaaatttaaaaacatattctatatcctaatagtacttaaatagtaatatacagcttttggaatacatttttaaaattgtatgtatatcttgatacgttaaagcatttgataatgccagaggaaatactttcatgtaagcagtaatgcttctgtgaagtttttatagttttaattagaatgagtaacatttctctaaacacgtttaaccatgcagactgatcttggtcagtcgtccatttttgatttgctttaacattagatatagaaatgtatgaaaatgtatgaaaattcttaaattgggaaatgtcttttgttttagaatataaaataactaagctctcaattagtttttaacacagactggaatgagaaaacatttccttagagttcgttataaaactaaatcaacttatttttattctgaagtcttgaattcattttatcgtaaagtggagtgaggcacataatagagtaaaacctctagagtcagcctagctggcttcttattgcagccctactagtccttgtggggaaggttacggaatatctctgaatcttactttcatcataagtaacatgagggtgctaagagcacacttcatcgaattacagtgaggatcacatctgcccagtacatgaaaggtagggctttagtgttttgatgaagaagaaattgccactgttcttctctggaagagaaaactgttaagcacctaatacagtttttaattaatattaataatttctaaacgctcatcacttgatacttgtgtaccctgttttgacaggttcccttttatgggccaggtggtaactggaacacagaacagtgaaggacagaaccttggaccacaggccattcctcaggtaacactgcctgtaatgagtccctctagaatgcacgcttttctgtttcccagcaaactcatgctttagagtaagtcccctgctagagagtagtactaggtttgtgcagaagtaaatgcggatttcaccatatgccatttgccagtggcaaaaaccgcaattactttttcaccaacctaaatagtagccttatctatcagcacagccaaaagtaaccaaaaagacactttactgctttttaaacaaaagacaaattaaggttaaaaaaattggctgtgatttctgaaaaggatttatatacttacgggtaaaaagtcacttgatggcaaaaccacacgctcaggacttttggttttatttttatttacttatttttaactccagaaggacattttcatgtcctgcattttagaattaaacccattatatttaaaatgtaaaacttctataaatactagaaaatggctgggcacggtggctcactcctctaatcccagcactttgggaggccgagatgggcaaattatgaagtcagcagtttgagaccagcctgaccaacgtagtgaaaccccgtctctacaaaaaatacaaaaattagtcaggcgtggtggcgcacacctatagtcccagctacttgggagactgaggcaggagaatcgcttgaacccgggaggcagaggttgcagtgagccgagatcacgccactgcactccagcttgggtgacagagcgagacttcatctcaaacaaacaaacacagcaagtagaaaacaatatgctatatttgttttttccttttttcttcccatccttgttgaaagatatgctatatttttaatataatatcaagcagtatctggggaagtaaaactcatgcagtatttttgtcagtgattttttttttataaagggagctacctactataatgtatgtcctgttttcttccttgccctgccagttatgctttagatttattatgctgataattatattcttctcattattaaaagaggaaacagaagccatttgatataatgggaaaagcatagcctttatagctgagtttttttaaagaaattatagttccactatgaatttactgtgcaactttgggcaaattctttagcctcttgttttttaatatgtcaaatgttaaaccaactgctttgtagtattgtgaagattgcacataatacattctggctgctagtataagtttataattattaccttgtatacagctcatgttaaggagaacttgtgacaactggataaacatttttcaacattaatttgttaggtgattatcagggacttgtgagattaataactgcttgttcagtcacctggaagaaataagacttttaacttgaaaataaaacgaattaaatactttttatttattttttttatttttttgggaacaggatcctgctgtgttgcccaggctggcctcaaacacctgggctcaagcgatcctaccacctcagcctcccaagtagccgggactacaggcgtgtgtagaaaataagactaatatttttattaacgtatttttcttttatatttgtgcatgttagagacattagtttttgttataaataaccatgctgtggagtggcatttagtcaatctggaacttgtgtttgattgaagaagaaaccaggtaaacttcatcaaaaagtgagattttttatatagatctctcgcttagtattagcagtaattgatttgccctgtattatatttctgatgaataatcctttacctcaagcataattgttttcagccaaaatctagacagtatagtagttcagagatagtaataagaattcagaattaggttgccaccactaaattcactctactttttataaaaaaacctttaaaagatatcttaggaaattaaagggttttttcttccatttctttttttctttctttcttttaaagttttttcccccctttaactgaaatgtggaataaacatatttgtaaattttacttattttaggatggcagtataacacatcagatttctaggcctaatcctccaaattttggtccaggctttgtcagtaagtataaatctaataagttaatgttttctggggattgcttgtctgcactctatgtgtgctgttctaaacctgaagtgagtgtaggtacaccagttcaagcccaggtgccctcctgtcttattaaacatcactgccctattaggcaactcttcttcaaggcgtgtgttttcattgcttttttcactgtgcatgaagaattatagttacagaaaagtattttaatacagaaaaaccatcttccccattctcttcaatattgttgctgtttttgtatacagattgggcactttacagtctatagaactaaaccacgttttgctctaagaactgtcttcctaagtgacaaggacactaaatgggaaaaacaaagggattatacttagcagtaagttgggttagcagcatggtgtaaaggtcaggtatgcaaggtgcccctgaatcctttctagttatttgcaggggtcccaaggtggttcaggatagtgtttaaagttctccccaaactgaacctttctgaaatcttcagactgtttagctaacttttttttcaccattatttttcattttgctcacctctgctctcctggttccagaaaccagaaaggctttccttgcggtaggtctcattctaccagaagcagaacttctgaaatcttgtgaaaaagcctgttcttaaaaaatgcccttcaaatttagtagactagatttcaagttcatacatgtactggaacttctgggtttaggaacaaacccaaagtctgaccttttgaaattccccctacattaattgttactataatttgaatacatatttgcattaaaaacaagtaaagaactataccaactggctttttctggctttattgtgcccattggctttggttggattcttaatgtatgacaatattctgttatcattgatgttattttcagcgaatgtccttcttagaaatgtatttattcatttctttgtcttgtagtgagtcaaaaaggtatattcagaatttcactacatacgatgactttttttttttccccttggactgggtatcaatgaagtaaagtgcccttaaagaataaagaagagaatattggtacaaaatgaagagatatagccatttggggagaattactggcagttgtaaaagtagaaaatgttttgcttggttaactattccctccccttattttaaaaaatataactacagaataataattaccaatgttttcaacttatggatttcctttataagtcatagactttaaattattccattctaaaacattctgggttccttttctctctgtttaggatattttttcattattaagaaataggaaagaacttataaactcaggaaaattaacatgggaagtgatttcctagtctatgcgctagaccttaatgggatatgtctttgtctcttcaaaatctgtaaaatcgtattcataaaatgcatgtataccttagtatgtagtttggcttgtgggttagagaatttgtttagtaaaaaaaaagaatttcattacataagtctgcttttccaagattggatttgtaatatttataagtgctaagttaaccagtatctcaagaatgtgcattctctggctttctcaattaaatatttttctaaaatctgatattttatcattacataatcgtctaatatttagtattgtgttttcaaatttcctattatgtggtcatggtgaaactacttccttacaaaatagatttgtgtaacttataatgttggactctttagaaaattaacacaactgaattttaatttttcctcagatgattcacagcgtaagcagtatgaagagtggctccaggagacccaacagctgcttcaaatgcagcagaagtatcttgaagaacaaattggtgctcacagaaaatctaagaaggccctttcagctaaacaacgtactgccaagaaagctgggcgtgaatttccagaggaagatgcagaacaactcaagcatgttactgaacagcaaagcatggttcagaaacagctagaacaggtaataaataggtttgcaaaatagaaactaccaacaattaatgagtagaatgttttggtgtgttgttcattagtgactttgactagtgattttttttgactagtattaaatggcattaaaagtacattgccaaaaagtgacagctctgagacctcttagtaactgcagccataacagctccagtcttttacttaaagtgacggtcacagcacatactaaataaatgacacaaaagagattgagtctcataatttcgacttcgaagaactattttcaactttggtatagttggagacgttatttttttctgcactaagaaatcactgcaaagaccatgtttctgttatacatcattgagagtattcgacttaactgaggaccgagctcatggggagatactgggtttagtttggaataagaattgggggcccagggagtatttttgtttacttggagttgatattattattatttcttaatgttttggtcttaaaatacattggtatgtcttatgtgaagtactgttccagaaaaatgaaatcattttgccattatcttctattataaaccagaagtttatcagaatatttaaactgaataatatactggaaaagaagaaacatgtaaaaattgtatttaaaataaaacaatagtagtgtacaaaatgggttcagagccaactcctaggtatatttacccaagtaaattaaaaacttaaggttcaggccaggcgtggtggttcatacctgtaattccagcactttgggaggccgaggtgggtggatcacttgaggtcaggagtttgagaccagcctggccaacatggtgaaaccccgtctctactaaaaatacaaaaattagctaagtatggtggtgtgtgcctgtaatcccagctatttgggaggctgaggcaggagaatccctgcaccaaggagtcagaggttgtggtgagccgagcttgcgccactgtactccagcctggcgacaaagtgagactccatctcaaaaaaaaaaaaaaaaaatgtgagtgctctataatgaacactgtaggaagcacttccatttacgttgtcttatctacatctttctgaaggagttagtattatccccattttacaaactgattcattgtaaaggttataaacactgtgtacacgtggccaggcacggtggctcacgcctgtaatcccagcactttgggaagccaagacaggcggatcacctgaggccaggagttcgagaccagctggccaacgtggcaaaactcgtctctactaaaaatacaagaagttagccaggcatggtggcaggtgcctgtaatcccagctgcttgggaggttgaggcaggagaattgcttgaatccgggaggtggaggctgcagtgagctgagattgcaccattgcactccagcctgggcaacaagagcaaaactcttgtctcaaaaacaaaacaaaacaaaaaaaatcccaaaaaatacccccactgtacatgtttgcttataactattagattagggatttggactcacgtgtcttatcttcaaaccacagctaccacaataatgtaccaacaataaggtgatcataattccagttgtttaaaactaggattattccagaatgaaaggtttcttttctctttaaatctactctctgggttcatgtttactgtaggttaatattcttgtaaagatatgtttaataaagtatattttttttagcactttcattgccatctggcatatttgtacaaggtcttttgatgagggcctaatttttgcatatccatagatcaaatcctatttagaagctaatacttgaaaaatgggatacatcatctattacatagttgccaaagatccagtataatcatattaagataagcagttgatggtaatgttttaaaaagtattataaaatatcatgggaaagacatggatgaccaccttatatatcccacatagtgttgtaggtgctttctgtactttcttactacttcaccaaccaatggtaatttctcagttctaaccagtaaactggccaggaaaaataagaaaataggagttacacaactgttgaagaagagatgaaacacgattatttgcagaaagtattagtctacctggggaacccaagaaaatactttgaaaaactattagaactcctgagtttagtatattaatatttatctaaaaattgaatgatgttgagagatatacacatccttttgcattccttctttccctagcttgctgaatgagatggtgaggttctccagaacatagtttgcgtcttgattgatatctggcctgtagtattgagcacattgggacacaaaggtttttggaatgaattaattaattgatattagccattatattaagagtctatttacagactattcaaaatacttcctcggagcttgtatagatttcagaaattataatttgagtgttagccattaaattgaaagtgttcaacaaatttagtctttttaatctgggtggggggtgtgatattcgtgctggtaattcatcttgtcttaaaatgttgtacaggccgggcgcagtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaatgttgtacaatttatatatttaagaaatgaaatcttaacatttaaatggttcaagtttgagttaagtctgttattctaacattgtatattgtaatttctaggacatcaaaattagctgcttgtgtaaccttttttattgtatattttttatgtatagtataaatagtatatatgagtttcaccataagattttaatattttactaaaccgtttttgatatttcatatgtgaagcacttttacagataactttataaaaatcctgttgttaaagagattgacagttgttagttaaggcttatcaattcaatttttttgtgacttttgcagttacccaagcaaaatatgtttgcttctgcagggccaaactgccctctgtgtaacctcaaccacagtcatcagccagtgttttacttcagtacctatgctgtatagaaatgagtaatgatgcattttgttattccagattcgtaaacaacagaaagaacatgctgaattgattgaagattatcggatcaaacagcagcagcaatgtgcaatggccccacctaccatgatgcccagtgtccagccccagccacccctaattccaggtgccactccacccaccatgagccaacccacctttcccatggtgccacagcagcttcagcaccagcagcacacaacagttatttctggccatactagccctgttagaatgcccagtttacctggatggcaacccaacagtgctcctgcccacctgcccctcaatcctcctagaattcagcccccaattgcccagttaccaataaaaacttgtacaccagccccagggacagtctcaaatgcaaatccacagagtggaccaccacctcgggtagaatttgatgacaacaatccctttagtgaaagttttcaagaacgggaacgtaaggaacgtttacgagaacagcaagagagacaacggatccaactcatgcaggaggtagatagacaaagagctttgcagcagaggatggaaatggagcagcatggtatggtgggctctgagataagtagtagtaggacatctgtgtcccagattcccttctacagttccgacttaccttgtgattttatgcaacctctaggaccccttcagcagtctccacaacaccaacagcaaatggggcaggttttacagcagcagaatatacaacaaggatcaattaattcaccctccacccaaactttcatgcagactaatgagcgaaggcaggtaggccctccttcatttgttcctgattcaccatcaatccctgttggaagcccaaatttttcttctgtgaagcagggacatggaaatctttctgggaccagcttccagcagtccccagtgaggccttcttttacacctgctttaccagcagcacctccagtagctaatagcagtctcccatgtggccaagattctactataacccatggacacagttatccgggatcaacccaatcgctcattcagttgtattctgatataatcccagaggaaaaagggaaaaagaaaagaacaagaaagaagaaaagagatgatgatgcagaatccaccaaggctccatcaactccccattcagatataactgccccaccgactccaggcatctcagaaactacctctactcctgcagtgagcacacccagtgagcttcctcaacaagccgaccaagagtcggtggaaccagtcggcccatccactcccaatatggcagcaggccagctatgtacagaattagagaacaaactgcccaatagtgatttctcacaagcaactccaaatcaacagacgtatgcaaattcagaagtagacaagctctccatggaaacccctgccaaaacagaagagataaaactggaaaaggctgagacagagtcctgcccaggccaagaggagcctaaattggaggaacagaatggtagtaaggtagaaggaaacgctgtagcctgtcctgtctcctcagcacagagtcctccccattctgctggggcccctgctgccaaaggagactcagggaatgaacttctgaaacacttgttgaaaaataaaaagtcatcttctcttttgaatcaaaaacctgagggcagtatttgttcagaagatgactgtacaaaggataataaactagttgagaagcagaacccagctgaaggactggtaagtgtaaatcataaaaacgacaacttttttcttttgttttaaattatacttacagcagattagtaccagcaactgtatttccacattattctacaacctttttattctaaaggaccattttttattttgtcatttctacctctctggaacccatgtttttacttatatctaaactatattaaataataatttgtttactattttttaaaaagcaaaggcatgtattgcatttcatatataacgtgatgtgtagcaactggttattaccacattgagttgatatgactaaagcaaagtaagtaaatgtctatgtactttattgtaaataagtgattaatttccattaacctctttaaaatgcagaggatagcccatgcacccctattaatacccttggcactcttagggataccacactgggaagctattgtgtggttacagtgttgtattgatacttaatgtaatgttacatgtagatactgttttgtagttttccatgtatcaattttctatcagttttaagttattaacatttaatttgctttttttttcatttacatgaagagctaacttgtaaatatacctttacaagaatctgtcccctttatttcagttaacttcattaagatagttccaaaactggagtttgagtcatgggaattggtctgcttaatagctcttgcctgtttatctttcagaaggtgcagtgccattaccagtgcattcataaagctgtccctagagagcttctcaaattggatttcattttcatattttaattaagggttgagtggtatatttagttgtccagttttttcattttaagattgttaatgaagctcatctttttgcaagtgttgctttttttcttgtctttgaccattcagtagagattgagtgttgacttgatagatttgtgtaatttttgtaaattttactggttatgcttttacagttgtcaccagtaaatataggcaactctccagcacagtctccatccactttctccaagacatcttataccctgaggagtactgaataacttgcagccttctgtctttttacccttctatgtataccacatgctgctgcttctgcctgttctgttctcccttcttatatacgtctggacaatatatttttatcttttgaaatgcagttcttgagtcatctttttccagatacctttctcacctctcccaatctcaaatatgtgttgatgctcgtgttctcacatagcgatttctgttgtaccacttaacattatttaaatagctccttgaaggacgtagactacattttgagcatgtttatattaaaatttgtgggtgtaagaatgtttaatggcatggggaacaaccacgtcaagtttaaaaagtagcccctccccccaaattaaagtgtgatttaaataaatatatagtgatttaaatatatataaatatatacatctatatataaatatatatataaatataaatatataaatatatatatataattaatttttaggttcttgccactcagagtgcagtccttggggatccgcagcatccacatcaggtgggagctttgtaacacatgcagaatctcccgccacacacctgcttctcagaatgtagacttaggaagatccccaggtgattcctgagcatctgaaggggagaagtactgctctaggcaggtgattctcaaagctaaagtgtgaggagcaccaggagggcttgttaaaccaagattgctgggctccagccccggtatttctgattctgcaggtctgggtgggaccagataatctgcatttctagaccagctctagatgctgctgccgccctggagaccccttgagagccacagaactagcctggagatgagcagtctaagcctgctttcgcctccctccatgagctaaaaatggcttttacatttttaaatggttgaaaaaaaatctaaggaagagtagtattttgtgacacataaaaattatacaaaattcaaatttgtccgtgaattttaaaagttttatttgaacgcagccaagctcattgatttatgaattgtttatggctgcttttgaagtacaagggcagagttgagtaattatgccaggggctgtatggcctacagaggcttacaatatttatcatctggctctttacataaaaatgttgccatccatgcgctaaactatttagaatataactggaaactaattttcagaaccgtcagagattcaatgcagaattcattacagtaagttcagctactataatcgtctatagcagagtactgctgttaaatttagaaataatggagcctgaaaatattcctgtgttttaaggtactgataggactacccttaaaggccttttcagggcttggcttattctcactttgtaatgataaaaataaagaaaaggtttatttgttatcatctacgttctctcccattgactttaagtatgtggccattatttttcagtcaaatacggttgtgaactaatttgaagaaccagtgttttttctttttattgttgtctggtgctatctgttctctcacctaagatgcataggctgtaaagcttttctggagcctgtgaattgtttcagcacacctcatatttcactagttcctaaggggaaccaaaaataactcaccaagaccactatgcagaggctcctatagccatctacaagcatttccttcccttctgcagtaagtaagcaggaataaggggttccccagccccagggaggtcagcatgaggggtaatgctttgccagaaagggctgtggccttactaatgagttctgctctttcctcaagcttcgcagcttactgatttccatactcgagaataacgtttgaagaaaaggatggtgtttttggaaaaccagcattgacaccactctatcttccctacttatttaataccttttagtgccatgttaggatgacgcgtcatagcttggcactgcatgaactaaaaaccaaatatgcaaattgttcacttattttttaccctttccaattacattagcaaactttgggggctcaaatgcaaggtggttttggatgtggcaaccagttgccaaaaacagatggaggaagtgaaaccaagaaacagcgaagcaaacggactcagaggacgggtgagaaagcagcacctcgctcaaagaaaaggaaaaaggacgaagaggagaaacaagctatgtactctagcactgacacgtttacccacttgaaacaggtgagggtgagtcatttagagcagcctcttttaaaagtcaaggatataggctgggggcagtggctcatgcctgtaatcccagcactttgggaggctgaggcaggtggatcacttgaggcatgagttctagatgagcttagccaacatggcaaaacctcatctctacgaaaaatacaaacatttactgggcgtggtggtacacgcctgtaattccagctacttgggaggctgaggcacgagaattgcttgagcctggatggcagaggttgcagtgagccgagattgtgccactgcactccagcctgggtgacagaatgagactgtgtctcaaaaaaaaaaacaaaaaaaaaacaaacaattcaaggacacgagagatcaaatgctaaaagacatctggacaaggaacctagtagactttttccaagcagaattgcaccgtatcctattggcatctgaaatttacggtaatacaaatggattgataggtgatagtcaagattttcttatgttcataaggagtagcctcagtaccaagaaaaaaatctgtcctcagtactttgttgtgactctgaatccaaagaaacacattgtgaattctgttctacacctttgtggttgttacagaaggtgggagacagttgctaacagtgctgttggtggtacccagcctcagttgatgccccagtttttgctgagcatagataagaaatatgtttttcttgttagatgcctggcagcattcatttagtacagagcttatttttaagtctcaaaggtctgtagtctctctcacttactccagcattttgatacttgaaaattttaagtctcatttttctgaagccttattcaacaaagttgcttcgggtcttagaaagttgagctacactgagttccttttatcatgtacattactcttaaatgtgttttttaatagcagctctctctgctccctctaatggaaccaatcattggagtgaactttgcgcactttcttccttatggcagtggccaatttaatagtgggaatcgacttctaggaacttttggcagtgctaccctggaaggggtttcggactactattctcagttgatctacaaggtatgtttctctgccaaggtgttgtcttgcttcatctttgggtaacatgtcagaattgatagagcttgtcttatttttgtatttagtttacatctactcttccaagttttattaaaacttaagttcagctacagggttaaaattttacctggtgaagtatttctagcataaacatttgaagttgtttttataggtaagaatacaaattgcaagaaatatctattatgtacttccatggtagtggaaatccttatttccttataacctttattaacacttaaaatgaattcaaaaatcattgtaaatggtggggatttaaaaaaagtagtagtttaccttgaaaaatgaaattaaacaattttaagtatatctaataatttaggtattaattacaagtaattcctagactattgtaggttttttttttttttttgagacagggtctcgctctgtcacccaggccagattgcagtggtgcaatctcagctccctgcaatctctgcctcccaaattcaagcaattctagtgcctcaacctaccaagtagctgggactacaggcatgcaccaccacaccctgaggtcaaggctgcagtgagcatgattgtgccattgccctctacctctagcttgggtgacagagcaagtctctgtctccaaaaagaaaaaaaaaaaactatcttaactcataagctgttctccaaccttattttatcatcctcatgaaattctttatctttgcaaaatttgtaatttgactttgcacttgatttgcatggtgttattggtagattccaagtctctccttgagagactaatcagtaaatgacaaattggtgataactgttaagctgggagaggtgtctgaagaggaactacattaatgatttagttactttagtagtagcattagtactgttgcttcttttaaaggtcttagtcaatccagattctcatatctcggatgtgagttgtattacaagtttaagaccagaaattcttaagtttttcatagaactagggcatatcttaatgagaacttaaaggatattttgataatattttgcaatttcttgattgcattttaaagttatccttcactagctataaccacgaaacttgaagaattgcataaataaaatcaggtagaaaggaaattagcttcttaatttcagagcttaagtagtcaagctgggtaaagtaagcaagttggtatgtccataaaatcacgagtatctgttccactaagaagcctcctggccttgtaggtattgttttcttggtgtgcaagatacatcttgattacatttctgtagccttgcttctatgtgcaaaaaattcacagaactacgttttagcaaggtcattgcatattcgctcagtagcatataatttaaattttttggtctcctgcagcagaataatttaagtaatcctccaacaccccctgcctctcttcctcctacaccacctcctatggcttgtcagaagatggccaatggttttgcaacaactgaagaacttgctggaaaagccggagtgttagtgagccatgaaggtatgattatagcctccaaatttcacacctcggagaaatgtgcctctgccagttgtgtattgtgaaatggcaatagaattgtaaagttctacccatttatcaatattgactgaatgtatttatggttttgtgtttttgcttttccagttaccaaaactctaggacctaaaccatttcagctgcccttcagaccccaggacgacttgttggcccgagctcttgctcagggccccaagacagttgatgtgccagcctccctcccaacaccacctcataacaatcaggaagaattaaggtacaggttatttttttctcaaataattcttagttatttcttcttttaaaaaaaataaatgtatgtatgtggcataatgtctttaggaatagcatgtaaaaacatttgaagagtacaatttggtgaataatcttcaggatttaaagtttataagacattgttaccattaaacataattagtttgcatttttttaagcctacatcatatagagagttaaataatctaatagacagttaagtattagattatttaatctaattaaataatctaatagacatgaaggtagtggaaaatctccatgcaacatatttcagaaatcattgtcctttaaagggtattaatgtgatttattgggtttattgttgtttgtagatgtctaaaatgaaagagcagaagttgctatatcagagaacgccgtcgtggaagagagtttaagaactgtctggggtttgatgtctttgtgtcagttctttaactgtaagattctaattggggagaatcaagttcccttagtagatgatcgctagccaactctttagatccagagggttcttacaacttcatcaaataattatctcttctttggaaaatctgcccactaccctctatttgatgagacatttatttaacctaagtcccttactttattaatggggaaactttggaccgaagtggagaataatctgtcccaattgaggatccaggtcctctttctactgtacctcagtaggccagcctttcttgggtctcctgcatgacagctacttctctgcgtgaggagtgggagacagcagttccacagggttgtggaacttagtctgagacctcacaattggcctggtagactcaaacttgaactcaacagaagggaccagtcttttgtttttctcacctcactttatcagttaagaaaaataagggccgatcaagtcaatggctaagttttctcccatcttgccagtgtaaagagcagcagtaggacagctgttttcccagtcaggtgaatgcaggtgtgaccattgcatatgtgttggacttctctttccttttttttttgtctttttaaagttttccttttttattgttaaatccaaccagcagctctttccttttcaagctgcaggagtgctgccctaggctcaacgatctgggattttgaaaaggtgctttcatgctctctatgttacatgctaatcagaacatcttcctctttggcaggtcttcaaactttggtgctgaagctttcgttaaaaggaaacataccatttaaattattttgtaactaaatattgttcttgtatttttttcccagtgtggctctgagctgattcatttgctgctcatcgtataggtgctgcccagagtatccttacagctgtattcacagatgtcagcagggttggtacaggaagcccccagtggtggatttgcagactttgatgtgtgtgtttatgttttttcaggatacaggatcactgtggtgatcgagatactcctgacagttttgttccctcatcctctcctgagagtgtggttggggtagaagtgagcaggtatccagatctgtcattggtcaaggaggagcctccagaaccggtgccgtcccccatcattccaattcttcctagcactgctgggaaaagtaagaacaacacttaaccttattatttccctttacactacgccaatttactaatgtaaatattttgattttgaaaatccattaacactattttcctcttttttttctctctttttaaaggttcagaatcaagaaggaatgacatcaaaactgagccaggcactttatattttgcgtcaccttttggtccttccccaaatggtcccagatcaggtcttatatctgtagcaattactctgcatcctacagctgctgaggtaaaagattaaatgacttcttaatgttaaacagtatgtccccaattttcaaagatgggtcaggtgtctaccataaaacacacacaaacaggatcactgaggataaagggtcagagagcagagctgatgctcactgcagacctctcagctgcctttgagtgccatcgtttgtcattgaattggtctcagcctacgtcaagtaaaaagggaaattagagctcacattttcttattaaaggatgtatactttagagaactctttttttttttttttttttaatagagacacagtctccttctgttgcccaggctggagtgcagtggcacagtcatagctcactgcagcctcaaacttactgggctcaagtaatccttctgctttagcctcctcagtagctgggactacatgtgtgagccatcatgtccatctcagaaaaaacttctttgtaactgttaacagagaagaaaattaagcaatgaaaaagaactttatcaacagtaatagttttgcagaagcaatagaaatgttcttcaagtagcatctgcttatatcaaacataagtaatttcctgaggattttttatttttttaactctgaattctgtgaagacatttcagtagagaccaaactagaagtccaatgatgtgatattttggttatcaacaaaatacagcagtagcaagacctttgtctgttcttacgggttgtgtcagagctggagggaagcccctggaagtaagctttctgaccacctgtaggaactgacggggtctgtcagatgttacaatatctaaaatagtttaatgtgttactagatatttaatgttaattggaatccctttatgaggatttctgtttataaatttctttttttggatattagttcgttagagctaatttttttcctgaggttctttaagtctaaataaaatttgttggattttcttagaatctatgtatcatgcaaagaggatttatcctaagtgtgtatttttcttcagtggttcactgttgccttctgggtgaataatacagcatttgcatttggttttagaacattagcagtgttgtggctgcattttccgaccttcttcacgtccgaatccctaacagctatgaggttagcagtgctccagatgtcccatccatgggtttggtcagtagccacagaatcaacccgggtttggagtatcgacagcatttacttctccgtgggcctccgccaggatctgcaaaccctcccagattagtgagctcttaccggctgaagcagcctaatgtaccatttcctccaacaagcaatggtgagctagtgagctttttgttaaccccaaatccattcctgattcaaaagttaagcttactctttgagatactgattatcttttaacaacggacaggtaacatgctggcgtatagtccttggtgaacttaccatgtgtgggtgttctgttttctgtgctgtgattttgacctctagtgctttggcctgtgtattctgtcatgctgtcaccaggggctatgtgagtgccagccatctgtgcaggctgccagaagaagcctgtgacgggcttgcccttgagcagcttttgttcttcctgtctcccaacccccatcccgctgcacctgggccacctggtacagatggggctggtgacctgacgtgggttctgtttcctgttctcctctgctttccatcctcacctacctcttgttttacctctgcaccagctctatagggcccttctcttcccacagaggtgttcatgccccccatctctgagaatggaacaacttccttagaccgaccatgatgtcgctttccttcctgcctcactggcaatcttacaggcgtgctcagtccaggccctggcttcctcctcttggcttctagctgttctgtcactttttccctgctcctttttgccttcacactgcacctgaatgatgctttctaattcctgagtccttatttaccttcttatccttggccttggctctttcctcatttctgactctgcaagtcacacttatttaagactcttatacatatgtcattgtatctttcataaaatgtttttttaccatcttaacctgcaagcaaaagtaatatctgtttccctctctgtcttactttgtacttagactgaatagtaatctctcttggtgacttagttttattagattcttcttttatactgccattgctttcccagctatttgagaataggcatgtttctttatttttgccctagtgtcagataatcgactctgtaaccattgcttagaagataaattttttttattaattaaagaataatgttaatgaaccatgttgtaatgagttgatactgcataatttttcaccatgtgccaccttgtgtcatcagtcagttttaattactaacaaaagttgattgcctttaggtctttctggatataaggattctagtcatggtattgcagaaagcgcagcactcagaccacagtggtgttgtcattgtaaagtggttattcttggaagtggtgtgcggaaatctttcaaagatctgacccttttgaacaaggtactttgctactccttttatgaccccacctcctacctccagcgaaaatgtccttggcagtgtctcttccaacatcagagagagacaccacttatggtggtgtgatggacacatgttcctggtgatggcaccagcgtatatcagatgtgcttgggctgaacaccaaagagctacaacaggctgttaaagggaatattatgaggactacgtatttttaaatagagtgaaccgtggaccacatagtttggttttatacatgtattttttccctagctaaattatcacatgctaaatattggaacatagtttcctttctactattaagataaagaaccactgtcacttttgaatataacataaaaataatgtatagatcctgtttttattaaattttgacttgttgagattcccacacatttctctttgcttttcaggattcccgagaaagcaccaagagggtagagaaggacattgtcttctgtagtaataactgctttattctttattcatcaactgcacaagcgaaaaactcagaaaacaaggtgagattaggataatctcagctgataacaatgtgtaacgagtgacttctgtgttctgggcatatgggagtgaataaagatgtgtccctgccttcatggagctctgtgtggggaatccaaagcaggtgctgacccggcagaggaggagagggtgtagggagccttgagtcgtgctactctttcaacttagttatttgacagaagtgggcagagttatgttttaaaagttcagtaaacagaacactaatattaaaatctttaattttaccagtttaatttttttttgagatggagtctcattctggtcccacaggctgaagggcattggcacctcttggctcactgcagactctgcctcccaattcaagcaattctcctgccttagcctcctgagtagctgggattacaggtgcgtgccaccacgcccagctaatttttgtagtttagtagagatggggtttcaccatgttggccaggctggtctcaaactcctgacctcgtgatccgcccacctcagcctctcaaagtgctgggattacaggtgtgagccactgcgcccggccgtaaatatcttaatattttaaaatcatttttattgatgttaccccaataggaaaacctgtttaaagataaaatttaagactatttgtgcattttaagagaaaacactttgctcacagtatggtgaaagaggtctgctttacttgattttatgtaatttgagtgtgtccaactaatggttgatacaaatgatatgtttataatcatgttttgaaggaagcttttcctgtacagtaatactgccagtcattcctccatccaggttattgctctggtatgtctttcacagaagaacattctgaagacttatttttaacaggtagttgtttgtagtatgcctgtaataaaatctaggctagatgacaaataaatttagatcttaaaatacatcagcctaaatgcaagaaggattttttttttcaccagatagtttaagttggtgtgcagtccctgcctgatttggtataaggcatgtcttttttcagataccttgtcaggattggggcatgtgaaaagagggcagcctgtgggttggtgtttattagtttatgatactctgtaccataaagtaaataagctattggagatttcccctcagctcaactgtttcagcagccggatcagagctgagaagcctcagagaaaagttagtatgattcatttgttgacaggggctccttccctttctgtaacatttacaccaattgattaaggctgagattaacagatgtgaattttagagtggagataagctctcaagaaacgatgctgcagcgttcttatttggttaaacaaaaaacactgttccattgtacaaattatattagctcttctgacagcattgtgagtgtgtgtgtgttttttctttttctggttttaatatagttagaaaggggattgtcccagaaagtgtaagagcagaatattctccagaattatggctttgtggaaaaggcctcgaaaggacgcggcacagctgccatcacccgctctctatccctgtgcaccttagagcatggtcagcttctgcggtgcatgagcccccagcacttactgctgactctccctctgcccctcaggtcacccatcctcttcagtcatactgctcagcttcttgtcttaacaagaattgctttccgggcttgtgaattatttttctttgtcatggtttctttatgttgcccaggaatccattccttcattgccacaatcacctatgagagaaacgccttccaaagcatttcatcagtacagcaacaacatctccactttggatgtgcactgtctcccccagctcccagagaaagcttctccccctgcctcaccacccatcgccttccctcctgcttttgaagcagcccaagtcgaggccaagccagatgagctgaaggtgacagtcaagctgaagcctcggctaagagctgtccatggtgggtttgaagattgcaggccgctcaataaaaaatggagaggaatgaaatggaagaagtggagcattcatattgtaatccctaaggggacatttaaaccaccttgtgaggatgaaatagatgaatttctaaagaaattgggcacttcccttaaacctgatcctgtgcccaaagactatcggaaatgttgcttttgtcatgaagaaggtgatggattgacagatggaccagcaaggctactcaaccttgacttggatctgtgggtccacttgaactgcgctctgtggtccacggaggtctatgagactcaggctggtgccttaataaatgtggagctagctctgaggagaggcctacaaatgaaatgtgtcttctgtcacaagacgggtgccactagtggatgccacagatttcgatgcaccaacatttatcacttcacttgcgccattaaagcacaatgcatgttttttaaggacaaaactatgctttgccccatgcacaaaccaaagggaattcatgagcaagaattaagttactttgcagtcttcaggagggtctatgttcagcgtgatgaggtgcgacagattgctagcatcgtgcaacgaggagaacgggaccatacctttcgcgtgggtagcctcatcttccacacaattggtcagctgcttccacagcagatgcaagcattccattctcctaaagcactcttccctgtgggctatgaagccagccggctgtactggagcactcgctatgccaataggcgctgccgctacctgtgctccattgaggagaaggatgggcgcccagtgtttgtcatcaggattgtggaacaaggccatgaagacctggttctaagtgacatctcacctaaaggtaacgtctgccgttcacatgctgtgcagtgctacttactctgatgtcaggctaatgaatgtattttgtcaattttccatgtttgtctcatgttagttttatattttataatgtgtatttttcatttacaaatgccaatgtttgtgttctcacaccttgctctctttgctatacagttgtctaaacactttcataatcaatatatctttgaacatacgagttggtgaggtaaatccgagaatgatttgtagataaaggttgcctgtcatttgcattggggacctcctttttctttttctttttctttttttttttttttttttttgagacggagtttctcttttgttgcacaggctggactgcaatggcgcgatctcagttccctgcaacctccgcctcctgggttcaagtgattctcctgcctcagcctcccgagtagctgggattacaggcttgcgctaccatgcccggctaatttttatatttttagtagtttttaattttgtatttttagtattttagggtttcagcatgttggccaggctgggctcaaactcctgacctcaggtgatccacctgcctcagccacccaaagtgctgggattacaggtgtgagccaccgtacctggcagggaccccctttttcttaaagtcagtttctagaaggcaggaatgacatctaaatcatactgtatacattgtcataagacaatgtataggaacatcagatattacgtaagtttagagatggaaattaaacacttagtttggacctccatggttaagtctagattgtcacttttgcttatgtagaaagtacacaaacaaaagtatgtggagctgctttcttaagtttagcacttaaaaaaaaaaagtctgaaaatactctaaagataattccaaagaaaatatcaatttaacattttaatttaaatctgaggggaaaggaacatagctatagacattaccaattagactaatcattttaaaatctggtatgttatatggccactatgaaagtaaatgaactgtttgcatgaatttcagttacattaagttttttcactttaatgtccttaatctattattttccccaaaatttaggtctttaaaaaaaattgctgccatttaataaacaggttcattagattattaccaaacagatttattagattattgcccaacaggatttatttggaaattagtaaatccttgtgagtggttattcttcattttgctcttgttttttatactgtatcctatttcctataaaaattatgtttttgtccctgtgtaggtgtctgggataagattttggagcctgtggcatgtgtgagaaaaaagtctgaaatgctccagcttttcccagcgtatttaaaaggagaggatctgtttggcctgaccgtctctgcagtggcacgcatagcggaatcagtgagtgtcttggtcaggctttgagattggaattgctttcctgattcagtgtgaccacttgaacacatgctgtaacatttgtggcactcttcagaaagtgactgagcctgtgcattaacccgtttctcttagaggaataaggcattggtgattaatcgggagagctcagccgtgttggtattcacccagttgaggtagttaaccaacttcaggttctcttccaggctggaggcaagcaggggtgaaggacaccaggcttgtcacatcttctgggtgtgctggatgggtgaggacactctcctcttcccttgcctttctgaagtttctcccacctcagaatgtcagtgtgcccatttcctgacacttgggtatttatggccactctcctgccctcttcctaggatgaagtcactagagggcagtagatcgcagcagcactgatttctgtcctctcttgacatttctttgcttaaaagattacaagcctgtttgtcagtgagtctaactgaaccatatctacacaatagttttagaaaattgtatgattctaaggcattgttttcaagaataaaaatatcattggtgtgttttctttggacaggcagaggaaaccccaaaagccactgagtaatgtgcctaattgttttctttggaatcgccctgcctaaatgatacttatcttttatgactacagagaaataaatttcacaagcaatgtattccagaaaagacctttaacatgtaaatgactttgagtaaagcttgagttaacacctatgctttatgctcccaggacatggagagcgataacctcatcacatcagagtcaaattgaaaggagtgagaaacgatcaagaaagaaaccatatagatgattttttaactgtttttaattgtaaaattccagacagagatataaaagttggcattaatacaggggaaagaactcaatgcgaatcattacatgccctgtgtttgtgggtattgtgtgtttcagtcaggccctgaaatcacacaagcgtgtatattggtcagccagtgtttgttgcatgggctaatctttttcttcaaggagcatttggcagggtttacctaagtttggctttgaaactgaatttgcatactcatatttaagtagatctacctgcaggccaatagtgttaacataagctagaagaccattttattatcggggaaaacgctgatgagttatttctgtcgtgggccatcctttgaccagcttgagattgtctgtagtctccatcagatggggtgactttgtgtctgctttgcttcttttcagcttcctggggttgaggcatgtgaaaattataccttccgatacggccgaaatcctctcatggaacttcctcttgccgttaaccccacaggttgtgcccgttctgaacctaaaatgagtgcccatgtcaagaggtttgtgttaaggtattttgttttaacttcacatagtacagcccagggtttctaggcgtattagtggtttcctgtgcttgatttgtctgctgcttacaaaccctgctgtctggctgtgtatgtgcccaactacataagagaactcgccgtgtgtctctgctaggcagctttccatgtatgtttctgtcagtaagaatctgaattaacctggttttgggcattactcagaggtatcttcagttttccttgtatttttttcctgttgatatgccattgtctgcaggcctcacaccttaaacagcaccagcacctcaaagtcatttcagagcacagtcactggagaactgaacgcaccttatagtaaacagtttgttcactccaagtcatcgcagtaccggaagatgaaaactgaatggaaatccaatgtgtatctggcacggtctcggattcaggtgaagaaatactttgtgtacaggaagtggagagacagggtggagtctagcaatctgaagctattgatgtccagtatgtgaaaatgatttcacatagctgcagggacagaaacgtgttttcaaaatcgtatcaaatcctgtcccttggtaacactagggatttaatatgtagtcttgggacttggtgattggcttccccaaagggaaagcagaccagtggaatccacatctttgcatcttgttgagagctcctgggaggcaggtagcattgtaatttgcacacactggatttgtggagtgctcagtagagctgtttcaagcacttgagagaaatacaaatgaaaatattttccaaaggtacaccaattttggaagttaccttatcttttggaagctaccgtttcatgaaatcagtgcatgttttttggtagactgtggactatcttacaagtaaggccgtgtataggctaagcatttaagtttacacctatagtccatacttcctgagctgcagacccaaatatccaaatgcctgttcagcatttttctccttggatgtctcagaatggaattacaaagctcttactttgtcaaacttgtccagctcctaaaccccgccatcctacaagctccttgctgagtgatgttaccgtttgtgtacattggcctcagtactgccagattaaacctaaagcatcatcgagttctgttttctcctaaaaattctctcagatccactcttaggtttaccagccctatcttgagccacatatcacttgcctgtaccactgcaggcctggctgtctcctcccatccagttccctctcagcagccagcaaagtatctttaccctataaactggatcagcgttcctttgtctatactcattcagattcttgttcctttgttggaacccttttactcctcactagaagtttgtaggatcttctctttattgatatttggacatttcacagaactacacctcagtggaggtctttttgttgattgctttcctcccttgatgagccctttcaacctggagcatcgtgaccttccgtctgagaaatgtgttttgtattcattcttttgcaagttctgcccctctgtttcctctgtgtttgcactaaaacccctgagattcaggatctcacagtgtggacctgagactagaagcagcagtgtcacctgggagcttgttaggatgtgcaggttcgggggccccagcccagcctcactgaatccagctctggaggtggggcctcctggatgattctcatgcatgtcagagagtaatttctgtcttatatcctttctccccttctgttctttgtttccttgtctctctgttctttctgagacttcctctactttatctgctaatctttcttgtctatttttagagattagctacgagccctttctgctcttgatcttgtttgatattttgtttttacattatgagtggagtatctgtgttttctctgctgttgcccctctctgttgagcctctctcggattctgtgggtgaattagtgctttgcctctactccttccagttctagctttcccctgctaagtcaattacttttcattttaaatagtccattcactcttatacccattcgtgttctcgaggagtgtgcttttactgtgattttagtgggtatcttaactgtgttcaacctgtcacctttaacctgaagcatttttgagagctctggtttctgtctctttacttatttcatcctgccaccctcccatctgtccacctccctggggatcccgtggatgatctaatatgtatcctgtttttctgtgctaatatcttagaactatatacacttttatgtacatatataaaaatggaatcatgttatatttatttttctccgtcttccttttctctgtaataatcagaggtccctctcgatcaactgacgtagcttcatttcattcttttgaatggttacctgatgttccatagtgttgatgaactgcagttaaaccattgcattactgatgagtgtgtatttgatttataatttttctcataacaaacagtgttgctatatcttgtacaaatatcacaatgaattaatagtttcactcctatggggtatattcccaaacgtgaggtttctgtgtaaaagcgtgtgtacttttcatttaaatagatattgccagttttctaaaaagtctcttactgcacacttcttcctgcagcatgtgagactgttttcttgtttcccatttgtagctggtgttactatttttttgtttagttggtctgataaatatagactgatgttaccttaattgaataggcagcttttcatgtccgccatttggatttgctttcataggaattgcgtattcatatcctttgtccatttttcaatttttagcagtttacactattcagaattttcccctacaaaatatcctttgcctaccagcaagtgtgacatcttttttcttgtaaaagttactgtttatataaacaaacatacataattttctgttgcatctagtcttggtcaagaccctagattatatacggattctagaggttttcttgcataacatttttaaaatacaatttcgctttcttccattggataaccagttgttgaagggccatttagaagtaacccactcatttttaactgattttctttcttcttctttgagacagggtctcactgtgtcgcccaggctggagtgcggtggcacaatctcagctcactgcagcttcgatctcctgggctcaagcgatcctcttacctcagcctcctgagtagccagggctacaggcgcatgccacaatacttggctaatttttaaaaatatttatttagagatgaggttttgccatgttgtccaggctggtcttgaacttctgaactcaagcaattcacctgcctcggcctcccaaagtgctgggattacaggcatgagcccccgtggctggcatgaattttttttttttttttttttgagacagagtcttcctctgtcacccaggctggagtgcagtggcacgatctcggctcactgcaacctctgcctcccaggttcaagcgattcttctgcctcagcctcccaagtaactgggactacaggtgtgtactaccatgcccggctaattttttttttttttttaagtagagatgggatttcaccatattggccaggctggtcctcaaactcctgaccttgtgacccgcccacctctgcctcccaaagtgctggtattacaggtgtgagccaccgcacctggcctttttcttctaaccccacgaaatcttgactataaactgaattttaataccagttactactgtacgttagattttcatacatgcagggatctatttctcttttctgagatggagtctcactctgtcacccagactggagtgcagtggtgccatcttggctcccagattaaagcgattctcatgcctcagcctctggagtctcactctgttgcccaggctggagtgcagtggcatgatctcagctcactgcaacctctgcctctggggctcaagcaattctcttggctcagcctccctagtagctggaattacaggcacacgccaccatgcccagctaatttttgtatttttagtagagacggggtttcaccatgttggccaggctggtcttgaactcctgacctcaagggatctgcctgccttggcttcccaaagtggtgggattataggcatgagtcaccacgcctggcccatttggaatctcttcatttccactgatcttgtttattcttaaaccacactctattgatctccatacatactttttgtgtgttctggttcattcacttgtgagttgtatctggagtagaacagataatcaaagatgcttgttcagaggataaatcagttcacatactaaagtctctcacatggcccttcccaccatgtgctcccggatgtgcttcatgaggatgcagctggggcagcacatggtcctcctagtaattccgactagaatgcagttgatttctgcattctagaattcagttcaattctagaattgcattctagtctagtacttctgattcagttgcatctagtctagtacttttgcattcagttgccttctagtcagaattaagtgcaaaaacccaaaattgggacaagaaaatacaactatttatggcaaagacccatattttgttagtatgtttctctacaagttgtgctaccaacctgaatagtgcacctggcaggccaccagcacgggagtacaagctgcgcagtgagagctgcttccatttcagcccgttcaaacttctttcccagcctcagaattttgtattagtgaaaaatttaccttccccaagagcttcatttgtttccaacattcctgatatttacagcagagtgacgtttcctgtgtctgctctttgccctggctgctgggaaactcagagccaagtctgaaccctgtttacagtatcagtgattggttatagttagcctgatttctatgttattgaatttattatgtcttttttgaaatagtattggggtaaaataaacaccacaagtcaataagcttatttagttggtgggaactcagctatctcatctggaaggttagatagcctaatacataagacagccaagccacagtactactttatacatagactctaagaatttagtgctaaaaaagatgtaggaataagctagtgatggcatagttttaagtagtaaaaatgtccaatttttaaaatttcagaaaatagcatattcaaaaatgatttgagttcaagtgaaacttaagtatggcttctaataagacccgagggtgaaacctttgtatgaaaaacagaaaaaagacttgttgtcacataaattggaagtatgtacacacttttttttaggggctgggcctgtatgctgctcgagacattgagaaacacaccatggtcattgagtacatcgggactatcattcgaaacgaagtagccaacaggaaagagaagctttatgagtctcaggtaggtgtctggtccccgagattgtatacacagcaccatcatcctctccctttctccgtgccagccagacaccctggaaggcagaatgaaatctgtcatgctgcattcagctttaaacaaaagccatatctgtatattagtgtatttttatcagttgtatctctttcaattggtgttacagtttactttgatagacaactgtaaattaatgagcctggcttcacacacaacctactgattccatgctttccattcgtgccatgtaaatgtcatctgtgcctaatagaatatccacagtaaggatgatcaggctgccgttccgttcagtttcgactgagtcctcctggtgtggataggaacacagaggggagtttcaggtcgacattgatgacttactgactgacttttccctcagaaccgtggtgtgtacatgttccgcatggataacgaccatgtgattgacgcgacgctcacaggagggcccgcaaggtgagacagcgaggaacctgacggggagtgcttttgcttgtggggccagtgctggtggagagaacactgaagccaagggaaaggctctcacggcagcctggcggtgactaaacattcagagcaaatgagttgagaatttttatttaaatgttatatttgtgcttctaacaatgggcaaatagaaatttaattagcaaaaactgctttatcaataaatgggaagtttttaaagctgcttctagctgttttacaatacagttttctgacatggtggcttgcaggtatatcaaccattcgtgtgcacctaattgtgtggctgaagtggtgacttttgagagaggacacaaaattatcatcagctccagtcggagaatccagaaaggagaagaggtaagagtgtgagagattgcatctgccatgttgttcagatcctgggcgaatagttccctcctcacacaggtcacttactcacttgtttcccaattctttgttgtgataaaaactctgtccataataggccagatgttcccaccctgcagtatctcacccttcaggcactccagttcaccttcctccacatggcagctctgtgagcatttgctgtcacctctcccttcccttctgtgccacgggttcagcatccccatggcacccaggtggtatcatttctgtgtgccataggatccttctttatccccttaacctggacacagtttggcagtgtcccctctgaagagcatccccgtccttctccaagggggccgtggctcctgagatggcactgttgggctgtgggcggcaaatctgggccgccgtgctgctgaggattgtgtgctcacgctggcgatcagtgtgtgcttaaccaagtgcccacatcgccacattcttcagcagttcaggtgtgggttgttgtcttcaaaatgccgagtgccaagcttgctgtttgtctccgtgctctcagaggtgactctggtccggcggctcacccattgggattatttttggccttaattgctgcatttgcttcccaccttggtctttcccactgtgattcaggtaccttggttctggaattggcatttcctggaaagctgtcactgagcagcaggcttggtttctgtaggaaacgtcccgcatttggggagtgaggcacctgagtgacttgactttgttggtgctcctctcccttcgtgaacatagccatgggattcgtgggattctatctgtattttgggtctttgtggaatctcctttcttagtcaagaataaggatccgactagacccaaggcccgttatacatctcaaagtaacgtgtaaataagacagtgtgtgggagccctggcacagtgccagtaaccaatggctaccatggtggtcagaagagactcagcccagggccacctgcctccttcctacttgagtattcttgagtaaatagtttaatatgagcccctattttatcttctgcaagatagagaaaatgacttccttaccaggctcttggaaggactcagcagatacctgaaagaaagcagtggaatcattgccaagaacagctgctcaataaacactggtttccttcctttctgtgtagaaggtctttccagctagcgtctagaatcatttcactcagaagagacctagaaattcctgggcctccccttcattttgcagcatcggctctctctggggtggtgggggttgcagggccgcgcactgaggcttgtaccgtgggactcacgcagactcccacctaccttgattggtctgagatgttaatttggtgacctctaaatagaaagacatcctttcagtcttgagtgaggaaaaatgaaggagggaaaacagagttagctggcagttcatctcacccagaattgcatgccccattcagtaaatcaggggaggtgaaaggcttctgggttttagggagagggctaggaaagcagttgcccttccagtcccctccatccacttgcagggacagcattatgagaagtcacagaaatacagctttctctggtcaggctcccgttctcagatctcgctgtttaaaaatactgcctccctcatttcctctgtgcaagcacaatgcctcttttcagggttcccccagggtcccatggaacctcaataaatcaggtcttccttaatttacgtctgtttcgtttgctggttttaaaatgcaagggagatggaggcagaaacgctattgccttccttgctgtcctttcttaccctgtgtctttgccgtgggcagctctgctatgactataagtttgactttgaagatgaccagcacaagattccgtgtcactgtggagctgtgaactgccggaagtggatgaactgaaatgcattccttgctagctcagcgggcggcttgtccctaggaagaggcgattcaacacaccattggaattttgcagacagaaagagatttttgttttctgttttatgactttttgaaaaagcttctgggagttctgatttcctcagtcctttaggttaaagcagcgccaggaggaagctgacagaagcagcgttcctgaagtggccgaggttaaacggaatcacagaatggtccagcacttttgcttttttttcttttccttttcttttttttttgtttgttttttgttttgtttttcccttgtgggtgggtttcattgttttggttttctagtctcactaaggagaaacttttactggggcaaagagccgatggctgccctgccccgggcaggggccttcctatgaatgtaagactgaaatcaccagcgagggggacagagagtgctggccacggccttattaaaaaggggcaggccctctaacttcaaaatgtttttaaataaagtagacaccactgaacaaggaatgtactgaaatgacttccttagggatagagctaagggataataacttgcactaaatacatttaaatacttgattccatgagtcagtttattgtagtttttgatttctgtaaaataagagaaacttttgtatttattattgaataagtgaatgaagctatttttaaataaagttagaagaaagccaagctgctgctgttacctgcagaactaacaaaccctgttactttgtacagatatgtaaatattttgagaaaaaatacagtataaaaatagttattgaccaaatgctaccaggctctgcagcagctcgggggcttataaaatgttcatagggatgttacaatataattttgtgttataaaatatgccattataattatgtaataaccaaaatttcaacctagagtgttgggggttttttggaaaccgcagtctattagtactcaatggttttatacaccttacttctgacagagcggggcgtatgctacgactacaacttttatagctgttttggtaatttaaactaattttttcatattatattgttgcatccctacttcttcagtcaggtttttttgtgcttacaatttgtgataactgtgaataactgcttaaaaatacacccaaatggaggctgaattttttcttcagcaaaagtagttttgattagaactttgtttcagccacagagaatcatgtaaacgtaataggatcatgtagcagaaacttaaatctaaccctttagccttctatttaacacaaaaatttgaaaaagttaaaaaaaaaaaggagatgtgattatgcttacagctgcaggactctggcaatagggtttttggaagatgtaattttaaaatgtgtttgtatgaactgtttgtttacatttctttaataaaaaaaacactgttttgtgtttgcttgtagaaacttaatcagcattttgaaccaggttagctttttattttgtacttaaaattctggtactgacacttcacaggctaagtataaaatgaagttttgtgtgcacaattcaagtggactgtaaactgttggtatattcagtgatgcagttctgaacttgtatatggcatgatgtatttttatcttacagaataaatcaattgtatatatttttctcttgataaatagctgtatgaaatttgtttcctgaatatttttcttctcttgtacaatatcctgacatcctaccagtatttgtcctaccgggtttttgttgttttctgttctgtataatagtatctaatgttggcaaaaattgaattttttgaagtatacagagtgttatgggttttggaatttgtggacacagatttagaagatcaccatttacaaataaaatattttacatctataa

SEQ ID NO: 13 - DNA, 87472 bp, Homo sapiens
ggacagcgccgaggaggaagaggttgatggcggcggcggagctccgagagacctcggctgggcaggggccggccgtggcgggccggggactgcgcctctagagccgcgagttctcgggaattcgccgcagcggacgcgctcggcgaatttgtgctcttgtgccctcctccgggcttgggcccaggcccggcccctcgcacttgcccttaccttttctatcgagtccgcatccctctccagccactgcgacccggcgaagagaaaaaggaacttcccccaccccctcgggtgccgtcggagccccccagcccacccctgggtgcggcgcggggaccccgggccgaagaagagatttcctgaggattctggttttcctcgcttgtatctccgaaagaattaaaaatggccgagaatgtggtggaaccggggccgccttcagccaagcggcctaaactctcatctccggccctctcggcgtccgccagcgatggcacaggttagtttcggcagccccggccttccacgttccctttaatcttttctactcggtgcgcctttattcttccattttttttttcttcctctctctctagttccctgccccttaattaattttaaaggtatttgaatgagctggtcgaagacgtccagtagcccaaccattttctttgcctcctaatacattgattgcaacactatgtcatatcggtgtgtgttctggaattagagctcgtaagtgggtgctatatagaaatggcctgtattgttgctctcatgcaatttaatttgggaaatgccaatgcatttgtgtgtaagagctcctatgcaatttaagtttcattttttttgttcttggcaaatgaatttcgaatcctttctctttactgtacttactgtgtttcctctactttccactcttcgaaattttctctcctttgcagaatattttctgttgaggaatagggtgtaaaaaaatcttgattttgtgtgtgcgaggtccaagatttcaggttagaggtgaagtttaacaattcttttatcttacctaccattcttagcttttttttcctttttcttcttatttgctttaagaatcaatatggagcgcagttcatttcacatctcccagttctttggtgtgagaccaaaatgtctgaaactctgggtttttaggttgggagaacaggggcatgttctttgcagtttgcagtcactttctcattttaggggaaataagataaacaattttgtggagttacgtacctggaaatcaaggttagaagttgaaagagttccaatcatgaactacaaacgtgaactgattgtacaaaagtttaaaatgtgcattaggtttggtgtttgtgtgtgtctttgtctttttacacttttaaacatacttggagatcaagattttcgtttaaaagctttacgaccagttcattcagttgtggactagctcctttgtcaggagaagttcagggagacttcttccatcatcccttcattcttttcttacagttagtttaatggtgttatcctgatgggtaaggaccttttctttgctgggataatgaagatgaagaatggctggccatctgacagtccacaagatgttcccctttactacggagcatctctttaactccctgagagcaggctcagcgtcatccctccatctgccagtgagagtgcataatggagttaaatgtaccctttgagtttgtagagaacttcgagagcatgtttctaaataggcttcatttcagagggtgaaaatgggaagacagagctaatgctttgaattcgttgcttttataagaaagatgtgaaatgaatttaagttaacctgcaaaaattgagaagtaggaatcttgcgagttcctctacctaaggcttgtaacattgattatgcatgaactttgatctgtacctattctatgaaggtactgtagtctccagggatttttttagctggttttttccttcagaattcatacacatacacaaacgtcgttgtattcctttgcacctactaaagtgccattcagaaacattttttagatcatctttagagacttaatcacctgtagatttttgtggtgtttctttcgtatttgtgtaatgtggtagtttttgctttttagttttggtgtaacgtggtagtcgattttacattggagttagccagtgacttggaacgtaggggaaacttttttgtgtactttgagtagtcctgatttgagcagtttcgtcttggagctgtattgtttaaatacttctgttcaggtgtgctactactttctccatgtcggtctgttttgctacttgaaatatctttgaataattacaagagttttaaatgtgttaagtgggcttttatagtttaaaaaaaaactcaacattgagattaattcattcactcataatgctaagagtttatcttagttacttttctaaattttgtaatgagggttaactttacccccctccccaaatcaagattctactccaggaattctttggtgtacggtttttaattgtaaccagtctgggtttgggggaggggagaagtgagtataaagaaaatactgtccctctgttaacttacttcaagttgggtaccattgtaatttttttttttttttttttttttttgagatggagtctcattctgtcacccaggctggagtgcagtggtgcgatctcactacaacctctgcctcctgggttaaagcagttctgtctcagcctccctagtagctaggactacaggcgcagaccaccacgcctggctgatttttgtatttttagttgagacaggatttcaccatattggtcaggctggtctcgatctcctgccctcaagtgatccacccaccttggcctcccgaagtgctggggttacaggtatgagccgcccggccagaggtaccattatatcttgaattttttttttttgacattctgcagtttgtaatatgtttgcaggtaacttttattggaggcacatcacctcttaaaacttttaagtttcaaacttgtaacttttgatttttgagttgtcacttgggtattttataaatgtgaaagaaaattatttcttgatattatggtttttgtctagaactggttgaaataagcccgaaattctagcacctaaaacttttttaaaaaaagtgatttaggcttgcaaatttcgtgatgtaaatatatccaccaagagcgttctaatgtcagctttaaaggaaagaaaactggaatccaatgggatgacatgctaaagtgttacaaatcaaattattacttaaatctcaacctctgaattgctgtttaatactcagatattctcctaaaaaatttccaggttgattcaaataacttaggttaaactcaacttttacgtgttgggatggggaagagaagacttatttgtagccttcacacctttatgttcctgtttcagtatttgcatttgatccattgaaatttttatttcatttggtatggttagggtaaaacaaatcatttgagaaatgacattttgttctccctctccctccaaaaaaaaaagattatgaaagccacttgtaaactttttttgtaaaaatgaccaaaagactggaaaagttaatgttaggcaaatcctggaaatatcttttggagctgtttctgatcatcttgagtgatggaaatgatgagggtcatctgttgtcttcattactcagtgaacacgttttgtcactgcttggtaaacgcttaatgccgtatgcacttaaaaagcacctggaaagataggattttaggatctggcatataattaagtagggtaaagatccttctggtcttggtacagttttgtggccctgggttttgtgcttttttgttttttgagtttttcccccatttcaaagacacagggcagatagtgtgtaaagtatacctgctttttgaccagtagattaatgtacacagtggagaagtggtaaggctttttaaaatgtcagctctactttttttttttttttttttttttgagacagaggtttgctctcgttgcccaggctggagtgcagtagctcgatcttggctcactgcaatctcaacctcccaggttcaagcgattctctgcttcaccctcctcagtagctgggattgcaggtgtccacaaccatgcccagctaagttttgtattttttagtggagacagtatttcaccattttggccaggctggtctcgaactcctgacctcaggtgatccacccgcctcagcctcccaaagtgctgggaatacaggcgtgagccaccatgcccggctgtcagctctattttcttaaaatgccattgtgttagtggttcgtcatcctaaccaaaacattttgatcaagaccatttattttccagctctgtaacttgtgatatgctatgttttattttattttggcttgaatgtttacataagagtttgcttctggagtcttgcagatatagctcctgatttagtgaggcatttctctcctcagtattaaattgcaaaacattttactaaagtgctttaagtttttctggcaattattctcaaggccttgtaagttcatttataggacttcaagaaggttgtctctggttgatagtgagataaagtgacttttaagttgtaaatcttgaatgcgttacaatatgggggtcttattccagcaggagttcatcttctatagcagaggttggaattgtattggcatgtccagtgaatggataatagggaggagggaggaaagggtttctgccttggtggccttttggcattattttgtgtttttctttgcttttctctctcttctttatttaataaaaacaaaaaaatggaaacagttgaaaattaatgcaaagtggtatttgtagggacattaagtggtaaataggaaagagaaaaagagtaggaagagtgttgcagatacaagtgggagtgtaaaatactttttcctggtatatttacaaaaacaatttgagagttattctgccaattcatatacccagcaattaatggaaaagtaaaagatgctagttttatgtttgtccagattttagggtttccttctttgaagatttctaaagttgaatatttttttaagtgaggcaagcagtaaaattaatgggcaaatgaaaccaattataccaagtctaaaatttttcttttttttttgaggcagagtctcgctttgtagctgggactacaggcgcctgccaccatgcccagctaattttttgtatttttagtagagacggggtttcaccatgttggccatgatggtctcgatctcctgaccttgtgaacctcccatctctgcctcccaaagtgctgggattacaggcgtgagccaccgcgcccagctaaaaattttttttttttttaatacttttaagttttaggatacatgtgcacaacgtgcaggtttgtcacatatgtatacatgtgccatgttggtgtgctgcacccattaactcgtcatttagcattaggtatatctcctaatgctatccctctcccctccctgctaaaaaattttttaacattgaacttcgcaggtgattttttttcgcttaatagacggtagtttcattttgaaattttcatgggaaattactgctcactttcccagaagcgcttaagaggataaataataattgaggtgttaagcctcttctgagcaatttggatataatttgtttttagatctagattcttttttataaatgtcccaaagcaattagaagtgattgttttttttgagacggagtctcgctctgtcgcccaggctggagtgcagtggcgcgatctcgggtcactgcaagctccgcctcccgggttcaagccattctcctgcctcagcctcccgagtagctgggactacaggcgcccgccaccacacccggctaattttttgtatttttagtagagacggggtttcaccgtgttagcaaggatggtctccatacactgacctcgtgatccgcccacctcagcctcccaaagtgctgggattacaggcgtgagccatagcacctggccctagaagtaattttgttgagagagagagagtaaaactaaaagtactgaaaagagtaagagagtagctaagagaatgagtattggagtcagactgctagagttcatagcccaggcttgtatttattaactgtgaactttgggccaaatacttaacctggctcaacctcctcacatttattcctaaccacagccctgtaaggtgggtgcgcaccttataggaatccaccttacttacccaccttacaggattgtggttaggaataaatgagaattctctttatcagatgcttaggactatgcttgcttctgtgtagtatgtgttcattgttaactgtttttaactttactgctaaatatatcagaaggaaagcagtggtagatggtttgggggttgtttttgtttttttgatttgcaacgaagtcttgctctgttgcccaagctggagtacagtggcgtgatctcggcctatgacaacctccgtctcccggcttcaagcgattctcctgctcagcctccggagtagctaggactacagctgcgcagcaccatgcccggctaatttttgtatttttagtagagacagggagtcctgacctcgtgatccacccacctcggcctcccaaaatgttgggattacaggcatgagccaccgcgcccggcctgtttttgtttttcgtggatatacagtagtccccccttatccttgcgggatacattccaagatctccagtggatacctgaaaccctgtatagtagtgaatataattgtcatcagtcagaacacgtttctgtccgtgtcttccacacacaaatttaatgccttttccatcttaactaatcacttgtcatgcactgtggctgtgatgtttgcagtttgaggtacaacagcaaaactatcacgaatttttttccttcacaatttcatgtatagatttgatctttgtaacctccgcatacaattttttttcattccttattaagtcaagaactttcaccttcaagcaatttacagcttctctttggcatatccatatagctgtcattgctacttttggacttagggactgtcattaagtaaaataagggttacttaaaactcaagcattgccctgccccatagtcagtctgacaatctgataactgagatggctactaagtgacaaatggctggtagtttatacaggtgaatacattagacggaggggagattcactacccggtcaggtgagatttcatcaggctactcagaatggcgcacagtttaaaacattgttgtggctcacgcctgtaatcctggcactttgggagattgaggcaggaggattgcttgaggccaggcattcaagaccagcctgggcaatgtagtgggaccccccatccccccaccatctctagaaaaaaaatttaaaaagtcagcaaggcatggtggcatgcatctgtagtcctagcttcttgggaggcttaaggtgtgaggatctcttgagcccaggagttttgaggttacagtgagctatgatgacaccactgtacactccagcctaggtgacatagcaagactctgtttctaaaacaacaaaaattagtgtttatttctgcagttttctttgtaatatttttgtaccacaggtgtttgaaatggcagaaaatgaaacggggtaaggatgaactcctgtatagatagactggataaagagaaagccaagtgcatgatgttcatagaggagtcttaagagtaagccttatgtcatctatccaaatgttgttttctaggagtataagaatataggaacagagcttaaaatggaaaaatactgtacagttagccttccgtatctgagggttccgtgtttgtggagtcagccacagattgaaaatatttaggggaaaaaaatccatggttgcatctgtactggacatgtacagactttattttcttgtcattattccctaaacaatacagtgcaccaactatttatgttgcatttacactgcattaggtattgtaaataatccagaaagaattcaaagtatatgggtgggtgtgtgtaggttatatgcaaatactacatgtcccctttatatcagggactggagcatcctcagattttggtatctgcagtggagggagtggattctggaaccaattcccagcagataccaagggacaaccatatatatatagtatcatgacatcttgtatcatgtcacgtatatatatatcatatatattatcatgtcacgtatacaagacatcttatatatcctatcatgtaagatgtcttgtatacgtaagtaatagaaatgaaaatcagcagatagttaaggcataatgagaaaatggaaaacattgttcttgttagaaatgtttaagaatggcttcttgataaagaactgtgttaagcatattctttcttctttttagacacagagtctcactctgtttcctagacaggagtgcagtggtgcaatcctggctcactgtagcctccatctcctgggttcaagctattctcctgcctcaacctcccaagtagctgggattacaggcacctgctaccatgcctggctaatgtttgtatttttagtagagatagggtttcaccgtgttggccaggctggtctcgaactcctgacctcagtctgcccacctcggcctcccaaagtgctggtattagaggcgagagccacagtgcctggccaattaagcataattttttctatttttcattttcttacatggatctttttttttttttttgagacggagtctagctctgtcacccaggctagagtgcagtgacacgatctcggctcactgccagctccgcctcctgggttcatgccattctcctgcctcagcctccctagtggctgggactacaggcacccgccaccatgcccggctaattttttgtatttttagtagagatggggtttcaccatgttaggcaggatggtctcgatctgctgacttcataatctacccttctcggcctcccaaagtgctgggattacaggggtaagccaccgtgcccagccacctgggtcttaaagaataaattttcttgagatggagtcttgctgtgttgcccaggctgaagttatcctcctgcttcggcctcctgagtagctgggattgcagatgtgagccactatgcctgcctctaagaaactttcttataaaggaggaagaagaaaagtagcagtgcagtgctccaaagaatttttttacaacacttaaggaagaactacctttaacttgtagcactagagactctgtttcaaagaatgcacaagaatacttacccttattacttgtaatatactctcatattttctgttgcttttttttcttttctttttttttttttttttagtactggttgcagcctactatattgatttttatgacccactgttggcttttgagccataatttgaagaatactggcgtagaagagttgacaagatggcagttattctgtattaggccaacattttctgtatgccaggaacttatcctctgtacattgttccttctttccttcctggagtttatagataagggaagaagactggcattcacggagtctggtgtgatcagcattgtatttgggaagtacgtatatagtgggaggaacaggagaacctaacccagtagttatcctggtggctgtctttgaggaattgtgtctgattttgggatctcacagatagagataggattagtaaaaatgagcccaggctagaaaggagactgtgtgaggccaggtatatcctgttctgggaacctgtgagtgctgtctgactggtagaatagccaaaaacttgactgtagaggtgagcaagggggccaatcatggagggcttataatacaggaatttagactttccattttacccatttaatggatggggcagaattgtgctttaggcagttaagtaaaaggaggaatagtttgggaagaacagggaaaaacaggaggcagggagaccagtgaaacagctgttttagggttccagccacccttaccacagaagatggaaagaagtggaaagatttgagggaagatggatgatcagcagaacttggtgactgattagaagttaggtagtaagatggacaaatcaaggataattccccagtttaaagtttgagcaacttgttgggtgatgatttatttattatttatttatttattttgagacaatctctgacccaggttggagtgcagtggtgtgatctcagctcactgcaacctccgccttccgggttcaagcgattctcatgcctcagcctcccaagtagctgggactaaaggtatccaccaccacgcctggctaatttttgtatttttagtagagatggggtttcaccatgttgatcaggctggtctcgaactctggcctcaagtgatctgctcgccttggcctcccaaaagtgctgggattacaggcatgagcagctgtgcccagctggataattatttaataaattggggagcataggaagcatagtatttgtgaagtgggtaggcaggtgtgatgggggtagtgatgttacatttggggcattttgaagttggtggttcttctgagttgagcagtcagtcactcttcatttgctgcacctttatctcattttagccaacagacattgaatacctaccaagtcttaggtatttgcaatgtaaagacaaattaaggtgccttctgctgtcagagacttcagagatacagtggggttggtatacatgtccacacagttttcccgtaagttatgctttaaaaggttttttaaatgttatatataaaggcaggggatgggttgcttttgacagagtaggtttggagcgttgatggaaaacttcatggagaaaatgtatatttgaacagggttggtggaaattaacataccttagaagtagggaaagttggaagggtttttcagatgaagctaacatgtttctgatgtggctagaatatacgctgtgtgatagggtttttcatgggagagagatgggaaaggatgttggggttctattgtggaaagagaaatatgctaaggaatttgccatttatcttagcatcaggataagaattgtatgagcaggggagtgacatggttggggaaagactaattctggtaacaccgtacagagcagcagtaggtagaacctatggcaggaagactaggagtacattatttacctcttttgaaatgagtttgtcatttgccttggaagtttttggtacattgtaattaacaaagtgaattgtttattttgttcaagatccatgcttggtttgccagttgttataaatgtagaaaatataccagataccaacttagaaaccattcactctccttgttatttacagatatgcaaggtttttttgttgttgtttttgttttgttttgtttttaaagggtatgtttctccatctaggattccctgtaggccttcccttgtaacaaatctcaaggtttgctcaaaatcaagaaatgttcagtgacagttaagttagcacacaatttaggcttactataaaacatgtccttgagttgattcttaaggtgggattttaataaataatagtgtcttcatcatgtagtttttttggtttttttttttcatacagagtcttgctctgttgcccaggctggagtgcagtggtgtaatcttggctcactgcaacctctgcctccccggttcaagtgattttcctgcctcagcctcccaagtagctgggattacaggcgcccgccaccacacccagctaatttttgtatttttagtagacacagggttttgccatgttggccaggctgacctcgaactcctgacctcaggcgatccgcccgcctcggcctcccaaagtgctggggttacaggcgtgagccaccatgtccggcctcatgtagttattttcacaagaagtgtcactatattaatacattgaaaaagagcaaggtgaattgtcaatgtgaattttctaaacatggccccaggtcacattcttgatcaattaaagcacttcacctctttaaaattcaagacttaaggctgggcgcagtggcctacacctgtaatcccagcactttgggaggctgaggcaggtggattacttgaggtcaggaattcaagaccagcctggccaacatggtgaaaccccatctctactaaaaatacaaaaattagctgggcatggccgggcacggtggcttacgcctgtaatcccagcactttgggaggccaagacgggcagatcacgaggtcaggagattgaaaccatcctgggtaacacggtgtaaccccgtctctactaaaaatacaaaaaaattaaccccgtctctactaaaaatacagaaaaattagccgggcgtagtggcgggcgcctgtagtcccagctactcaggaggctgaggcaggagaatggcgtgaacccaggaggcggagctagcagtgagccgagatcgtgccactgcactccagcctaggtgacagagcgagactccatctcagaaaaaaaaaaaaaaaaaaaaaaagccgggcgtggtggcaggcgcctgtagtcccagctactcgggaggctgaggcaagggaatctcttgaacccgggaggcggaggttgccatgagctgagattgcacctgggccacgagagtgaaactgcatctcaaaaaaaaaaaaattcaatattgaaatgttttgggtttttttgtttgtttgtttctttttttgagatggagtctcactctgtcatccaggctggagtgcagtggtgcagtctccactcactgcagcctccgcctcccgggttcaagcgattctcctgcttcagcctcctgagtagctgggactataggcacatgccaccacagccggctaatttttgtatttttagtagagatggggtttcactatgttggccaggctggtcttgaactcctgacctcatgatccacccacctcggcctcccaaagtgttgggattacaggcgtgagccaccacccctggcgtgttggggtttaaaaagaataaacttcaagttaatctcttcccaaagtataagtataccttttgatgtcatgatagcaggaccatgtgaagagtacatattttgaaatttgcttgcacttttgccctttcactctattggatttcaaaattcaacagctgtcagcatttgtagctgtgtaatcctgtataattatcatcttttatccaaatttgtataaaacttacaagttttcctaatttttttggagtattagagatcttgcctgtctttccagcatggatattttattttaattttcttaatgttccttcaaattacgtagtttgaaatgtttgtacatctttatttccttgctagatgggttgtttatatgattagataattcttcatttacagagggttaaagtaactttttttaaatgaagtactgaatagaggttaggaaagttgttggaacctgataaatttgtaaaatttacaaaatttctcattttaaaagctacagttttaaaatttcatgctttttaagcatccattgtaagagtaggagtgtccaaaagcaataagaacaagaaatctttgtaagattggtagtttcagtgtttagccaaaccattatcagaattagaatgactaatgttatgtaggtttggttttcaactccattctttttttgtttcattttttaaaaaattccaaatctctaacctggccttggcgctctgagtcttctgatctctgcccacctcatcactcactttgttctccccattttgtttatttcaattgctgaactggctgagcttttactctccccaccttaggttgttccactcttcatctgtcaagctcctactcatcctgtggactcaaccactgggttagatgaaagaaaagtttgacgtgtccactctttaaaaacattaagtgttttttgttgtttgtttgagactgtcgtccaggctgtagtgcagtggcgcaatcttggctcacggcagcctcgacctcctgggctaaatgatcctcccacctcagcctgtagctgcaccaccatgcctggctaatttttaaatttttttgtagaggcagggtcttgctatgttgctcaggcttgtctaaaactcctgggctcaagcagcctgccttggcctcccaaagtgccatgattacagttgtgagccacctaccaggtctggcctaaaagcatttttttatttttattttttgaggtgggatctcgcactgtcacccaggctggagtgcagtagcgtgatctcggcttactgcaacctccgcctccaaggttcgggtgattctcaagcctcagcctcctgagtagctgggattacaggcgtgcaccatcacccccggctcatttttgtatttttagtagcgatggggtttcaccatgttggccaggctggtctcaaactcctgatctccgccagcctcggccttccaaagtgctgagattacaggcatgagccacggtgcctgacctaaaagcattttaatgccacagagaaagccagctaaagggaggaggagcagtagatggattctgtcttctaagtgggatttgagaattgactggattttaaataattaataaaggtgttttacttaatgaacacagtttaagagaactgagttgattttacttcattttacctaaagtacaaaggtaagtgtgtttactcaaataatatgtgagccttttaagtaaaaaaaaaaaaaagtgtaactgtgagagatactaatatagtagaattagattttgagccaaaattgttttaattttaaattacattttgtgtcatagttaagtaactagaaaattgtctgatttatgttcatagtacagtgtttgggattatatttttaatggttctaattttgaaggttatgcttcatttatatataatacttcatttgttcaatttctcacgtatcattgaattattttgatcctttgatttttggaaaggctaaatgaaccgagattattttttatttatttatttggagtttggcttttgttgcccaaactggagtgcattggtgcagtctcggctcactgcaacctctgcctcctgggttcaagcgattctcctgcctcagcctcccaagtagctgggattacaggcatgtgccaccacacccagctaattttgtattttttttttgtagagacagagtttttccgtgttagtcaggctggtcttgaactcccgacctcaggtgatagcttgcctcggcctcccaaagtgctgggattacaggcgtgagccaccacgcccggccaccgagtttattttataagggattatatggttacatctgttgcaaggagcaaaccacaagcaatatagaagacaacaagggtgatctacagaatcagtatgtgataatgaaaggatgttttgactcaacactagtttccacgtgtttaatccaaactcagttgttgtttaaattgttaaatttctaatacacggtccactgggtaaaccatgtattaggctaaacttttctttttctttttcttttttttttttttttttttttgagacagggtctcattctgtcgcccagtctggagtgcagtggcgtgatcatggctcgctgcaacctcaacctcctgggctcaagcaatcctcccatctcagcctcccaagtagctgggactacagatgtgcaccaccatgcctggctaattttcgtatttttttgttgacactggtgtccttctacattccaggctggccttgaactcctgcgttcaagcaaccctccagccttggccttccaaagtggtaggattataggcgtgagccacggtgcccaacctatgctaaacttttcacatcagatttatatgtgtcctgtcccgttttacttcaccatgattggactcagtgtacactcagatgaagaaacttcaaaaaaaaaatactgctccttgtgaagcagaagaaagattttactgaaagtgatgtttgtattggagcatcattaaaggcataaaggaacttgtgaacaaactacttggtagaagcagcctggtgatgttgattggttgatactttaggaagcgggaaatgtcttactggagatagttccttcatttcaacagtcatttgtgatactgttttttaatatttgccataggatagttaaaaggtaatggaacaaacttcagatttataagtttttaattaaatataaagggggcaaaagtagataaatatcttaagagctcaccttactgtctagaaaaaatacttgctggcccagcgccgtggcacacatatgtaagtaatcccagcactttgggaggccaaggtgggaggcttgcctgagcccaggagattcagaccagtctgggtaacatggtgagacccccatctcaacaaaataaaaaattaggtgtggtgatgtgtgcctttggtggcagctactaaggaggattgcttgagccaggaggtgaagctgcagtgtgctgtgatcccgtcgctccactccaggctgggcgacagagcaagaccctgtctcaaaaaaaaaaaaaaacaaaaaaaaacggaaaacataagacagcaatcaaatacaatagatttggcttcagtaaatgaaaaccctcactgtaggccctagaataacaagacttctatattactaaagctgattactgcttgatgaactctgtacatgtgatgtgactagtatgaacttctgaggttgttgagatgaatgagaataaacgtgaggtgccaagaaaaatgcctgacacattgaaagtgctggataaatgtatgctgtcatcattgtaagctgggctatctcctaatagtgtaatgagtccattgaataacaataggtaacatgtttatagtgcttagtgtgtgccaggtactgttctaaacactttacatttattcactcatttaatcacaaataacatgaagtaggcactttgctgttatgcagagatggaaacaaggttatccctgcatcttttttttttggcagggggaggaggacgggaacggatggagttggtttttttttttggagcttctgagacccaagcttcaggccatgctcccccaagcacctccccaccaccaccccccaagatgtagtcttgctctgtttcccaggctggagtgcaatggcgtgatctcagctaaacggaacttctgcctcccgggctcaagcaattctcctgccccggcctcctgagtagctgggattacaggcgcctgccaccacgcccagctaatttttgtatttttagtagagatggggtttcaccatcttggccaggctcgaactcttgacctcaggtgatctgctcgcctcggcctcccaaagtgctgggattacaggtgtgacccactgtgcccatcctgttccctgccccccccccctttttttttaagttattgagacagagcctcacttggtcacccaggctggagtgcagtggcaggatcatagcgcactgcagcctcaacctcctgggctcaagcaggccctttgagtaactgggacctgtaggtgcatgccagcatatccagctaattttttttttttttttttttttttttttttttttttttgagacaaagtctcactctgttgcccaagctggagtgcagtggtgtcattgcaacctccacctctcgggttcaactgattctcctgcctcagcctcccgactagctgggactacaggcatgctccaccattcccggctgatttttttatttttagtagagatgggatttcactatgttggccaggctggtcttgaacacctggcctcaagtgatccacccgcctcggcctcccaaagtaaagtgctgggattgcagatgtgagctaccacatccggcctatatccagctaatttttaaaaataatatttttgtagagaggtggtctttctcccctcggccttccaacgtactaggattacaggcgtgagccacccttctggctgtcttttcctttttattttttcacacttccagtggtccttgggatctgtgtatactttagaatcatcttgtccagtttcttgacaaacttctagaagtttgattgatactgcattgaatctatagatcagtactggggaatgatgtttttaatactgaggatttctaagtgtttgagatattctgtttagtcagcctttacttttgagtttacacctgttttatatacattgtcagtttttccctatgttataaatctttttttttttttttttaaatttgagatagagtctcactcttgtcacccaggccggaatgcagtggtacaatctctgctcactgcaaactctgcctcctggatgcaagcgattctcgtgcctcagccttctgagtagctgggactacaggcatgtgccaccacgcgcagctaattttggtatttttagtggagaccgggtttcaccacgttggccaggctggtcttggctggtcttaaactcctgacctccagcagtccacctgtctcagcctcccaaagtgctaggattacaggcgtgagccactgtgcccggctctacattatttaaaaaattatttgtaaccatttgttgctggcatacagaaattcactttgatacgtttatatttatggtataaccagtcatcttgctaacctctcacaatttccagttgtatgtatttctttaaaattgacaacagttgtgtatattcatgggttatagtgtgatgatatatgtatttgctttgaactttctatgtcaacagttatattatctacagacaataagttttgtttcttcctttttcctttttctttctttccttcttttttgttttgagacggagttttgcttttgtcacccagggtagagtgcaatggcactatctgggctcaccacaacctctgcctcccaagtcaagcgattctcctgcctcagcctcctgagtagctgaggttacggcctgcaccaccacgtaccgctaattttgtatttttggtagagacggggtttctccatgttgctcaggctggtctcgaacacccgacctcaggtgaacgcctgccttggcctgctaaagtgctgggattacaggtgagaaccaccatgcccggacttttttctctttttttttcttttttagaacttgtaacctttttttttttttttttttttttttttttgagacagagtctcactctgtcgcccaggctggagtgcagtggcgcgatgtccactcactgcaagctccgcctcccgggttcacgccatcctcctgcctcagcctcccgagtagctgggactacaggcatccgccaccgcgcccagctaattttttgtattttttagtagagacggggtttcactgtgttagccaggatggtctcaatctcctgaactcgtgatccgcccgccttggcctcccaaagtgctgggattacaagcgtgagccaccatgcctggccacctatttttttatgtgtgtgtgagacagtctcgctctgtcacccagcctggagtgcagtggcactgtctctgctcactgcaacctctgctcccctgggttcaagcgattccttgcttcagcctcccaagtagctgggactacaggcgcctgccaccacacccagctaattttttgttttgttttgtttttagtagagatgtggtttcgctatattggccaggctggtctcaagctcctgacctcaagtgatctgcccaccttggcctcccaaagtgctgggattacaggcgtgagccactgtgcctggccaagatgaatcttatattttctttatcctttgttactatggcgaatgacagtttatagatgttctggtgtcccctggattcctgggattatcccaacttgatgatgatttttgagcctttggtttgctctttttaaagagtcttgtttctgtgtccatgaagaagattggcctgtgtttttcttatattggccatgtgtaatttttatattgttttttttttttagaagtatttgtgttagcttgaattgtattttccttgaaagtttggtgtagggcatgcctgtaaacaattcggatatggtgctttctttatggaaagattaaccaagggcttattttctctagtagcagtaggattacagtggtctggcttcccatgtgcctattacccagcttcaggtttactagtatattatactacccttccccccttttttgctggagtattttaaagcaaatcctagccatgtcatttcaccagaaatatttcaatgtatatctttcagtaaaaaggatttattttaaaataatgccattgttatagtcaataaagttaatgatttcttaatatcacccatttctcagtctgtacctaaatatgtcttactctcatttcaaaatgtgtgtttatagttggcttgtttgaatcaggattccaccccccccccaacttatgctatggatttgttggagaaactgggacattccatatcctatatgatttcttttttattaaggtttgagtattttctccggaatttatttattttgtatgttttcttcatttgtataaagttgatagtattgctttatcttttaattttctttttttcttaaccttcttgaagttcgtcttttgttactccaaaaaactaacttctagttttggtaatgctgttacattcctatttcctgtttcgtttatgcttttgtctttgattgtcttcttcatattaatactatttttctaatataatttggatacttaattcattattagcaacctcaggagactcactggagagttcattaatttgtaactttatttattattattatttttttgagacggagtctcgctctgtcgcccaggctggagtgaagtggcgtgatctcggctcactgcaaactctgtctcccgggttcatgccattctcctgcctcagcctcctgagtagctgggactataggcgcccgccaccacgccctgctaattttttgtatttttagtagagatggggtttcaccgtgttatccaggatggtctcgatctcctgacctcgtgatccgcccacctcggcctcccaaagtgctgggataacaggcgtgagccactgcgcccggcctttttaactttattttctaacataggcctttaggttttgaaatatattttttattactcaatttcctttgtgatttcttttgtaatttatcactgcctgtttttaaaatttctaaagtggagatttttttgccctctatgttcagtatgctaatgataaaatattttcttggatactccaggggaaaagtaaaaattgcaaataaagtatgatctcagttttgtaaatcacgtaagtataaggaaataatgaaggaactatatcagtatattaagcaggcatttttgaatagtggttttaggtcagttttgttacacatttgggtatttgttgttgttgttgttgttgttgtttgagataggatctcgctctgtcacccaggctagagtgcagtggtacattcacggctcactgcagcctcaacttcccaagctgccgctatcctccttcctcagcctccctagtagctgagaccacaggtacaggccactaggcctggctaagttttgtatttttttgtgcagtttggttttctccatgttgcccaggctggtctgctgagctcgagccgtctgccctccttggcctcacaaagtgttgggattacaggttgtgagccaaagtgctcagccttgtggcacatttttgatggaggagcccatatgatatttcaaaaggaaagagtaattctgtaaaactctggactctaaattatgccctgagatcttgggatacaatttgacttagttcatatatgaccacatgttggtttagttaatatatgaccatgtgcttactatgttgccagtaggcaaggagctggtatataagtggtaaaacatgtccttcgcgaagaatgcatggttggagtgaggggtggtcacaagggatggcaaggggaggagaggaggcaaacccagagataatttcagtgacatgataaaatgctaaaagatacagaaggagcaggattgggaagaaaaaaaaaaactacaagaagaggaagggcacatacaggaagagttatacttaggaactaagattaattggatcaagtagaccattaaggcaatattttgtcttcaagggatggtccattttttaagaggataatagctgtggaatttttgttgttgttagtagacaaggtctcacagtgcccagacttgatgtgaattcctgggctcaagctatcctcttgcctcagcctcctgagtagcttggactatagatgtgtaccactatgcccaacacccagtaatgcctttttaatgtgaaaactactttagagaattgaaaggaaagaaaactcaaataatttttatagtaggttaatactgtcaataggtcaatcaggagtaattttcttcccccaggggatgtttggtgatgtctggagacagttttgattgtcacaattgggatatgggtgctactggcataagtagaaagaccaggagtctcctaatgataatagagggcacaagacaatcaccctccacccacaacaaagaattatcacatagctcaaaatgttaatagtgccagggttgagaaaccctgcattaatctatacttagcacccagttttgtttgttcttttttgagacaggatcttgctctgtcacccaggctggagtgcagttgtgcagttaaagctcactacaacctcaaattcctggactcaagtaatcctcccaccttagcctcctgagtggctaggagtatagcctagtgccaccacacccagccgactttattgtttgtagagacagggtcttgctgtgttgacctgggctgaagaattcctcctgccttggccttctaaagtactgagattacaggtgtgagctaccagggctggtcttgcaccctgtttttggtaggggtggtttgtatggtgaaggagccagaggcatggtgttgtaccctattctggctagactttggttaaggaaagctattctgtaggctacaggtcaaaaactccgcctgttaaaggcctactttgaggcaggtactatataggaacttggtaaaaaatggtggatagccctctgcttaactggagcacacactgagtgttccacaaatgacaggtcttttgtatcagttgtgtgtctttatgtattacaatatttaaaatgttttctttccatcctgagtttagtttgtgtgtagatattttaactgttcttctaaggaacttgggaatattaatacagcttaattgcatttcttttttccatgactgtggatacaaacctttagctagcaactcatgtaataatgggtgttgcactttttttttaacaaaaaataaaattttatttcaactattatgctaattctataacattatttagaatgtttttctttttttaattatcctttaagttttgggatacatgtgcagaacgtgcaggtttgttacataggtatacatgtgccatggtggtttgccgcacccatcaatccgtcatctacattaggtatttgtcctaatgctatcctctcctagccccccatcccccagcaggccctggtgtctgatgttcccctctctgtgtccatgtgttcgtatttaactcccacttatgagtgagaacatgcggtgtttagttttcttttcctatgttttctgagaatgatggtttccaggcttcatccttgtccctgcaaaggacatgaactcatccttttttatggctgcatagtattccatggtgtatatgtgccacattttctttatccagtctgtcattgatggggggtgttgtactttcaatcccttttttccttggtcttattttaggtatagttcttaagtgtttaagtttgttgatataaccaaatatcccctcaatttaaaaaatctataaaatggttttagtatgacctaaaaaactaccatacaaatagtatatatatagggctgtgtgtggtggctcacacctgtaatcccagcactttggaaggccaatgcagacagatagcttcagctcaggagtgtaagaccagccaggtcaacatggcaagctccgcctctactaaaaatacaaaatttagctcggtgtggtggtgcgcacttgtagtcacagctacttgggaggctgagatggtagaatcacttgaacctgtggatagaggttacagtaagccaagatcgcgcaccactgcactccagcctgtgcaacagagtaagaccctgtctcaaataaatagaaaaacatggagtgaggttgggaaatgacatttaatgcttattgagaacaatatagagcagttttttattttggttttgtcatactttgacctttgtcttttccctttgcttttagattttggctctctatttgacttggagcacgacttaccagatgaattaatcaactctacagaattgggactaaccaatggtggtgatattaatcagcttcagacaagtcttggcatggtacaagatgcagcttctaaacataaacagctgtcagaattgctgcgatctggtagttcccctaacctcaatatgggagttggtggcccaggtcaagtcatggccagccaggcccaacagagcagtcctggattaggtttgataaatagcatggtcaaaagcccaatgacacaggcaggcttgacttctcccaacatggggatgggcactagtggaccaaatcagggtcctacgcagtcaacaggtatgatgaacagtccagtaaatcagcctgccatgggaatgaacacagggatgaatgcgggcatgaatcctggaatgttggctgcaggcaatggacaagggataatgcctaatcaagtcatgaacggttcaattggagcaggccgagggcgacagaatatgcagtacccaaacccaggcatgggaagtgctggcaacttactgactgagcctcttcagcagggctctccccagatgggaggacaaacaggattgagaggcccccagcctcttaaggtaagtacagttttggtttgtgtgcacaatcggcatgcatgtgagtattgtcatgatggatggagggtttgccttacattgtatagcagtttccactattacacgccaggaatttactgtgctgtcataagttttaagaagtgcctgtatttaagtaaaacgtttattttacagctggtattctataacttcatacttccaaatgattgctggctaatgctggttctctctggcacaagtattggaatgtttttatctcatttccaagtccagtttagccttgtagcctccttataaaattacagttttgagatggctggcattacactgtcttcagatggatactccatttgttcctattgctttgaatgtccctggttttcaagagatacatttattctgagaaatgtattaactgttatttttctttattggttgatggaaattaaggtgcatttgttcatgtgaaacctcaacagtgtagatgtttcagtgaaccagaacttggccaaagacttctgttagctttattaactagagaatgctaagtatattaaaaatattttaaacttttaaatgtggatcctgtatacataaataaggcataatcacacatactttagtgcttatttcttcatatttttctttacatattttatctgtttttcttaaaatgggatcacactatggttgccagtgcctggcatgtagttcgtttttgttgaatgagagatggcttcacttcgaagatgaaattggagataggtacgattttcacaaggagtcaagagcaagctttctctgtaacaggaataatttgagcagacatcaggacttctgtgttcctgagaatcttgggtgcagtggctcatgcctgtaatcccagcactttgggaggccaaggctagaggatcgcttgagcccaggagttaagagaccaaccaggtagcattgaccccatcttctatttaaggggaaaaaaaaaaaaagaaccttgatggtgacagagaatgcaagtgtgaattgaagacagatggacaaacttgtgttggggggaactgaggtgacatgtaggaattcaaaaaccttaaatttttttttgctgcgagaatattgacaagttaggattctgttttagcattcctttgtagattctccctttctgcccctcacccccgccaccttttttttttttttttgagacagggtcttactctgtcacccaggctggagtgcactggcctaatcatggcttactgcagcctcaacctaccaggcttaaacagtcttctcgcctcagcctcctgagtagctggaactgaaggcacataccaccatgcctggcttattattattttttttttttttttttttttttttaagagatggggtctcactatgttgctcaggctaatctcaaactcctcttgggctcaagtgatcctcttgtctcagcctcccaaagtgccaggattacaggtgtgagccactgcacccatcctctgacacttttagattgccgtgtcagtgtagtttacttagaatatttggagtgagaaccaaaaacaaggtaaattattaagtacctcttctaggatctaggaacatagctatgaagagagaaagtccttgccaccgatgtttatattctgttacggagaggagggatgacttacaataaaccctcactggtggacaaaatactttagggttaaagtagtgaatgaacttattttatgtaacctactttctactgtgcacataagatataaattttagagtatgccaggtaagtgctatggagaaaaataaggaaaggctcattgacatctgcttgggggtgtgggactattatggttataatcttaatttctttcagaaactgggtttatatagaagtgagcaaaacaaaaatccctgtccttgtggagcttgtattttgatgagaaggaggaattcaaattttaaacttctgttaaacgatattttatttccttatttgatttttattttgagaccgagtcttgctgttgcccatgctggagtgcagtggcgtgatcttggatcactgcaacctctgcctcccgggttcaggcagttctcctgcctcaggctccaagtagctgggaccacaggcatgcgccaccaagcctggctaatttttgtatttttagtagagaaggagtttcaccatgttgcccaggctcgttgtgaactcctgacctcaagtgatctgcccacctcggcctcccaaagtgttgccaccgcacctaggcctattttcttattttaaatgaatccacctatattgatattttgtagagtacttatatcagtgtttgacaaatgagggagctttaaatgtttaataaatttaacaaatgttttaagttatgtaggtttaggataagataaccacttaaggctggatgcagcggttcacacctagaatcattccagaccagccccagcaacatagtgagacccccatctctaccaaaaacaaaaaattatccttgtgtcgtggcacacccacgccagcagttgcccttccactgtaccaagtcctaaaattatcttgtagagcgaattatactcattacatttcttaaactcctaagacttgtgatatttaagaattaggatttaaggtgtaagaaagttttcagtaagatttgatgactgtaaccctgttggcaaatgacatcagcttttgcacaccgttcttgtcatggatgaatctgtggttcaggaggtgcaggcaggtggtgacattactactacagctgtcttccaaaagtctgacctatggtgatttataggaagaaacttggatcatactgccttttaccccaatctttagattcagcataaactaatcaaagccagaatgttttaagttacttttgtttttgagacaggatctcttcctatcacccaggctggagtacagtggcaccatcacagctcacttgcagccttgatctcccaggcttacgcgatcctcctacctcagactcctaagtagctagtactacaaggactgtcatgccctgccagttatttttatttttgttgagacagggtctcactatgttgtcttggcatcaagcaatccacctgccttggtcttccaaagtgctcagattacagacaggggccactaagcctggccacatttttttcaagaagaaaaaataggcatggctcagtagttcacatctgtattcctaccgctttgggaggctgaggcaggaggatctcttgaagccagaagttcgagatgtgcctgggcaacataatgagaccccatctctacttttcttttttcttttttcttttttttcaaaaaagaaagaatagttgtctgcaggacgcatttcttgtagctgcctagaactttgtgtggcttcctcaccctctcctttttagtttaggtagctatttgtatggtggtgggtaattggacatctggagcatattagctatggagaaagaaacaagatcaaataactatagtgtagcagaaattaagtacaaaatcttccttattacatttagtgtggggagtaaagaagcagggctcaggagatagaaggggcagtgatctggaggttggttggtattttattttctaattcctcagcagatctgtgtgggagatggaaaaacaaaagctagagaatcttttttggtcacagtgaccaaaagtgtcaggaagaaattactgccagctgatcagcaatcagtgtagtctgtgtatttaaacccatagtctgccatagaggagcttggagtttccaggtaatgcatcgtgatcaagggaacaagcagtgtcaggaattggttgaaattcagttggtctaggcaggcaaggcatgcaatcatgaaggaccagattgtttggggaaatatttggataaagacattacatttattaacaagagacaacaacacagcttagaaattccaacattttgttgattcagataataggactcttgagggcataatttattgtcttagtcttttattgtttgtcatgcgggttctgtgatagaatgactttcatactatatctatcatgaattttcatgctaataagaaacaggttaaacaactcccccatgtataggtatggatattattggagccacataggataaatactagtagtttaaaaaaaacataggtagcagcagcacttgcagtcagatttgtaactaccaaaagtagcctggacttgatttaaacctgtttctgcattctattgcccctgcaatcttttggccatatttacatagaatcaagaaggtttttttctttcttcttcttcttttttttttttttttttttttttggagacagagtttcgttcttgtcgcccaggcaggagtgcaatggcccaatcttggctcattgcaacctctgcctcccaggtttaagtgattctcctgcctcagtctcccgagtaggtgggattgcaggtgtgtgctaccacgcccagataatttttgtattattagtagagacagggttttaccatgttggccaggctggtttcaaactcctgacctcaggtgatccatccaccgccacctctcaaagtgctgggattacaggcgtgagccaccgtgcccgaccaagaaattatcttctctgaatgcttctcatttcaggccacctcattcttttatgcttccatcaaactgccacttgtaaattacttgtaaatcattcttgtaaattacttaccttagtctctgaatttcatctggaaaatgaaaatgttctttaacttttttttttcattttttggtaatagtataaagaagattaatttacatttttttgttttttttaatagaggcaaactgctgaaccaaaaaagatgtcatattcatagatttgcagagtatagatattgcatatgatttaaagaacgaattttaggccaggcatggtgggagatgcctgtaatcccagcacttaggcagaaggattgcttgaggctaggagttcagtcaactcctgggcaacatctctacaaaaataaaaacaaaaattagctgggcatggtggtgcaagcttgtagtcccatctgcttgggaggctgagatgggagaattgcttgagcccagaggttgggaattataatgagctatgataatgcaactgcactccaacctaggcaacagagtgagaccctgtctttttatataaaaagtaaaagaaaaattttattaagagctttgtacctgtccaaaacagatgcttcacagaggtagtaacatttgaaattacaaggatgagtagaatctgcaggtgtttcttagttaggttgtactatctaaggaaccaacagaaaatgcctctctgtgaacttggtgtttatttccaggttggcattaaggagtcaaataggaaagaaaatgtgctactgttcagttgtagggaaagggaaaagcttgaggcaaatgctggaggctcaaggagcgtgatactttcagactttaagaaatcagtacaggaaatatataagataccatagataggtagtcagacttcataaaggctttggtatacgtactgtggggttgatttttttcttttatagaggcaggtgaaaacagaagacaggcaaacctgttgtccacagtctgtacaagcactgtgataggtttgagttaagacagtcacagtaggtaggaatacatgggaagggttttagtgtctatgtgtgcttttagaggtagaattgaaggaccctttgattggtcttagcagacagaaatctggtatgaatcctttaattgggcagtagctatagtatcttgagttattctgagtgtttgctcaatgtttctagtagtgatgatgacttgtagttgggatcctatgtgtaatttggcagaagaggacggtggcttcaaactttgtttgggatataaagttgaccccattttgaattattttaaaataatttgaaagattaatgaaaatgcatttttataactttcattattagtaaaacgtttgactttagaataatgctgtttttcaattaattattattatagtataatggctccaggtgaacttaacataaatatagaacataaactactttttaaagtacagagggagccggcacagtggctaacgcctgtaatcccagcactttgggaggccgaggtgggcagatcacttgaggtcaggagttcaaggccagccttgccaacatggcgaaaccccgtctcgactgaaagtaaaaaaattagctgagtatggcggcgcacgcctgtagtcccagctactcaggctgaggcaggataaccgcttgaacccaggaggcagaggttgcagtgagccgaaattgcaccactgcgccccagcctgggcgacagagcgagactttgtctcaaaaacagagaagtacataagggttgcaaagtcaaatgacttgaagggccaagcaggtgacttagcaggtgacttaatagagcagctaggtttaaaacagcaaggaatagtgtggagtctggacttccgcatgctctatgtaaaggagtcagaatcagaagttttaaaaaacactgtcatcagtgtccctacacaaaaaaggacatattcccaaaccatcagttttctactttttatacaaacaaaatacaggaataattattcaaatgaggccaagcatggtggttcacgcctataatcgcagcactttgggaagctgtggtgggaggattgctagagcccgggaatttgagaccagcctgggcaacatggcaagaccctgtctctattttttaatagtcaaaaaaaagaagaagaagaaaacattcaaatgcttgaacatgacaaaggggttagatggcttattaagttgaattcgccatgtagcatcatgtgtgacgtaatggaaatgaatggcaaaccttgtttaacagaattaaatgaagatgattaaaagtatttctaaaacatctttatttcaaatatttatgaaaataactctgtacatttaccatacccaaggcccctaaatcttaattttgatcttaatcttgaaaatgtattgttgttagcatactttgtatagtgggttttttttgtttgtttgtttttgagacagggtctcactctgttgccgaggctggagtgcagtggcctgatcatggcttacttgcagcctcaacctcccaggctcaggtgatcctcctacctcagcctcctgagtagctgggaccacaggcacatgccaccacatccagcttttctttccttttttttttttttttttttttttgagatggagtctcactctgtcgcccaggctggagtgcagcggcgtgatctcggctcactgcaagctccgcctcccgggttcactccattctcctgcctcagcctcccgactagctgggactacaggcgcccgccaccacacccggctaattttttgtatttttagtagagacggggtttcaccatgttagccaggatagtctctatctcctgacctcatgatcctcccgcttcggcctcccaaagtgctgagattacaggtgtgagccactgcgcccggctgttttttggggttttttttttgtattttggtaccgatgggttttcaccatgttccccaggctgttgtcaaactcctgacctcaagaaaccctcctgccttggcctcgcaaagtggtgggattacaggtatgagtcgccaggcccggccacttggttttttgccatcatggctccctacaacctctacctcccaggcttcactgataatcccactttagccttccaattagctgggactataggcttgcgccaccatgtccagatttttgtattttttagtagagatggggttttgtcacgttgcccaagctgtagtgtcttttctaatagaagctgagaatttcctttgaaactgtctttgtgaacttggaagtgaaatcagaaaaggaataataatgtcttaaattttattgcttattttgttttcttttgtttcttactcttagatgggaatgatgaacaaccccaatccttatggttcaccatatactcagaatcctggacagcagattggagccagtggccttggtctccagattcagacaaaaactgtactatcaaataacttatctccatttgctatggacaaaaaggcagttcctggtggaggaatgcccaacatggtgagtactaatccattacagacttgttttcaaactggcattttgacaaaagaattgtgttaaactttcacccttctgttatatatgctgggatttgtacccactaggagcctaaattgatatgtacttgatgatccctgtgaggaggcttgtgcttcctttccatttctctgttttttttgttccatgtggttattgatcagtgagcatgttgatccaaacaggagtaagtgaactgctacaatgaagttttaggggcctgccattcagcaacttggtcttgtgagcgtttccatacgatacgaaagcggaacctttcacttttgggggaaggaatctctggcaaaggatccgaactctcagtgaccatatttaccaatattatttgattctactacacccaagtaaattccctctcaaaagtaatgtattgttttaaacagcaatttttgttaaataaaattttcaggaacttctagtgttatttttgtacagtcaaactactagtagtaaatgtgtctgcattcaactttggaaaaacattgtctgaaaaaatcctctttcagatgttttagttttgtcctttgtgtcattatgtttatggactgcctatatttgagatactctgccaagtactggagttatacagatgaatgaaacatgtcatctctgtcccgagaaatgttcacttttttttttttttttttttttttttttttttgagacggagtttagctcttgttgcccaggctggagtgcagtggtacgatctcggctcactgcaacttctccctcctggtttcaagcaactctcctgcctcagccttctgagtagctgggattacaggcatgtgccatcatgcccggctaactttgtatttttagtagagacagggtttctccatgttggtcaggctgatctcgaactcccgacctcaggtgatccgcctgcctcggcctcccaacgtgctagggttacaggcgtgagccaccgcgcccggcctgaaatcttcactttttaatttaaaaaactaaatttatcccagagtttagaaaaactagtttttcaccaacccgaaagacccctctgctgagtctcttgaggagttcttcattgctctttaaaacctaatttgggtgtgcttttaactacagacaccctctcacccttccctctcccgctggagtttaccatgtccttctctctgcttttgctctctgtgtattatacatacttatatcacttcgtaatgtcattttttttcttattaaattgagcttcttaaaggtaggagccatggtttatgcattccctgtgtcaaaaaatggagtctggcttatagtagactaaccataaaggttttcattgaaaatatccacatctctatttattaagaaatagcacattatgactcctaccattaaatatattgttatatctctcagggtcaacagccagccccgcaggtccagcagccaggcctggtgactccagttgcccaagggatgggttctggagcacatacagctgatccagagaagcgcaagctcatccagcagcagcttgttctccttttgcatgctcacaagtgccagcgccgggaacaggccaatggggaagtgaggcagtgcaaccttccccactgtcgcacaatgaagaatgtcctaaaccacatgacacactgccagtcaggcaagtcttgccaaggtaagtggacccacagggttactgtacttagcaatttttacagccagggagaagaaggaaaatgtgatcaagtctattttgtggtgatggatatgtttaataccttaattgtggtgatggtgtctgtatgtacaaagtcaccaaaatgtatacattagaccaggtgtggtgtctcacacttacaatcccagcactttggtaggccaaatggggaggattgcttgaggccaggagtttgagaccagcctggacaacatagcaagacctcgccgggcatgatgatgcacctgtagtcctagctgagggactaagaaggctgaggaaggaggattgcttgagcccaggaagtcaaggctgcagggggctatgattgcgccactgtactccagcctgggtgacaatgtgagaccatgtctttaaaaaaggttgggcgcagtggctcatgcctgtcatcccagcactttgggagactgaggtgggcagatcacttgaggtcaggagttcaagaccagcctgggcaatatggtgaaacctcgtctctacaaaaaaatactaaagaaaatcagccagatgtctgggtgtgttcctgtagtcccagctacttgggagattgaggtgggaggatggcttgagcccaagagggcaggggttggtgtgattcgacatcataccactgcactccagcctggacgatagaaccaaaccctgtttcaaaaaaaaaacagtgtacatatgtgtaattttttaaaattattttattttatttatttgttttttgagacagagtctcgctctgtttcccaggctggagtgtggtggcacaatctcggctcactgcaaactccaccttccaggttcatgccattctcccgcctcagcctcccaagtaactgggactacaggcaggcgcctaccaccatgcccggctaattttttgtatttttagtggagacggggttttaccgtgttggccaggatcgtctcaatctcctgaccttgtggtccacccgccttggcctcccaaagtgttaggattacaggcgtgagccaccacgcttggccaatatgtgcaatttaaaaaatatttataccccaaagcatttagaaaattccattgtctaaatgcatcatcacagttaactcactcggtaaaggtcgtcttggctgcgtccattctgtggcaattacgaataaagctgccataaacaaaatcaattttgagactcctttactgatagtgacgttattttaggaaatgataaaaacacagttttttttttgagatggagtctcgctctgtcgcccaggctggagtgcagtggtgtgatctcagctcaccgcaagctccgcctcctgggttcatgccattctcctgcctcagcctcccgagtagatgggactacaggcgcccgccaccatggcggctaattttttttgtatttttggtagagacggggtttcactgtgttagccaggatggtctctatctcctgacctcgtgatccgcccgcctcggcctcccaaagtgctggaattacaggcgtgagccaccgcgcccggccaaaacacactatcgtttttgtgagcaagtatctaaggatgtgagaagagaataaattttaaaggtcttcccatgtggtgatcctcatagactttgatttttatttgccctagcatagcatactttaaatgttattgagggtttgctaactgtcatgtaggcaagtgttcaatttaatacaatttactgcagtcatttttacccgatctaatacaatttgtatgaagtcattaaaaagtgttcttataggcatgtgtgtcataacattggtttagagtacatttgcttagaataaagtaggttgtgtatagcatggtgaaaaatgagggctcttaagccagactgcttgaggttgaatctcactttgagtactctgtgactttgtgcaaattgcttacccattctttttgcctttcttgactgtgaattctgagtattaataggagctaccttatagggctgttaggaagatgaaataagttaatgcatttatgttacttattaagtggtcaacaagttagctattattaatgtaaaaacattaacctgctcttgaaaaaatatgttttcttctctttagtggcacactgtgcatcttctcgacaaatcatttcacactggaagaattgtacaagacatgattgtcctgtgtgtctccccctcaaaaatgctggtgataagagaaatcaacagcgtaagtgatgaaatcttttgaaggtttatatgaaaagttttaaagtctcaccagtgccatttatagtactacttgattatgtgagggacctgtggtgttgtactatgttgaataaatgtttttttcccttttaatttttctgcttccctagtgcatagaattgaactgcttagggagtttgaggctgcagtgagctatggtcatgttactgcgctccagcctgagtgatggagtgagaacctgcctcaattaaaaaaaaaaaaaaaagaaagaaaaaacagtgcagtggctcatgcctgtcatcccaacagttttggaagccaaggcaagaggattcccaggagttcaagaccagcctaggcaacttagcaagaccttgtatcttccaaaaactttaaaaattagttgtgtgtggtgtgcctggctgagatgagaggattgcttgaatccaggaggtggaggctgtagtgagctatgattgtggcacagcagtccagcctgggtgacacaaggataccctgtctttaaaaaaaacaaaacaaaacaaaacaaaaaaaacaactgaacactgcttaacatccaaaataagatccaggaactctcaatacttattatttatacaaacagcaataggtaaatttatgttctgctttgaacctatgaaaatttaaagaccgttgctttggcattgggcaagttattcttttatactatacttgtgatctaaacgttccaggtacttggaaattattttaaaaagaaaaaatatgagattatttttataatattgggatatagaagagctttttttttttaagagaaaagacgagattaacactttaaaattgtaactaccacatctctatagcaacaaaaatttaagcttttagggttaaaggacaaatttgggaagtattgtacagcatttgaaaatggaattaaattttataacaagaattgggaatagaaaatagacaattcaccagagacgggaggagagaggggaactcccaatataattcactattaagaagagaaataaggtatcgtttctctcctgtagtgtaggcagaaatgatgctgccgggtgttggcagttgaatggctccaaagcattcatacagtgttggtcggaacattaataaagccctttgggaaggctattgggcattcagaatcaaaagccttttataccagtggtcccctttaccaatcagttctgcatctagaaatttcttccaggaaataatggaagacaagatccacatactcagatgtttcataatcacgtaacaataattttgtggggttttttattagacatgttagtcttttttttctcaccagcattaatttgtaatactatatcttttgtcttctctagcaattttgactggagcacccgttggacttggaaatcctagctctctaggggtgggtcaacagtctgcccccaacctaagcactgttagtcagattgatcccagctccatagaaagagcctatgcagctcttggactaccctatcaagtaaatcagatgccgacacaaccccaggtgcaagcaaagaaccagcagaatcagcagcctgggcagtctccccaaggcatgcggcccatgagcaacatgagtaagtttgtgtcatcctaataacatggtattggttgtgtcagtaaatgacatctataaacacagtgttgttagctcctttttattttttctgctacatgattttttaagtaattttttaaagattacagtgtaaaaggtcccttacagttcatctacgagaggtaactgccactggtttgtatcttccttgatccttttttgcattatatgagttcagatttgcagaaatgagatcccatatgttattccacaacaaactttgattaatactgtgtagacgggccgggcatggtggctaacacctgtaatcccagcacattgggaggccaaggtgggtggatcacaaggtcaggagtttgagaccagcctgaccaacatagtgaaaccccgtctctactaaaaatacaaaaattagtagggtgtggtggtgcgtgcctgtaatcctagctacacgagaggctgagacaggagaatggcttgaacctgggaggcagaggttgcagtgagctgagattgagccattgcactccagcctgggtgacagagcaagactccatctcaaaaaaaaaaaaaatactatgtagacatctttcatagtcagtattccatgtatcattttaaatggttgtatagtatgtcattctttcattcttttttttttttttttttttgagatggagtctcgctctgttgtcaggctggaatgcagtggcacgatctcggctcactgcaacctctgcctcccgggttcaagcgaatctcctgccttagcctcctgagtagctgggactacaggcgcgtgccaccatgcccagctaatttttgtatttttagtagaggtggggttttcaccatgttggccatgatgatctcaatctcttgacctcgtgatccacccacctgggcctcccaaaatgctgggattacaggcgtgagctactgcacccggcccaacaatctcttacagatggacattgagatctccaattattctgctgctttaaactatacaacagaaattgtgttttgacttgaggcattttgggctgaaacatatagaaatgagtgtagttggtaatgatttcctcatgtctggcaggaggaatagtgtgccttttcaaatagtttttttgtgacttgtttgcctcacttcctgttttatgactgagagggaagagggagaagtgttccagtatcctaatttggggatatatatgtttctctgattgcatatgataacattggaagaattgttctaatatcttaattttgggatatgtatgtttctctaattgcatatgataaaatcaaacagcttttttctgtgtctatccctctgctgtcaagcagttcaaatatctaagctattttgtttgagtagttagacatccagcattgtagagaccaggtcttgtccaggttggtcttgaactcctggtcttaagcaatcctcctgccttggcctcccagagtgctgggattacaggcatgagccaccgcacctggcctaagattatccccccccccacccccaccccggaaacagagtctcgctgtgtcaccgaggctggagtacagtggcacgatcttggctcactgcaacttccgcctcctgggttcaagcagttcttcctgcctcagcctcccaaatagctgggattagaggcacctgccaccacacccagctaattttttttttggaacgaagttttgccatgttggccaggctggtcttgaactcctgacctcaggtgatctgcctgcctcaacctcccaaagtgctgtgattacagacatgaaccactgtgcctgaccctctaagattattttttaatacagattgagtatcccttttcctaaatgcttgaaagcagagtactttagatttttttcggagtttggaatgtttatatttgctggttgagttgagaatcccaaatccaaaaatcaaaatgctgcattgagcatttcccttgaatatcattcacaaagttttggatttctgtatttgggatgccaaccaacccatactgctattttttactttcttcctattttccactgctgtgttctgttgctcccatttttggtttttgaattaatcttcaggacatttttttctttctgtttttctttactatataataacagtattttcaaaccagtgatctgcttttaagcacatgttgagccactgtgcagtaaagtttaatgctcctgttttcaaaactgttgaacaactgttttgtcagaaactgaaagttatgagagtgaaatgcaaacatttttagacccatcaattttgattttgacttttaataatttaagatctaaaatgctagatagtgacatggagcttcttgtattcaagtttgtaagtcagattttgcagtcactggcatgactattttagacagttgtgctaatgctcattgtaccagaccatttctattttaatattctttagattcttcattcctgccctgttgttattgtttattacttggtctgttgatttcattcttttcttttttttttttttttttctgatttcattcttgaaagtagtattttcaaggaggatgtttttcttgagttttacctaatcagggacttagataagttttcttagataaattatggataactagaaacgtacgtgtgtgtttgagtttggtctcgctgtgtgcatgtgtgtttttgagactgggtctgataactggaaacgtacgtgtgtgtgtgtgtgagattggtctcactgtgtgtgtatgtgtgtgtttgagactgggtctcgctgtgtcacccaggctggagtgcagtagtgcgatcttggcctgcatcctctgcctcctgggctcaagcggtactcccacctcagcctcccaagtagctgggaccacatacgtgcaccaccacgcctggctaatttttgtatgttttgtagagacagggtttcgccatgtggcccaggctggtcttgaactcctgagctcaagtgatcgcctgcctcgacctcccaaagcagtttgtgtttttcgttacttccatgacaaccagtactaactagttaaataattattgagtgacgagtttttaagcaggactaggaaaagggatgaggagcaatcttgccttttcaggcttccttttacctcttctgtattgaaaataacatgtacagcggtaatggaaagttggacctggacactagcatattttcccctcttgttttatatcttctgtcttggaatgagcattgcttttttctttctttctttctttttctttttgagacaacatctcactctgtcgcccaggctggagtgtagtggcgccatctcggctcactgcaacctccgcctcctgggttcaagcgatgctcctgcctcagcctccaagagtagctgggactaggcgcacaccaccacctttttgtgttttcttttagtagagacagggtttcaccacattggccaggctggtcttgaactgctgacttcgtgatccgcccacctcggcctcccaaagtgctgggattacaggacgcccagccagcattgcttttttatctcccattccatgttacgcagaatgcacttacctttttccttaagttttagtaggttgttgtcttcccctggcctggaatttcattactgtaattgggtagttcccttttgtttttcaaagttatgtttatagttcctattatagctcttttcctctcattatattatcttgcctatgtacttttatatatatgcacaattatttgaatgataattttgggggatttttgcccccatttcttcgtgtctttttatttagaattagatttaagattactcaagttccctttgtttttatttcttctggtctcctgaagtgctgagattacaggcgtgagcctctgcgcctggtcacatttgctttttttttttaagttatgtttcgttttctatgatttactgttgggtgcttcatctttttcttacctgtttgtaagggtgcttcaaatcagcctttacatatgtgttgccagttatattgtcaattatttattgtatatgctgcaaattttttttctgatttgtcatttgtttcttaactttatagtatttattgtatggtggctgttgtatttatttctgtctcctgttatttcattttgacttaggtgctagtcctatgggagtaaatggaggtgtaggagttcaaacgccgagtcttctttctgactcaatgttgcattcagccataaattctcaaaagtaagtcttaacgtgatttataccctgggtcacattacaaatactactggttaacaattcattgtttgacttttgaacttagtttcctcggtttgaggatgtctttgaatacagatagatgtttgagtccattctttcttttttcgctctgtagcccaggctagagtgcagtggcatgatctcagctcactgcaacctctgcctcctggttctggttaaagcaattctcctgcctcagcctcctgagtagctgggattacaggaacacaccaccatgcccagctaatttttgtacttttggtagagacagggtttcactgtgttggccaggctgttcttgaactcctgacctcgcgatccgtctgcctcagtctcccgaagtgctgggattgcaggcgtgagccaccacgcctagcccactctttcttctttctacagccttaatcgaaattgtattgattttctagtgtagcctacaccttccctaatacagtaggatgttgcaaggttacagctccataatagccttatcctgatgttaagaattagtccaccagcctgggcaatatgtcaagacgtcttctctacaagaaaatacaaaaaagttaacggggcatggtggcgtgcacctgtagtcccagctactgatgaggctgaggtgggaggagcacttgaggctgggaggtcgaggctctggtgagccgtgattacaccactgcaccctagtctgggtgacagcgagactgtgtctcaaaagataaaaattattattttaaaaagagaggtagtccatcatccaaagcattccctgaggtgagctgtgttaaaatgacagcttagtctgataacacaagccttagaaaactaagtatgggccgagcatggcagctcccctgtaatcccagcactttgggaggccgaggcaggcagattgcttgatcttagaagctcaagaccagcctgggcaacatggcgaaatcctgtctctgctagaaataagaaaattagccgggcatggtggcatccacctgtaatcccagctactcaggaggctgaggcaggagaatcgcttgaaccccggaggcagaggttgcagtgagctgagatcatgccactgcactccagcctgggtgacagagcgacacgccatctcaagaaggaaaaaaaaatggctgggctcagtggctcacgcctgtaatctcagcactttgggaggcccaggtgggtggatcacttgaggtcaggagtttgagaccagcctagccaacatgatgaaaccccatctctactaaaatacaaaattagccggacgtggtggcgggtgcctgtaatcccaccaactcaagaggctgaggcaggagaatcgcttgaacccagaaggcagagattgcagtgatctgggattgcaccactacagtccagcctgggcaacagagcaagactttgtctcaaaaaaaaaaaaaaaaaaaaggcattacagacaaaacccagaaaatgaagtcttatgatatcttgtgttaggacatcatcctgccctccaaagaaatacaacttaccctcacacaggtatgaacatgcacagtttaaaatcagtctagtcacacacttctccctgcctagctccttaatgcgaatagaagtgacatagcatattgattccattacaataatcagtgtcagcttgaattaaatgaggtcttctcctacctttcttcactaaaactatttggtgacccctttttgaagcccaatgatgagtgaaaatgccagtgtgccctccctgggtcctatgccaacagcagctcaaccatccactactggaattcggaaacagtggcacgaagatattactcaggatcttcgaaatcatcttgttcacaaactgtaagtaagattgtggacacgtctcattcgtaaagagatgttacgtcaacatgttttcaatctcctgggcatttaattactaaaggaatattagcaatttttctgtagcatggaggttgatgttgatacttctactcttgtggatttcttgctgctgctgcttttttccttctcaacctttcccaccatcatctatggtagtctttcagctttaatggtatgtgaactattctgtctagtgacagtaaataatatattaaacattgtttttagctattgcctttgcaaaacttatatatctaagaaaaactaggcctcagctcattaaaatattgcattgataacatccttttctgttactcctggtagagcaggggttttttgtttgtttgagatggagtctcactctgttgcccaggctggagtgcagtggcacgatcttggttcactgcagacttcgcctcccaggtgccagtgattctcctgtctcagccgcccaggtagctgggactacaggcacgtgccacctcacctggctaatttttgtatttttagtagagacggggtttcactgtgttggtcacgctgacttcaaattcctgacatcaagtgatccgcctgcctcagcttcccaaagtgctaggattacaggtgtgagccaccacgcctgtcctggtagagcttttattatgtaaaaatctggtagggtggactctctggtcttctcgtcctccagatgtgcacatggcagtttatttttgagaagttgatatatttcaggcactctccccttacgaactccatcttaatctaaagagtttttgtcagatgaaggagggggaggcatatagagcaaggtaatgaaatgtgctcagcatcataaaaaggtagagcttggaccttgccaattacagagtttacccttcaaacaccatgcagtattttttcttggagaagtcttttcatttcactttcagttaatagcagggtcgtctttactgtatccatattttttaattgactgaggaactatttatcattttgtcttaatttatttttatgttatgtcaaactaccaattatatacgtttcatttaggaatttttttttcctcccacgaacccatgcttgctaatcatttaggattctttgtttgtttgtttttgtttttgtttttgagactgagtctttctctgtcgcccaggctggagtgcagtgtcgtgatctcggctggctactgcaacctcccgtctcctgggttcaagcgtttctcctgtctcatcctcccaagtagctggggttacaggtgtttgccaccacacctggctgatatttgtatttttagtagagatggggtttcgccgtgttggccaggctggtctcgaactcctgacctcaggtgatccacctgccttggcctcccaaagggctgggattataggcgttgagccactgtgtccagccaggaattcttcagtggtagcactaagtaacggaatttgacaaggaaagaacttcacaagtttaatgaaattattcctttaataaagaataaccgatctcttattttgtgacagactattcaggaacttttatttaatggacagagatgattatttggggttgatcatttgactttacgttaaaagtttattatatatgctcgagttttctaccaacttggtattattctggacttccatttatatcttcttgatctggttccttcaagtcctatgcaactgagtacgggatgtccaaataaaattagtgcctaaagatcacatttgtcagtcataagagatactagtgcaaaacattttgttagggaattgcatgaaagtgaaaaactgaatctaacagaatcattacgcatttctggtctgtccacttcaggtttttggttttttgtttgttttttataagcctttgtcagaacagttcaagtttttgatgttttaacattttagagtggttactgaattttatttcagtaagctaaataataaatttagaagagcagatggaactctgaaggctacttgatactatgacaaggcctgttttcctcactgtctttagtatgtaacccaaagtaatattttgctttatgtctagagtaacagggaccaaagagtattttttatagagtcatttcttatattgtgaacggaaatatagacaaaaattcttttgtttatcacaaaaagataatttcatttcagtaagtaatatatatcaccttgccattattttttcttttcctctatgtgttcagtgtataaaaatcagaaaaatactaattaaatgctgacatgatattacagtggtaggattttctttttccagcgtccaagccatatttcctacgccggatcctgctgctttaaaagacagacggatggaaaacctagttgcatatgctcggaaagttgaaggggacatgtatgaatctgcaaacaatcgagtgagtgtctggtttttttctattaatagccaagattgaacctgttgtggttattttattcctctttagcatgtacaagtagtacatatgcttcagacgggggacacgctgtagctatcccgtcttattgtccccaagcatagttaggataccaaagcagtttcttaagtgtatgtcatcaagaatcttatgtttttcctcctaatacagtgcactcatgtggcactttatctggttgtcctgtcaacctaaaaagtggctgagctggccgagtgcagtggctcggtgcctgtaatcccagcagtttgaaagtctgaggtgggcggatcacttgagcctaggagttggagaccagcccgggcaacatagcaaaaccccatctctacaaaaaattagccaggcatggtggcacgtgcctgttgtcccagctgctcaaaaggctgaggtgggggaatcaccagagccttggaagtcaagctgcagtgattcgggattgcgctgctggtgacagagggagaccttgtctctctcaaaaacaggagtggggtggtgctgagctgttaccagctgtgttctcttttcactagaatataatgaagtagcgacttaactgttgttcacggtagttcagattctctacataagttgaactttcctttctaaattggcaccagttcttaatgcagcatataaaatgaaactaatatctattctcagtttattttttctgttacctggtggtagttccttttttcctcatctcccttattttacttcaacaattcaaaaggcggaatactaccaccttctagctgagaaaatctataagatccagaaagaactagaagaaaaacgaaggaccagactacagaagcagaacatgctaccaaatgctgcaggcatggttccagtttccatgaatccagggcctaacatgggacagccgcaaccaggaatgacttctagtaagtggtttttgttatatttctgtttgagagaaattgataataaaatagtttctatctaaagtcattaatttctgtaagcttgtgtaactattctagagttttttaaataaccatttgcctttgcaaagaaaataactcatctactagtaaaaacagaagcagaacaagtatatttaagatgtctgggcatggtacttaacataccttgataatctggaattgtttttagagcccaaggtgtaaacttctctaatagtgacatctagaaagcaatagcctacatacagatgttcacagatttctctgagactggcttgtgtggtaagtagccagtaaatgtttgtaggctgaccaggttcaggagccctgtaacacacataatatcatattacactgtcacactttctacttgacataaaatattctaagtctaggaactctttttttttttttctttttctttttttttgaggcagagtctcactccgtcacccaggctggagtacggtggcatgatcttggatcactgcagcctccgcctcccaggttcaagcaattctcccacctcagccttccgagtagctgggattacaggcacatgccaccacgcctgtctaatttttgtatttttcgtagagacagggttttgccatgttggcctagctgatctcaaactcctggcctcaaatgatccgcccaccttggcatcccaaagtactaggattacaggcatgagccaccactccctgcctagaagcatcatttaaaattacattttgacagcttcagtttctgattatagcatcattgttgacctgatgaattaaccagatagccaagactatgataaatagtcttactcaatcgttgacttattggtacgatcaaagtagtgaaatatggagcaggcacaccattttcaggaatggcacaggctgtaagtgctgtgagcaaggctgtgataggaaaaacctgcatttactgagttaggaaatgctaatgacctctaagaagtgccaactgagccagcgggcagtaaacctcatacgatcagtagattataggtgggctgagaagttcatctctttcattcattgaagtagtaaagtagagaaccattggttaccactggcctttagcagcctcatttgctaactgaagtgtgccaggtactgttttgtaatgtgtaaaaagttgggaggagcaacattgctgaggaaatagtatacatggaggctgcccaatagtaaggaaaaacacagattttttgagtagttagaacaaattttcaggaatgaaaaagtcaagattagagttgagactgcttcagtacatgatttggacttgagtagtaactaaagattaaaaaaagtagacaggctgggtgcggtggttcatgcctgtactcccagcactttgggaggccgaggcgggtagatcatgacgtcaggagatggagaccatcctggctaacacggtgaaaccccatctctactaaaaatacaaaacaattagccgggcatggtggcgggcacctgtagtcccagctactcaagaggctgaggcaggagaacagtgtgaacccgggaggcggagcttgcagtgagccgagattgtgcctctgcactccagcctgggcaacagagcgagactctgtctcaaaaaaaaaacaagtggacatacctgagatacttggttttggtagaatttactcaagttctgggtgaagttctgagccaagtttaaagtctgtgagatattaaattgtattctaatgtcagtataaacagtatggtactgatgtaagcaggaataagtggtagtggaactgagtatcagccttaagtatatgttgacctttagctcgtactaaatctgacattttgtagaatgagattcttaccttaacctgatacacagaaaataatagaagcataaaagtggtcgggcatggtggtggctcacgcctgtaatcccagctctttgggaggctgaggctgcagatcacttgagcttaggagttcagaaccagcctgggcaacatggtgaaactctgtctctataaaaaatacaaaaattagccaggcatggaggtgtgtgcctgtagtcccagctactcaggaggatgaggcaggaacatcacttgagcccaggaggtcaaggctgcagtgagctgtgattgtgccactgcacttaagcctggacaacagagtgagatcctgtctttaaataaataaataaggtttgtaaactttgaaaaaacaaaattgaaagaactacgtagaatgttgaagaaaacataacattctcatcttcatgtttctttaacatttgtttttttgttgttggttttgtttttgttttttttttgaaacagtctctctttgtcactcaggctgaagtgcagtggcaccatctaagctcactgcaacctctgcctcccagattcagttgattcttgtacctcagcatccccagcagctggaattacaggcatgcatcaccacacctaactaatgttttgtattttcagtagagacagggtttcacaccatgttggccaacctagtctcgaactcccggcctcaagtgatccgcgtaccttggtcttgcaaagtgctgggattacaggcttgagccatcacacctggccacgtttgatttttttgttttaatacaaagaatacagttattatagaatcagagagtggcaatggcaggactatgtgtattggcctaaaaatatgcccatagtaaacttatgtaacgtgtaccatcttgaaaaaataatcccggttgttaatggagttgaaggtaggtaactctttccttattaattttttgcaaagatacgaagtttcaggaaaagctgatgacagaagtatgcatgttatagtctgagtttttttaagtgtggcatatgccctagaaaaagttctggaagaagtaaatactaatctctgaacatgggcttctgatgggggcagtggaattccaggatacttgtgttgtgtgataaagggtttttgattatttgacttaatgcatatagtttgcattaagggcatatatattgaaatgtgaaagatggacatttttgtttgtgtatattttctttacctctaaatatttatatatatacatttttgagatggggtctgtttcgcccagcctggagtgcagtggtgtgatctcggctcactgcatcctccatgcctcccaagctcaagcaatcctcccacttcagccccccaagtagctgggaccacaggcacacgccaccatgcctggctaatttttttttattttttagtagaaacagggtttctgtatgttgcccagactagtctcgaactcctgagctcaagatatccacccacctcggcctcccaaaatgctgaaattacaggtgtgacccactgcgcccagcctttaaatatttatcttaaaaaatagtatcaagatgttcctttaaataattcatcaagtttccttaaaatgacaagagctgcctcatggagcaataatagatacattcgtatctgcatcatatggggcaaatgtgggcagtaggattgcggttttatttttaaaccattttcatttgattagtctcaaatacttaaaaatcagaagattttgcatttaaaaagtctgaatttctggctgctttaaaaaaaaaaggacatgtctggcagacttgaccccctttctcctacagtgacacctgtctatagctgcactcatggctgactctagaagagctgtgttttctctccacttcagtcctcaccattctctattgttttgggtacttaaaacagttttacttggtattagctgcttggcacttgccatttagcttggaacacctatccatattgttgacttgaaaaaaaagttactcatatcttaggtgaaaacattgttttgtagatagtgtgcgtgaatacagatatgtgtggggaggaagaggaaaggtttatctcaaggtcatttgttggatcctgattcatttttctattgatttttaatttttatgtaatgagcatggattatgcatatacttcttataaagcttgcagagttacagataaaagtttatatgaataaatgttgagcatttcctctctcagttttgctcatttactaaaggttgaaatttgtctgaagggatggacatctccttagaagagcagcaggtcttcctctcctatgcctgaggcttgaatgtacagcccttgatggagggtatggccagggtggagccaggtcactacagacatctgtcctttccgagggtgctgtaaaaatattttctctgtgcactatgttgaaagtactacactagagcatgtgcagataatccaggaaaaagaccttagaatttatgtatttatattttaggttttttttgagacggagtctcgctctgtcgcccaggctggagtgcagtggcacgatctcagcttactgcaagctccacctcccggggtcatgccccgggttcacgccattctcctgcctcagcctcccgagtagctgggactacaggcgcctgccaccacgcccggctatttttttgtatttttagtagagacgggtttcaccgtgctatctaggatggtctcgatctcctgacctcgtgatccgcccgcctcggcctcccaaagtgctgggattacaggatattttatttttttaagaattatttctgtttttgtatttaagaggtacatgatatgtagtgtggtataatatgcatattatttaaaatcaatgttcacagtttatgtgcataaaaacgttgtgctacatgatcaaattcggccaccattagacatgattcatagctattatccatggagatactctgttgcatgccaaccagactcagactttgttaaacaataacatattaaatgctatgatggcctcaatttttttttttttttttgagacagagtcttgctccatcgcccaggctggagtgcagtcgtgtgatcttggctcactgcaacctccgccttccaggttcatgcgattctcctgcctcagcctcctgagtagctgggattacaggtgcctgccaccacgcctggctaatttttttgtatttttagtagagacagggtttcgccatgttggctaggctggttttgaactcctgacctcaagtgatccacccacctcagcctcccaaagtgccaggattacaggcgtgagccactgtgcctggcctataatggcttcaatagcttatttttctatcaacattgaaagcacccgggctcataaaggaataccaacaaatccacttggaggcatttttctgtattccagaaataacattttcttcaagcttctgtctagttcagagctttattttgtgattcatactcaattttcaaaggtattattaaaaatattttgtggggtttgtgtgtgcagtgagtttttgtttggttaagggaagatggtgcaaagatacttatttctcttttttactctagatggccctctacctgacccaagtatgatccgtggcagtgtgccaaaccagatgatgcctcgaataactccacaatctggtaaatagtgaaaaaaatttttttattttaaaagaatccccggtgtactgcaagataatacttgctacctgaacacccgctttatgccaacagcaagtgtcatgattacctgcccatagaggaagagggggtgaagagcaggttggctggcagatcacagggcaggtgacattaaatgatcaagtatccattaaaaaacaactgcaggctgggcatggtggctcacgcttgtaatcccagcactttgggaggccgaggctggtgtaccacctgaggtcaaagtacgagaccagcctggccaatgtggtgaaaccctgtctctactaaaaatacaaaaaaattagccggttgtagtggcacgggcctgtaatcccatttactctggaggctgaggctggagaatcacttgaacccaggaggcggagtttgcagtgaggcgagatcgcgccactggaccccagcctgagtgacagcaagacttcgtctcaaaaaaaaaaaaaaaagcagattgtaaaatttgtaaaattcagtttggagatcctgttagttgataatgtctgtttactgctactgtgaatgagacagatttatttatacttagaaggttgaaagccagtttattagtcctgatagaatcagggccaggtgcggtggctcacgcctgtaatcccagcactttgggaggctgaggcgggcagatcacaaggtcaggagatagagaccatcctggctaacacagtgaaacccccgtctctactaaaaatacaaaaaattagctgggtgtggtggcggacgcctgtagtcccagctactcaggaggctgaggcaggagaatggtgtgaacccaggtggcagagcttgcagtgagcggagattgcgccactgcactccagcctgggcgacagagcaagactccgtctcaaaaaaaaaaaaagatacagaatcagacataagaattctatcttttattattcaatttcacaaaggcattcagatctaacattttgctcatattcacaggtttgaatcaatttggccagatgagcatggcccagccccctattgtaccccggcaaacccctcctcttcagcaccatggacagttggctcaacctggagctctcaacccggttagtttgacgtctttggtaatctctttggcctttacctggtattttgaaaatcctgtttgttcctactttataaattctcacagtcatttaaacagaccataactcctagttcttctgtaattcttctgtatttaactctactagaaagctgaccaaaaaacgaaaacagccagtcccttgtccctggagtgtcagtgtttagtggcctgcatgcgttttcacggtcacttctcttccctgatgtctgtcttccctcctccaggcagagaactgtcttgcaaggttgatggtgcgtttttgcctggttcttgaactcggagaagagagactaggcttctcctgctccttatgcgaactcttaaccagtccatctctctaccttgaccctaaccctcctgctgccctttagagttagctggtgcctctgattcttgacccttttgggggttcctgagcattactacttctcactaatctgccattttcaacagggagttctgtccttcattttaacctataagacagatggtcttagcttatgaagtttttggcctttggtactcgagatttctttctttaaggcctgaatttgtgtagggtaattttggaaatgacatgtaacagtgctagagcatttgtggaccatgaatgctaccagattctgctacaacttgtaagattttcttgtttttacatattatgggtcttagaatttgtgttattacatcactgacatgacctcatgaaattgtgattaactctcctcacttaacagagcatgcaaagaaaattacctgctatccttgtgctaggcatatttgtgtaccaagagaatgtgtgttccatcctcttactatttcttggagtaggcctaggtaaactgtgaggctatttctctttatcttggcacaagagtcagttgttctacaactttcttccttctcctcttcagccctcttcacctatactcctgtctttggcttttctctacttaataagcctgacgttaggagcatttgatgattttagttatagtagaataactataatgaagcagtttggtgatttgtgttttttttttttttcagcctatgggctatgggcctcgtatgcaacagccttccaaccagggccagttccttcctcagactcagttcccatcacagggaatgaatgtaacaaatatccctttggctccgtccagcggtcaagctccagtgtctcaagtatgtctcataagtggatttttcacttatttttgattcttgaaacttctcttgatgtaggtttttataggagagagtggcagcaaatagtgggtgaaaacagatgattttttaaaaaataacaattttggacttagggtattctgaacatgaagagattattctgtgacatagcaatggtgttaattgttacaaagtaggaaataatttaaatggatagttttaattgtttttactagtgaacactttaaaataaatcttagaattaaacacaatgtagaaggaaatctggctgaaaagagcataggcaggccctagagcactctgcactcaattctgccatttttctgcggtggctgaggccattctgctgaatggtttgaagtctctttagttaagtactatcttgatggtgctgtccaaagatacatgcccagtaatagggtattttacacattttgaaatagacacattgctactctttgtttaatcagtttgtgtcctaaatttatatatcatgcctatgtaagtatttccttaattctgttctgaattgctgtcttgttatgttttttattttaacaggcacaaatgtctagttcttcctgcccggtgaactctcctataatgcctccagggtctcaggggagccacattcactgtccccagcttcctcaaccagctcttcatcagaattcaccctcgcctgtacctagtcgtacccccacccctcaccatactcccccaagcataggggctcagcagccaccagcaacaacaattccagcccctgttcctacacctcctgccatgccacctgggccacagtcccaggctctacatccccctccaaggcagacacctacaccaccaacaacacaacttccccaacaagtgcagccttcacttcctgctgcaccttctgctgaccagccccagcagcagcctcgctcacagcagagcacagcagcgtctgttcctaccccaacagcaccgctgcttcctccgcagcctgcaactccagtaagtagagatttggatttaggcagaatcattagagctatactgtagtattatattacttctgggccatttccattctcttttgctttatctcttactgttttctccacaagtagaatgtaatctatttttcattagggacttttgtatcctgttttgccttcctgtgatagtacctatcgtagcaggagcataaagattttatttagctctgactttgaccattatgtttcatgttgtaccctgaggtctgaaggtacgtaaaggggtacgacaaggggacacaatccttctccttatttagtatattatttagtgcagcacataaattttacatatatttaaggaatctttttcaaacagtttgagccataaaacctagagattgaatttaaaaattgcagatttggacgggcgcggtggtgtacacttttcatcctagcactttgggaggctgtggcaggcagatcacttgaggtcaggagttcaagaccagcctggccaacatggtgaaaccctgtctctacaaaaaaataacaaaaattagccagacatggtagcgggtgcctgtaatcccagctactcgggagactgaggcaggagaatggcttgaacctgggaggtggaggttgcagtgatccgagattgcgccactgcactctagcctaggcgacagagtgaaactccgtctaaaaaaaaaaaaaaaaattgcagatttatgagtccttgtggcccaaaccaaagtttaaaaataagatgagagaattatagacccagaacaacctgtagcttccttgtgagaggttggttatgtatataataaaaatccaaattctcatctaatagttgaatccttattaatagaactttttttaagggtttagaagcttctactttgataccgatattaatatatatcggtatccaatagttctcagccatgttgatgaactgagaagttccatgagtcacagccgttttataaagtactgtacttgacggatggctggttcatcgtggcctctgatagacaaggaaggacagaatgagagaggaaccagtggatctgcttgattttattctttataaaatcaaggatacttccagaaaatactgacttctcattaagagatttcttatgacaagccttaggataaagatagggaatgccagtttatctcattagaatctagcgattcaaaacagccactctctgggacatcattatatttattgtctccttttctgtacctttgaaactttctctggtgagaaggtaaaaacaagccagtctttcttattttctttcactcatttctgtataaatgtgagctcctctgaagcagacatctttgaaatccccacacactgccagataatgatagttatcaatgaaatagttgctggttctttgatgtacaatcagccaaccagtatttacaagtcttaattctcctgttcttaagcataattaagggaggtgaaatgggcagagcaaatgaaagcaccatgaataaatataagccaagaaataggtggctaattctgctatcctgttgcttaccttacattctgattgtatcgttggcagactctgcgtgtgtctcacctacttcccttttttttctgcccagctttcccagccagctgtaagcattgaaggacaggtatcaaatcctccatctactagtagcacagaagtgaattctcaggccattgctgagaagcagccttcccaggaagtgaagatggaggccaaaatggaagtggatcaaccagaaccagcagatactcagccggaggatatttcagaggtgagagtagggcaattactgtttgatttggttaggacctcagtataggaacccaagttttaaaaaatattgcagaaaaatattttgataattagatctcatggcatagattttgcatgagaaagggtgttcagattactgattcccaactagatatctttggaatactaaaaattcttacgttttcttttagtctaaagtggaagactgtaaaatggaatctaccgaaacagaagagagaagcactgagttaaaaactgaaataaaagaggaggaagaccagccaagtacttcagctacccagtcatctccggctccaggacagtcaaagaaaaagagtgagtctctgaagccattcgttctggaggtagctgaagaaaccaaagacccagggcagaattgcggtcatgcctcttgggcctcagaagttgccattattgtgatttcattaacctggaagccctgggcctggtctcttcattgttactaataatttttctttcttttttttttttttaatattcacttgcagcaaccaatgagttaagtcattcccctcatttcttcagggttccctgtgttagtacaccctaaaaattgtctcatttttcaggagagagaaatgtttgtaaatagccttgactaaaatgcaggaaagaatagcaatagtaatagcatttgtcattcacctgctgtgtgctaagtatccacattgtctcatttaataatttctttctttctttttcttttcttttttgtttggaatcggattctcacttttgttgttcaggctggagtgcagtggcgggatctgagctcactgcaacctccacctcccaggttcaagcgattctcctgcctcagcctcccgagtatctgggactgcatgcgcatgccaccatgcccgtctaatttttgtatttttagtagagacaggatttcaccgtgttggccaggatggtctcgatctcttgacctggtgatccacccgcttcgagctcccaaagtgctgggattacaggcatgagctaccacacccggcctcatttaataatttcacaacagctctgaggttattggcctgaagcttagcaaagttaagtaactttccacaggttactcagctgaccctactgcctgggccaggaagcagacccaggcagtctgaggcagagtgctcaaatccagccattccaacaagtgttaattgactattttaggactagaacttttgtggctctagtgatctgcaaaaggcaccaggtaggacatacctgaggagtgagtctgctggctcttacagatgatatatattgaaaagtgttccattaatacaatgtgttgtaaaatgttgggattaaaaaattattttcattttaaaaataagacttgtatatattgaggtgttttaatatgggctgtaacaaacccagtcttactattggcaatctctctttaaaatgtgtgttccctcatgcctgtaatcccaccgctttgggaggccgagcgggcagatcacttgaggtcaggagttcaagaccagcctggccaatatggtgaaactctgtctctactaaaagtacaaaagttagccgggtgtggtggctctcacccgtagtcccatctacttgggaggctgaggcagaagaatcacttgaacccgggagatggaaggaggttgcagtgagccaagatggcgccactgcactccagcctgagtgacagagagtaattgtctcaaacaaataaataaaataaaatgtctaatttcacaagtttattcaaatagtccttatttttagcacagctaaatatgagtgacaagcatcttcgtagtctggtttccccccactccatggcaaccccccagaggtgaaaattatctgaagtaacaaatatactctaccgatgatgaaattttttttgccaattaagaaaaaataaggcccttgctgaaattgaaagctttttaaatcactggcttctcaaagaactgtttgattccatttgggacacaccaacaaatttttccggactttttgggaaatatcattgagaacacatttgaacttaatttgatcaactaagtctattattttagcaataccatttttgttctctcttcttttaaacttaaacctaacatttgtcattaaaatagtacatgtctctttttctttggctctaaaataccaagcatttgaacgaaggagtcttctcttctgtgcccctgactccttgtagtataagacaatacctgatctagtctagtttctgacttgttaaatactgatgtcatgaagaaagacttttctgttcttgcttgactgcatctccctcttaacacgagtatcttgtgcactctttttttttttttttttttttttgagatggggcctcattctgttgcctaggctggagtgcagtggcgccatctcggctcactgcaacatctgcctcccgagttcaagcagttctcttgcctcaagcctcctgagtagctgagactagcatgccaccatgtccgactaattttttatatttttagtagagacgaggtttcaccatgttggccaggctgaaacttctgacctcaaagtgatctgcccacctcagcctccaccgtgcctggtcccatggactcttatttggcaaagtctcttcataaatttttagaagcctttggattctgcttctaattgaccgagtctgtcttcactgactttgtgactgaaaagttaagctgagggtgaagagtgttttaaggtgataagacacaatgttttttaggagctgtctgaaacaaagcggggcttagaatctagaatcagtgattgagcctgtagtgatatttccatggggacagagtggttaattttgttattgattcttgagatgcttttagagcttcaggctgaatgattttttaaagttcttctgcttaattggtaactaatttcaaatgcactttttttttttaagttttcaaaccagaagaactacgacaggcactgatgccaactttggaggcactttaccgtcaggatccagaatcccttccctttcgtcaacctgtggaccctcagcttttaggaatccctgtaagtatttggtggtacttttgattttattttttaatttgataacagctttattgagagataattcacattccaaacagtatagccactcatttcaaatttgtaattcagtgattttttttttttccccctgagacagggtcttattctggttgcctaggctggagtgcagtggcacgatcgtggctcactactgtctccacctcccgggctcaggtgattctcccacctcagcatcctgagtagctgggataactacattcatgtgccacctcacctggctagttttttgtattttttagtagagacggggtttcgccatgttgcccaggctggtcttgaacgcctggactcaagcaataggcccatctcagcctcccagagtgctggaattacaggtgtgagccactgggcctggcctaattcagggagttttagtatattcacagagttgtgcatgacactttcattttcatcatctgaaaaaaatcctttaccattaacagtcactcactattttctcccatagcaccccaatcctagacatcaccagactgcattctgtctctggatttgtctgttctacatgtttcattaaattggaacatacagtatgtgattctttgtgccaggacgttccttagcataatgttttcaaggttcatccatgttgtagcatgaatcagtagcacatacctatttatagcccaataatattccattatttttctttacctgttgatgagttgatagacatttaggttgtttacacgttttgactattaagataggactgtagtgaacattgtgtggatttaagtttttatttctccttggtatttacctaggagtggaattcctgggttatatagtttgtttacttttttgttgttgttatttgttttttgtttttttgagatggagtttcactcttgttgcccaggctagagtgcaatggcgcaatctcagttcacctcaacctccccctcccgggttcaagcagttctcctacctctcagcctcccgagtagctgggattacaggcatgtgccaccatgcccggctaattttgtatttttagtagagatggggtttctgtatgttggtcaggctggtctcaaactcccaacctcagatgatccacccacctcggcctcccagaatgcccagattacaggcgtgagccaccgcacccggccactttcgttgtttcaagagcaataggtcatagcagaaaaaaggaccgtggttagctttgtttttaaagttgcctccatatactaggctgctggcagatttcatttggtggttttaaactgttacttggccgggcacggtggctaacgcctgtaatcccaacacttttggaggccaaggcaggcagatcacttgagttcaggagttggagaccagcctcaccaacatggtgaaaccccatctctactaaaaatataaaaagtaactgggcgtggtggtgcacgcctgtaatcctggctacttgggaggctgaggcaggtgaatagtttgaacgaccctgggaggcagaggttgcactgagccaagattgcaccactgcactccagcctgggcaacatgttgacagagactccatctcaaaggtcaagtgcttccaggggcaaaagccttttaggacttttcctctcttgtatcttgctgtgatttcagatggaacattttaagttctgtgggcttagtttcctcattgtacaccccttctagtactaaaattttaaatgtctttgactttactgatctcacatgtactttcataaagaacctgaagttgcttcagtagaatatcagcctgatgtctagaaagtccatagtagttctgtttctctgccctttgagtagtttaatatctctgtaaactaatatttaaagaagtgatggacatcagtcacctcttggggaatatagacaggccagaaactaaaacactgcctggaaaattaacaatgataatggatgatactccatctcccgtaaaaatagtgagacttgagtaatgtttgatgtcacttgtctttctaggattactttgatattgtgaagagccccatggatctttctaccattaagaggaagttagacactggacagtatcaggagccctggcagtatgtcgatgatatttggcttatgttcaataatgcctggttatataaccggaaaacatcacgggtatacaaatactgctccaagctctctgaggtctttgaacaagaaattgacccagtgatgcaaagccttggatactgttgtggcagaaaggtaagaaatgtgtttcagatttgactttaacttttctgggatacctagaataatatagtggtgactgggataagagaatatcctgcttctggctttgacatggcttttttttttttttttttttttcctttttgacagggtcttattctcccaggctggagtgcagtggtgaggtcatagctcactgcagcttcaacctcctgggctcaagcaattctcccacctcagcctcctgagcagctgggactacagccgtacgccaccatgcctggctgattttttaaatttgttttgtagaaacagggtctcatgatgttgctcaggctagtcttgaactcctgggctcaagcagtcctcctgcctcggcctcccaaagtgctggaattacagtcatgagccacctctcccagccaacacagtctttctcttactgtgtgccacagtagtaatatctcttaatatgaaatgggctttctttaaaggcattttttcagagtggcaattgtatggaaaagttgactaattaaataatcaacagactgttaactcatctggagtaggggcattcttatattcacctgtgggtgcagattcctcagcatgtgctggctttcctgtacataccaattcacattattggttttttgtttttaaaataagactatggtcttgctgtgttgcctaagctggtctggaactcttgggctcacgcagtcttcccacctcagcttctgagcactgcaggcatgtgccaccctgcccagctattcctgttaggttctttggtaaagtgatggaaggatatgactgctaagcctacctcagcgttttgaaataatgtggtagtaaactgagaatgattttcaggaactgaattagcccatcattattaacataaatgagaactaagacaccactgacttctgtttctgacttgccattcttactgttctagcttgtccttaaggcctctgtgctttttaacaaatggtttcttttgcagttggagttctctccacagacactgtgttgctacggcaaacagttgtgcacaatacctcgtgatgccacttattacagttaccagaacaggtaagcttggccaggtgtggaccatggtccatgtgtccacatgtccagggagtgcatgcggatgggccagcacacatacagtcatggttcatgtgtatcttgcttgaagacagctgtatagcacaagttctgttttttgccttctgcctttgtttgcagaacaataaaattttctatcagagtagccttgcatcagttacctgggttcctcccaagagcttgagaagttaagcaactttgtgagttgttggcctagatgggtctatatcccaggccccacttctctttctactgtgtgtttgttgatcaccacagcctgaggcaaaactgagaagatttttaaacttttaactgaaactcgctagacagctttttggaaatatttcctttttagatgaggcctatccctaagtagttgttattagaatatatgaaaacaggattctggagtcttttctttgcctcatattaagcaaattaaaaggaaaacctcacatagctctctgtaccttacttttcccaacccagccttgtatgtgacagaggatgatttgagtctaataaacgaggcacctctgcctaattttctcctgcccaatcaatggctgtaatcacataaatctcattcactaatctatcttaaccacaatttgtctcctgttttcagtgatcagctacaagtatagcttgcattgggtgtttatttggggctctgatacaataataacaaggctggatgatattaataccctttatttgtttgttaataccaaatccatggtgttggtttttgctgaacttgtgtgttgcagatgcatttctagctttgaaaagtcacttaaactttttcttttatttacaaaaagttaggcgtgcttctaatgctttgtagacctaatgctttgattttgcagtgagtaaaaatctagctctttactcatttgaaacctagaaaaggtgggactcaagttgttataagtaccttatgtttaaaaaagcaagtaactggacatgaaacttttctcatgtttactaaaacagtagtctaaagtgtttatctttgcaccaagccatctttaatcaggtacctgcacacatcatttccttttgaaatgtatcacttgatggctgtagtcagtatttaactgcttgtgcaggcttttcaataaacagttttttttctttctttgttgagacagggtctcactctgtcactcaggctggagtgcagtggcgcaatcttagctcactgcaacctctgcctcccgggttcaagcgattctcctgcctcagccttccaaatagttgggattacaggtgtgtgccaccatgccttgcttatttttgtatttttagtagagacagggtttcagcatgttggccaggctggtctcgatctcctgacctcagatgatccaccctctcagccttccaaagtgctaggattataggtatgagccaccacgcctggcaatggttgttttagattattgttttctgcagttgtatctatagtgggcttttggggtggggggtgggggtctgtggttttttgttttgtaagtgggaagaggtgtgattcctgtatttaggtaatgagtagcagttcttctctccctggtatatttatccttcttcctccttttgattatttacatcacatagcgttaattgctgaaatgaaaggatatgggtctgtgtaattgaaacatttgcttttatttgcagtaatcatttgctacttgtgatcccatttgagatatttaatgctaatctgtgctttgccttggctttctgctttgtgttgttctgtcttgcttttatgttttttgttgtcttgcaatccctcatttcttcgtttgttttgtgtttttttttctccctcatgcttgtcgttgtctgcacttggctttgattgcaaaaaaaaaaacaaaaaaaaacaaaaaaacaaacaaaaaaaccaaaacccaaactgtggggcccatatatctgcatcattgaatgtccttgtcgccgttgatgacctgctctctgctcccgtccccctccttggcctgctgtgattggtggcttcgttgcttggcttgggctgtgttgtgtgaacggaacagttcaccccagtatggccttcttgccgacaggtatcatttctgtgagaagtgtttcaatgagatccaaggggagagcgtttctttgggggatgacccttcccagcctcaaacgtaagtaactgcattattttgaaaagtgctaattagtttgttgtccagtgattatgcacagcttatttctaaatgaacttaagctatgctgttgaatatggtagccattagccacatgttgctatttaaatgcatattaatttaaataaaaattgtttatcacatggaatactcacatttcaactgttcagtagctatctgtgtctggtggctaccatattggtcaacacagagaacatatccatcatagtagaaagctctttgagacatcaatgaattagggaatatgtcagcaatgggcaatcatcttagttctagtaaaagtattctgtataggaagcaatcagcttctcttcgaaaaattggaggttagtacaagaaaacatcattattaactgttctgagtttgagggtgattgaactgatgaccaccttacacccttctcttgtaggttaacagaagacccaagtcactattgtagtgaataatagactttaacagcatgccggggtttaagagatttgcttgtgctttgcagtctcacaagctcttaccatttggtaaatggccaagaaaaaaatttcaaacatatagtctaatagtttaatctctggccaggcgtggtggctcatgcctgtcatctcagcactttgggaggccaaggcgggcggatcacgaggtcaggagatcgagaccatcctggctaacacggtgaagccctgtctctactaaaaatacaaaaaattagccgggcatggtggtgggcgcctgtagtcccagctactcgggaggctgaggcaggagaacggcgtgaacccgggaggtggagcttgcagtgagctgagattgggccactgcattccagcctgggcgacagagcgagagtctgtctcaaaataaataaaagaaaaaaagaaaaaagtaacttaagatgtaggcagtcattagaattcaaactgggactgtctaagaaggaaaaactgttcagtgtaattttaatattattgaaagttcatatttacttctgttcaggacgttgcacaaaaatttggaattctcttgttcctagtaaaaatggggcttctgagaaaagctggttaatttttctaaattgcgttctaaagatagcagtgtctgggtgctagctaggagagtagatactaggagcctttgatccttgaaacattttgacatttggttaagccaggaaggttagctctagggtaagtttccttgatgcaggaagagacgtaagccttgtcattgaactctcaggtggcttaccaaatagtctaaaccttaaggcagtacatctctaactttgaaaagagtaggaacaagacccttcccaattctgcaggcctgtagtggatccaagtgtctatttctaactcccagattgttctggtgctgctcatcttcagattgcacttggagtagcaagacaggccattcaggaaaatgctattaacagagatgaatgaatctctaggccataactagtataagaaacggttttcaatgtggacatgtcctcatttttgtaaggaagtataacagaagtccaagttggtccccctaatgttgattctagttggagaatgtggatcctagttggagaatggtaagactgttagcttttgtatgtagtgaggctatgagcagtgtgttatgctgggtttcaggatgggaagccatgatacctaacaccaagaatagtaacagacaagattttaaaaggaaaagaagaaacagtatttctagttcttcctgggttctccatttctgataagaggaaatttatttactatgaagtcctatagaatattcctttacataaacatgcattttgtgtgagccaagaatacacctatttaaatgtgtattcttaaaaaacctgaatctctatatagggtgaagtttgttcctttggttagaacagcagtcagattgctcatctctatcactttttctcattgtgtcccttttctctccttagtacaataaataaagaacaattttccaagagaaaaaatgacacactggatcctgaactgtaagtacgatccccttgaatagtcagtacgctttggcttttctttttccctttcattctcttgaagtttgcatgaccaatcagatgatcctatattcttgggctaaatctacataacatacatctaatggatagtaaaaccatggaaaacactgaagtactaaggaacattatttcttaatgttaattttaatgttcttaatgttgaatgtgaaacattaaagatctaaacttctagtttgcagtgaggccttttagatcatggaggactgacatgtatgtcttctagatgttcctaaaatggatgggatggtatttggatttatttggaattttcagcaccaggaatctgtcttaaaaattagccaggttttggccgggcacggtggctcacgcctgtaatcccagcactttgggaggccgaggcgggcagatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacctgggaggcggagcttgcagtgagccgagatcccgccactgcactccagcctgggcgacagagcgagactccgtctcaaaaaaaaaaaaaaaaaaaaattagccaggtttggccgggcacagtggcccacatctgtaatcccagcactttgggaggccaaggcaggatcacccaaggtcaagagttcgagaccagcctggccaacatggcaaaatcccgtctctactacaaatatataaattagctgtgcgtggtggtgcgcgcctgtaatcccagctactcgggaggctgaggcaggagaatcgctggaacccgggaggcaggggttgaagtgagctgatatgacgccactgcactccagcctgggcgacacagagagactccatctcagaaaacaaaacaaaaaacagccaggcatgatagtatgtgcctatcctagccaggtagctgagaggccaaggcaggaaaatggcttgagcccaggagtttaaggttgtagtgagctgtgatcatgccacccactccagcctgtacaacagagaccctatctctaaaaaaatagaaactttattaaaactattttcagttctttggtcatgaccttggctgtctttgtcagaagtcatgggaaatattgcaagttttcatttggttaaggtttggggttaattttggaattggctctgctcttccaggtttgttgaatgtacagagtgcggaagaaagatgcatcagatctgtgtccttcaccatgagatcatctggcctgctgggtaagtcttaacgttgttactttctctggaatttttctttatcgtgaatattaacaagttttttattctatgcaattgactgtattatatcttcaaagttactatctttaaattgttttctttgggtttggccacgataattatagttcgctttttaaaaattaagtaacctagtatccaaaaatagatttttatcttatttttatgcattcttcttagccatataaatatattttattctgctggattgtttattaaaattatattgtagttattacacatcaaaagtaaatatttatggccaggcgaggtggctcacgcctgtaatcccagcactttgggaggccgaggcgggcggatcacctgaggacaggggttccagaccagcctgaccaacatggcaaaacctcgtgtctactgaaaatacaaaaattagcctggcgtggtggtgcacgcctgtaatccagctactcaggagggaggctgagggaagagaatcacttgaacctgtgagggggaggttgcagtgagctgagatcacgccactgcactccagcctgggtgacagagtgagactctgtctcaaagaaaaaagtaaatgcttttgttccggcatctagaaactaggatcatgctgctggcatgaataggtctggccctggtaagggtcaccatttggttagggcaggaacagcaagttataaggctgcagtcatagtgtaattgcctagtaaaagggaggggccatcgctctgtacaagaggaactaatcccagccatgttccaaaggaagcgggtatatgggacatccagtgcctctcattaagatgggatctccatctcttctgctctgttcttgggctgattgttgttcctgatttggaggttacaagaaagggcaggctaattgacagatttcacttttctttttttcaccgttattttcacatagaaaataacactaaggaaaataggtgatggtttagtggatactttattttcagtgtgacttgtcttttaagtgtgcctttttagtgctttccttaacagatttcgtaagaatgattaagagacttcttgtggttcttctaatttaggatcagtcaactgaatgaaaataatctgttattactgtgttaagcttgctttttcttaaaagtaatttatgttcattataaaatttgaatagtatgacagtttatgaagtaaaaagcgacggtctcagcttctctcttcccacccagattcctcactacaggaataacactcttttgtacatacaatcatacattttctttttttctttttttgagacagagtttcgctcttgttgcccaggctggagtgcagtggcgcgatctcggctcactgcaacctctgcctcccaggttcaagtgattctcctgcctcagcctccctagtagctgggattataggtgtgtgccaccatgcccggctaatttttgtattttggtagagacagggtttcatcatattggtcaggctggtcttgaactcccgacctcaggtgatccacccacctcggcctcccgaagtgctgggattacagcatgagccactgcacctggcacattttcttgatttatgtgtatttaatttttaatttttgtattttgttataagtcatagacttttttaattgagtctcactttcatcacccaggctggagtgcaatggtgtgatctcagctcactgcaacctccacctcctgggttcaggcaattctcctgcctcagcctctcctgcctcagcctctcgagtagctgggattacaggcacataccaccatgtctgaccaattcttgtatttttactagagacagggtttcattatgttggtcagggtggtcttgaactcctgacctcaaaagatccacccacctcgacctcccaaagtactgggattacaggcgggagccaccacgcctggctggtcatagacactcatttatgtctgctgcatttttaatggatgcatagtattctgtaacatactataatccatttatttacttggttgatgaacaagtttatacaagaaactacttaggagacaaatatcatgtgcatttgcagtagctgaatctattggttctactctcaaaatgtactttccaactagtagcatataggaaatgtcacctcttaggatttttctcccctatcacattagcaaaacctatcttgatttgtaatccttgatcatcttttcctgtgtaaaccaatttatatgcccttcatgtttcttcatgtctgttgcttgattttcaattatcttttttattcttactgatttctaaaagctctttgtgtattagttttattaactcttcattagaaatttagaaatacttctgctagattgtcttttgaattttaactttttgttagtataaattcaacggtttatctaagttgtgtaagcaaagttttggtttacatttagattcgtctgtgatggctgtttaaagaaaagtgcacgaactaggaaagaaaataagttttctgctaaaagtaagttttattcttaaaggtaaattttggcaaaacttatctgaagcctagataagaaaccatccaaagtgaattactttgtttttaatcacagtaatagagtaaaaataaaataattctataatctccttatagttgatctgtaatatattttttggtgtgaaatttattagaccaaagaaaaaaatttccaaggaacggatttgtagaatgcacaagatacgtgtttttcctgttcctatatttttccctatttggggcatttcataaaggaggaataaggtgtggaaatgattggccggaattgccatctctcagtttgtttatttattattttttattttattttttgagagtctcactctgtcccccaggctgcacagtgcagtggcacgatctcagctcactgcaacctccgcctcccaggttcatgtgatttttctgtcttagcctccagtgtagctgggactacaggcatgtgcctccacacccagctaatttttgtaatttattagagatggcgttttgccatgttggccaggctgatctcaaactcctgatcacaggtgatccacccaccttggcctcccaaagtactgggattacaggcgtgaaccaccatgcccaacccctcagttcacaccatttatatgggctaccttttggccttatgtgattgttttctactgtgccaggaggatgtcaaaaattttatcatgtaagtaattaacactaataatctaaatgtagtatttgatttagttttggggtgttttactgatctacagattattttgattcttgtaaggtttctcaaaatgctcaaccttcgttactttaaaatattactgcaatctaggcaaagtacatagagatgttcattgtttatatatttgtgtgtgtgtgtgtgtgtgtgtgtatatatatatatatatatatatatatatatatatatatatatatatatataatgtttggttggttgggttttttgttttttggaaacaaggtttcactgtgttgtccaggctgatcttgaactcctggattcaagcaatcctcccacctcagcctcccaaagtacaaggattaggattatgggtgtgagccttgtctcctggccattgttctatttctgtttgtttttgtttttttttttgtttttttttttttttttttttttttgagacagagtctcgctgtcgcccatagtggcgcagtctcagctcactgcagcctctgcctcccgggttcaagcgattctcgtgcctcagcctcccaagtagctggaattacaggcgtgcaccaccatgcctggctaatttttgtatttttagtagagacggggtttcagcatgttggccaggctggtctcgaactcctgacctcaggtgatgcgcccacctcagcctcccaaagtgctgggattacaggcatgagctaccgcacccggcccctgttctgtatttttataaactcttccaaaattggaaatttttcaaaatgagaagttggggaaaatgatatttagaaattattgagtactgtgtctgctttaatagcacatgtattaaaattagaatgatatgaagattagcatgttccctgcactcatatgacatgtaaatctgcaaagtagtgactactttgctatgattttttaaaatttcaccaagttatcctgtttgtattgaaaaaagtacaaatgagatttgaggttgaaccttaagactaacaacagtaaatttgcacctcagtaacttttaacttttacattcctagggttgccatctaccagacttggcacctttctagagaatcgtgtgaatgactttctgaggcgacagaatcaccctgagtcaggagaggtcactgttagagtagttcatgcttctgacaaaaccgtggaagtaaaaccaggcatgaaagcaaggtatctagtcatttcacttttcttctcctcgtggatccaaaattgctcatacatggttactattggtgattccagtctgaatgagttatgttgtggttcccccaccatctcaattgtataggtttgtggacagtggagagatggcagaatcctttccataccgaaccaaagccctctttgcctttgaagaaattgatggtgttgacctgtgcttctttggcatgcatgttcaagagtatggctctgactgccctccacccaaccagaggtatgactagctcacagtggctagctccggatttgtgtgggagttccaacttataataggtggaaaagcataacaggcaagaaaatgtttagtgtgtttggtttggaaatgcaaaatctcaagtgtccagtaattttaaagtgaaacagattaaaaagcaaacccccaaacaaaataaccgctcaatactgctcttctgtggtcatagtaataaaggatatgaatagcaacctgaaattggaatttgaaaacaaacgtactactcttcagaaaatgagcttaaatctggattaagtagctatgtgaaaatatatcatacaaatcgggtgggaatttcttttctccaaaaatagtataaaggcaataataaaaacgtatagggatcaccaaatactgattgatgtgtatgtgccaggcactgctagttactacaaatagaaggaaaccacaggctcactgaacttccctgaagggttcacggcggagtcgcctacctgcctgtgatgagcttcacaaataacgatgtgagcaaagagcctgggagagtgagagggtgttattaggcacatggagtaaagaactcattatgtgacctgactttttttttcctcttcatttctcttcattttgtataggagagtatacatatcttacctcgatagtgttcatttcttccgtcctaaatgcttgaggactgcagtctatcatgaaatcctaattggatatttagaatatgtcaagaaattagggtaagcatattttgataatggctttttttctttaactagcatggcattctggtgagatataggttaaatatgcaaatatataactcttggcctttttttcctcattttagttcttacgtaacaattctcttaactttgttggagcccctttgaagttaatgtcagtagagagaaatggatatgttggccctagtttcacccatccaacattagttttgtttgtaagctaagccattgggtccactttgctttgaagtttgatttgtgcccctcatttgagggcagaattttaactgcatttgatccttttacaacctgggtatgaagaccaaaaacagttctggagatacttcttacctttagagtatgtatgtcattggaaacattcactccctcatcttgaagtctgtttctctgaacagtgtgccttttaatttagctcttgttaaatgggtccattttcctttgcagtgtaatcttcatttggtcttaacatgcagacttagggtttttggatccagggctaagtcacccacttcgtggctgagattcgcaacatcccaccatggcctccaaaaataagtaggcaatatgagatccattgttactactgtgagttatgcctaattttggcctcacaatgttaatctcattctgggttatatatacactgtgttatcttgggaaaaattattggtatctatatcaactccaacttgtggtttaaaatgtagccttctagaatagattatctcttttccttaatgttctttctctttgtattgttagttacacaacagggcatatttgggcatgtccaccaagtgagggagatgattatatcttccattgccatcctcctgaccagaagatacccaagcccaagcgactgcaggaatggtacaaaaaaatgcttgacaaggctgtatcagagcgtattgtccatgactacaaggtcagttgggacataggggccaggtgctgacaatagatctggaaatgcactaatgttgctgctctttgttctgtcatttaacttttttttttttttttttttttttttgagacggagtctcgctctgtcacgcaggctggagtgcagtgacacgattttggctcacttcaagctccgcctcctgggttcatgccattctcctgcctcagcctcctgagtagctgggactacaggctcctgccatcacacccggctaaatttttttgtatttttagtagagacggggtttcaccgtgttagccaggatggtctcgatctcctgaccttgtgatccgcccgccttggcctcccaaagtgctgggattacaggcatgagccaccgtgcccagccttttttttttttttttaaacaaaagtcttgcttgttctacctcttgcatgtaattcctaaaaatgctaatttgattgcttttattttgtatattcaaaatttttcaatataagaaaaaccaggttttgaagagcggtagatcaagaaatccctgttttaaacatgtaaccaaaattttattttatttatttttggggggagggtggggatagagttggggtatcgccatgctgcccaggctggacttgaactcttggcctcaagcattccaaagtgctgggattacaggcatgagccactgtgcccggccttaaaatatatctttttgttttggttttttgttggtttggtttgggttggttagggttttaggggtgtgggtgttttgttttcagaaagggtcactctctgtcacccaggctagggtgcagtggcatgatacccgctcattgcaacctgtgcctcccaggctcaagccatcctcccatctcagcttcctgagttgctgggactaggtgcacactacgagagctagctgatttttgtatattttttgtagagacaggatgtcaccatgttgcccaggctggtctcaaactcctgagctcaagtgatctgcccacctcagcctcccaaagtgctaggattataggcatgagccacatcacccagccaaaaatatattctcccttttttttttttggacggagtttcaggctggagtgcaatggtgcagtctcctgggttcaagtgatggtcctacctcagcctcccgagtagctgggattacaggcatgcaccaccaagccaggctaattttttctatttttagtagagacggggtttctccacattggtcaggctggtctcgaactcctgacctcaggtgatccacctgcctcggcctcccaaagtgctgggattacaggtgtgagtcactgcacctggccaaaaatatattcttaattaacagtattatgttattcataaatataggttgtctcatgatacagacttgtcttcctcaatttagtagttcaactaaataaagaagttttcctaagcagcccagcaaatcattctgcagcagatactatttccagtatttgtagttttggtcattttgaacaaagctgtcagtaaaagctgctgaaattccaaggatgggtgtgaggagggcatgcttcataccacatattctgtgataaggagtggtaggggccatggcatgcatgatggtgctaccaccctgacgttgatcctggcaggataattgccacttggttatataaaggcagataagctccctgtttttgtgggtagaagaaatagaaaaccggaaatattgactttaggccaggccttttcactatttatttttctaaatactccctggcttacggcttaggtataaagtctctgccagctttcaagacattttaagctttcatgtttcttgtcagccatgattattctgtataatcaatgctttaaaagaacatagaaattcctatatgtacatgcatgttttcacaggatatttttaaacaagctactgaagatagattaacaagtgcaaaggaattgccttatttcgagggtgatttctggcccaatgttctggaagaaagcattaaggaactggaacaggaggaagaagagagaaaacgagaggaaaacaccagcaatgaaagcacagatgtaagggcattgagtttcctttgaaacttctatcatgattctaatatttaatccagaagtgcacttaaactttcaattgggttttaaagctttcaggtgtaaaagagctctttaagttggacaagaaatattggcttagagaggttattagggttctgtttcagtggtattaaacttttaaagcatcagagccccttttaaaatggcatctcagactttgagtaatgtgaaatgataaaagaaactgaaggaaatcctgaaaaactgatagaagattacttatctgaaggactaggttatgaatattataggccttgtgggtcacatatctctggcatattttctgtcttttaaaaacacactctttttaaatgtaaaaaaccattcttagctatacaaaataggcctgagccagaatttaagttactaagcctggcttagtaacctcaccagttatttccccatagcatatctcgaattacctccattgaatttaacttaacaaaaggcacccttaaatagtctgttaacaaactcttacagccttgtcatttagtatttgtaggctcataacattttagaatatgagtggaaggaaataaaaccaaggtcttctggctccccactttgatacactcttcactaccccaaagtgccaccccttccttgttccctagccccaatctgggatacattcaatcaatctacagggtctgcacattctgtggcctcttctaggcaaaaagctaaagggctgccattgccttaaagatcactgggagaaaattaggtcaaataacaactttaaggagaaagaataagtgaagagaacagctagtaaaataagttacaggcataagattatgatatctagtttcaaagaagggagatattctgtgctattcccaaattacttaacaaaaaccttattttcttgtctcctttgtgctactctgcaggtgaccaagggagacagcaaaaatgctaaaaagaagaataataagaaaaccagcaaaaataagagcagcctgagtaggggcaacaagaagaaacccgggatgcccaatgtatctaacgacctctcacagaaactatatgccaccatggagaagcataaagaggtaagatgcagccacccagagttggggaaaaacggcaagatttctggccaggcatggtggctcacacctgtaatcccagcactttgggaggccaaggcgggtggatcacctgaggtcaggagttcaagaccagcctgaccaacacggtgaaaccttgctctactaaaaatacaaaattagctgggcatggtggcacatgcctgtaatcccagctactcaggaggctgaggcaggagaattgcttgaacctgagaagcggagattgcagtgagccgaggtcactccattgcactccagcctgggcaacaagagcgaaactccacctcagaaaaagaaataagaaatgaataaaaacactgactgttcgctgggcgtggtggctcatgcctgtaatcccagcactttggaggttgaggcaggcggatcacttgaggtcaggagttggagaccagcctggccaacatggcgaaccgaaaccccgtctctactaaaaatacaaaaattagcctggcgtggtggcacacacctgtaatccttgggatgctggggtgggaggatcacttgaacctgggaggcagaggttgcagtgcacttacagcctgggtgacagaacgagactctgtttcaaaaaataaaaagatttaacctttctgaaagtgaattagtaaatagaattggagaaaagttaaacttccacatatggacttacaacccccttctcaaaactttttgagttatttcatcatttacattgtttagttgttcttgcagtcatttgggaaaataactgggtaaggttttttttttctctctttaatatcatataattgataacgaaagccaggagaattgaagagtaattcctctcagggtttgtccaatggtagtaatctcgattgttcagtcagactcctcattttactatctcggttctcagacatataatcaagttcttataggaagtggtaattaagttgagagggaaatgaaggcttgatttcaggttgtaattccgtacctaaaaattggttaaacagtctctttgggagagaaatagttaacaaaatcttttttagagaggaatttgttataatgatgttatcatggtgaacacctatatacataggtgttcaaagtatcttttcccccactgctccccccatcaccaccccttttttgttagcctagaataatgggctacgatgtaataatggtaataaccattatctcagccatgctagtgaaatggaaggattcctgagttctaatacgttaggtaatgattattaacaattaatagttactagctatttcaagcagtaagtaatgccacagaatcctaggcagttgggaaaagcccttagaatatattgtaataggtttgacttaaattgtggacacattccatggctgtttaaatttaggttgtaaatccaagtattggcctggttgtagggtgacagaagcagcgaacattgctggccagagactgtgagtgtggctgccagtgtgcacagatgttgaataatctgttatcagtacagcagtttctcacaagttcctaatttcttaaggggatgttttacattttattactttaataggtgtttatagttatatactaattaatgtcaaatacatatgtaataccagctttttataccttttacactaatggttatgagaattgatggttgttacaagttttttcaaacttcaatgaacaagaattttattgctttgtcaacaaagactaagattttttatccattccattcccttccaaacctgtaggaaaagttacacaggaaagttgcataggggaccttcatgagtccaggccagttgtttttcatactgtctccatatttggatttgtctggtttgttgtaattagattgaggttaaaccatggattgcatcttaaagtagactgccttgaggcaaaatgtccactgtgcatggtgctatacctcacccagaccattgttactctgaaggagttactgaatgaaggagaaaaaaatcacaggatgtgcatttcagttctatttatagtcagtctcaagagaccaaagaggtaaagcaggaaaaggaacaggaggcgtatggtggtgaaactaactcagcattcgccagtctcattggtgctcagcctgctgtacctgctcacacctgtaatcccagcactctgggaggctgaggcaggcagatcacttgagcttaggagtttgagaccagcctgggcaacatggcgaagcctcgtctctacaaaaaatgcagaaattagccaggtgtggtggtgtgggcctgtggtctcagctattcaggaggccatggtgggataattgcttgagcccaggaggcagaggttgtagtgagccaagatcacgccactgcattccagcctggatgacagagcgaggccctgtctcaaaaaaaagagactgtctgtttttcaggtcttctttgtgatccgcctcattgctggccctgctgccaactccctgcctcccattgttgatcctgatcctctcatcccctgcgatctgatggatggtcgggatgcgtttctcacgctggcaagggacaagcacctggagttctcttcactccgaagagcccagtggtccaccatgtgcatgctggtggagctgcacacgcagagccaggaccgctttgtctacacctgcaatgaatgcaagcaccatgtggagacacgctggcactgtactgtctgtgaggtaggcaccgggttgtgggaaggaggaggtgagctccgcagggttgttctgaggggccatgcagccacgtattttatagaggcctgtgggatgctaggggcttggcctcgtgtttgaggggcagagctgaagaggctagtttttgttctacgaaaggggcttttctagcccaaacaatatctaaaatacttttgaatgacttaaatcttggagagtttacgtgcacctcctgttttttccctaggattatgacttgtgtatcacctgctataacactaaaaaccatgaccacaaaatggagaaactaggccttggcttagatgatgagagcaacaaccagcaggctgcagccacccagagcccaggcgattctcgccgcctgagtatccagcgctgcatccagtctctggtccatgcttgccagtgtcggaatgccaattgctcactgccatcctgccagaagatgaagcgggttgtgcagcataccaagggttgcaaacggaaaaccaatggcgggtgccccatctgcaagcagctcattgccctctgctgctaccatgccaagcactgccaggagaacaaatgcccggtgccgttctgcctaaacatcaagcagaagctccggcagcaacagctgcagcaccgactacagcaggcccaaatgcttcgcaggaggatggccagcatgcagcggactggtgtggttgggcagcaacagggcctcccttcccccactcctgccactccaacgacaccaactggccaacagccaaccaccccgcagacgccccagcccacttctcagcctcagcctacccctcccaatagcatgccaccctacttgcccaggactcaagctgctggccctgtgtcccagggtaaggcagcaggccaggtgacccctccaacccctcctcagactgctcagccaccccttccagggcccccacctgcagcagtggaaatggcaatgcagattcagagagcagcggagacgcagcgccagatggcccacgtgcaaatttttcaaaggccaatccaacaccagatgcccccgatgactcccatggcccccatgggtatgaacccacctcccatgaccagaggtcccagtgggcatttggagccagggatgggaccgacagggatgcagcaacagccaccctggagccaaggaggattgcctcagccccagcaactacagtctgggatgccaaggccagccatgatgtcagtggcccagcatggtcaacctttgaacatggctccacaaccaggattgggccaggtaggtatcagcccactcaaaccaggcactgtgtctcaacaagccttacaaaaccttttgcggactctcaggtctcccagctctcccctgcagcagcaacaggtgcttagtatccttcacgccaacccccagctgttggctgcattcatcaagcagcgggctgccaagtatgccaactctaatccacaacccatccctgggcagcctggcatgccccaggggcagccagggctacagccacctaccatgccaggtcagcagggggtccactccaatccagccatgcagaacatgaatccaatgcaggcgggcgttcagagggctggcctgccccagcagcaaccacagcagcaactccagccacccatgggagggatgagcccccaggctcagcagatgaacatgaaccacaacaccatgccttcacaattccgagacatcttgagacgacagcaaatgatgcaacagcagcagcaacagggagcagggccaggaataggccctggaatggccaaccataaccagttccagcaaccccaaggagttggctacccaccacagcagcagcagcggatgcagcatcacatgcaacagatgcaacaaggaaatatgggacagataggccagcttccccaggccttgggagcagaggcaggtgccagtctacaggcctatcagcagcgactccttcagcaacagatggggtcccctgttcagcccaaccccatgagcccccagcagcatatgctcccaaatcaggcccagtccccacacctacaaggccagcagatccctaattctctctccaatcaagtgcgctctccccagcctgtcccttctccacggccacagtcccagcccccccactccagtccttccccaaggatgcagcctcagccttctccacaccacgtttccccacagacaagttccccacatcctggactggtagctgcccaggccaaccccatggaacaagggcattttgccagcccggaccagaattcaatgctttctcagcttgctagcaatccaggcatggcaaacctccatggtgcaagcgccacggacctgggactcagcaccgataactcagacttgaattcaaacctctcacagagtacactagacatacactagagacaccttgtagtattttgggagcaaaaaaattattttctcttaacaagactttttgtactgaaaacaatttttttgaatctttcgtagcctaaaagacaattttccttggaacacataagaactgtgcagtagccgtttgtggtttaaagcaaacatgcaagatgaacctgagggatgatagaatacaaagaatatatttttgttatggctggttaccaccagcctttcttcccctttgtgtgtgtggttcaagtgtgcactgggaggaggctgaggcctgtgaagccaaacaatatgctcctgccttgcacctccaataggttttattattttttttaaattaatgaacatatgtaatattaatagttattatttactggtgcagatggttgacatttttccctattttcctcactttatggaagagttaaaacatttctaaaccagaggacaaaaggggttaatgttactttaaaattacattctatatatatataaatatatataaatatatattaaaataccagttttttttctctgggtgcaaagatgttcattcttttaaaaaatgtttaaaaaaaaaaaaaaactgcctttcttcccctcaagtcaacttttgtgctccagaaaattttctattctgtaagtctgagcgtaaaacttcaagtattaaaataatttgtacatgtagagagaaaaatgactttttcaaaaatatacaggggcagctgccaaattgatgtattatatattgtggtttctgtttcttgaaagaatttttttcgttatttttacatctaacaaagtaaaaaaattaaaaagagggtaagaaacgattccggtgggatgattttaacatgcaaaatgtccctgggggtttcttctttgcttgctttcttcctccttaccctaccccccactcacacacacacacacacacacacacacacacacacacacacactttctataaaacttgaaaatagcaaaaaccctcaactgttgtaaatcatgcaattaaagttgattacttataaatatgaactttggatcactgtatagactgttaaatttgatttcttattacctattgttaaataaactgtgtgagacag

SEQ ID NO: 14 - DNA, 282701 bp, Homo sapiens
acttccggtggggtgtcatggcggcgtctcggactgtgatggctgtggggagacggcgctagtggggagagcgaccaagaggccccctcccctccccgggtccccttcccctatccccctccccccagcctccttgccaacgccccctttccctctccccctcccgctcggcgctgaccccccatccccacccccgtgggaacactgggagcctgcactccacagaccctctccttgcctcttccctcacctcagcctccgctccccgccctcttcccggcccagggcgccggcccacccttccctccgccgccccccggccgcggggaggacatggccgcgcacaggccggtggaatgggtccaggccgtggtcagccgcttcgacgagcaggtaaccggcccgtggcgggcgggaggtgggagcggagtgggggtggggacagagtaggtgaggggaggtaggagcggccgcctcccccgcggctgcctcaggctctggaggaaaggaagggaagggaagagaagggaaggggggataagtgggggtggccaaggcgggaggtgaggggtaggaggggacagctgggagcttgggcaccctttccctcctaagtcggggggtggggccttgtccctgaccagcctccgaccctccatcccctttatcccagcccttccgcttggaaatggggatgagtgacctgggggcgcctttaggggcgcgccatctggatttaataattacccccttacttttgtttttgagcagaggtgggtaacgtttaggggttctctcttcctcttccctccgtgaccctcctaactggggacgagcgaaccctaaggcctgtcttatataccctcaataggagaacgataacattccgcccctcccccagtttcttcagcttcctctcctggagggggaagagcagaagaaagcaaggaaggcacaggttttcttactttctgctccatcgtctcatcctgccccgagagcttcaagtgcacactcactgcacatctttgtgatgccctacaacgtcgtcccccatatcctgatgacacagactgccttttttttttattgccgtttgcagtggaaaccgtggttctgaaatatcttccccttccttgataattgcagtctcttccccccccccttttttttttgccagcggtctgaggatgtgatgcattctcgagtgagaatgttggggagtaaaggggagaagggtgaaaggaaagtgagaaactgcttcagagccaccgacaacagagcaaagccagctgggatgtggtcctggagcggatcattctgctagtgtttgtggttgtttttgactctctcctggttgacaagagaactttcattgagaatatttgggatgaaaaaaaagttttgtagcttgaggaggtgactttttatcgcctgagtttcacacaataaatcctggggctgattagaataaatgcacacatagccttttgtcagtggaaattggtttaactttgtgttgctgtaggtagttggggatggtttaagggatgctttctgcagctgtgggtgcagtgggcttcctgtgatgggggaattgtttaagattgagtcaacctattttgtttactggatataatggtaaaacattatgggagctgaaggggtgggggaagagctcttctgttatttgatgcataaacatttctttacgggactcagcgtttcagacctacctggaaaatatcttggaatagacagaggaagttgagaagaagctatgtagataaaatagagttatgaagctgtcagagacttgaaggaattgttttatccattcgtatgcttccagacccaaaggcatctaaactaaactactaatccatctgaagtataatgttactgcatataaaagattacattattgatagagcgttagatttaaaacttggtagaaaagactctgtaattttaagaaaggatttaaaaggcacatagaagacttccaaagctgaaccttgtggacagcagaatctggatgtaggaaattgaaggatccacgccgcaattctccttaaattttaaaaattaaaaatttttttcagttttttcttaattttatttttttacttcttacctgttcatctctaggcttatttgccatattggaaaaagatacttaagagaggaatgattttgggctgggcgcggtggctcacgcctgtaatcccagcactttgggatgccaaggcaggtggatcacctgaggtcaggagtttgagaccagcctgaccaacatggagaaacctcgtctctactaaaaatacaaaaattagctgggcatggtggcgggcgcctgtaatcccagctactcgggaggctgaggcaggagaattgcttgaatccgggaggtggaggttgcagtgagctgagatcacaccactgcactctagcctgggcgacagagcgagactcttgtctccaaaaaaaaaaaaaaaaaaaaaggaggaatgattttgattatatacccagtaaagcaagaaagtgtttctccttctgtccctagctttaaaagaccttaaggcttcgttgtttgttatgcatattgtggaatcaaactcaccaccatctgttaaaaattaaggacattagtttttaaaacagcatttttctgcattccttatgttgtaattaagagaaagatatataggagagattattcctcactttttttttttgagacaaggtcttgctctgtcgcccacgctggagtgcagtagcttgatgtcggttcattgcaacccctgcttcccacattcacgtgattctcctgcttcagtctcccaagtagctgggattacaggtgtgcaccatcgtgcctggctaatttttgtatttttagtagagacgggggtttcaccatgttggtcaggctggtcttgaactcctgacctcaggtgatctgccccccaccccctgctcggcctcccgaagtgctgggattacaggcatgagccactgtgcctggcctattcctcacatttttctcttagaaagttaaagtctctgaccttgagatacaaaaatgtaagggttttcagtgtttaacataaggtacttatatatattatatatagtatatatataaaataaattaatatattaatttattatataagtgataaatgtttaattcaaattagagttcaccttacggttgaaaatgtcttttagtcagaaaactgaggcatgggaaggttaagtgacatagatctaataagagcttcagtatgaaaagtagtgaatgcttgaccatcagggagatacttttcctaagtatcccataaaatttgttctaatccattaaatatatttagaagactttattttattttttttatttttgagacggagtttcatgattcttgcctaggctggagtgcaatgatgcgaccttggcttactgcaacctctgcctcctgggttcaagtgattctcctgcctcagcctcccaagtggctgggattacaggcgcctgccaccactcctggataacatttgttatttttagtagagtgctgagattacaggcgtgagccatcgcttacatttttattgaggggagaaaaagccctgcatgtactgagagatagttgtataagaatcttaagagttggccgggcgcggcggctcacgcctgtgatcccagcactttgggaggccgaggcgggccgatcatgaggtcaggagatcgagaccatcctggctaacacagtgaaaccccatctctactaaaaatacaaaaattagctgggtgtggtggtgggtgcctgtagtcccagctacttgggaggctgaggcaggagaatggcctgaacctgggaggtggagcttgcggtgagccgagattgcgccactgcactccagcctgggtgacagagcgagactccatctcagaaaaaaaaaaaaaaaaaaagaatcttaatagtttcaactgtttataaaacttttgaattttggattatattatctgtactttgctttactgggcccagggggagttaagctttccttcttattacagctaagagtttgcctgttggaccacttaacgcccccagggagcatgtgcatgtctaaagatggcaactctgtttatgattgctgttttggttggatttctaatattcggtgtgattaaagcagaaatgcatttctagccactgctgattacagacatattgcactctgatgggtatcgcttagcaacttagtgcagtagactcagttaaaagaagtggatgtgtgccatattgacattttgagctcacattcttgtgggtaatataaaattccttaacctgataatattgcagctaaacctagtatttagggtctaagttgaatgagtattaccaattttagaagtaatcacctccttggttagggaaatgacagttgcacaggtggacagccagaaagctgaatgttatcagttaaatcttacatctctccttaacctgccttcgtggtgccaaatagcaagtttctaattgaaactgacaaattgtaggtgtgtagcttttttttttttttttttgagacagagtttcgctcttgtctcctaggctggagtgcaatggggagatctcagcatactgcaacctctgcctcctgggttcaagccattctcctgcctcagcctcccaagtagctgggattacaggcgcccaccaccacgcctgcctaatttttgtatttttagtagagacgggggtttcaccgtgttggccaggctggtctccaactcctggcttcaggtgatccacctgccttggcctcccaaagtgctgggattacaggcgtgagccaccacgcccggccatgtgtagcttttaattgtggttcattaacccagtttctaagcaaattagaaccttctgtgtatctcccctagttctgtatgccccactggttcctgtagagctttatttctgaagggaagtatgggaaaactatggatatttgaactaaaaaaaaaaaaaaaagaattaaaaagaactccatcccaaaatgatttgttgtaaatatgttcatttaaagcaattatattttccatatctgatcaagcaaaagtagtacataaaagccaaaaaacccaatttaaagaatatgttatggaataaactctgattttagaggttgtagtagcatatttgttgttctcatacattgagtgttcatctgaatgtacgttgaatatgcggtgagtgattcacagtataaaatgattggcaagtatcttcgaaattacaaaccacatactgattagacaaatagatttgcaaaactgaagctttttggatttaaaaaatatctcctagcctcattcttcaagcctggtgtgtaatttttataaggccttatagtagttgaaaatgagtactcttttatggtgacgaattctttatggtgagtgagaaataatgcttattcttccaattttagtatatgtggtgctgaatcgagcacaataatgcttattctttgcttcggaattttttaatttattattattgttattttaaatttttatttatttatttattttgagatggagtctcactctgtcgcccaggctggagtgcagtggcgcgatctcagctcactgcaacgtctgcctcctgggttcaagcgattctcctgcctcagcctcccaagtagctgggactacaggcgcatgccaccacgcccagctaattttgtatttttagtagagacagggtttcaccgtgctagccaggatgggtctgaatttcttgatgtcgtgatccacctgccttgacttcccaaagtgctgggattacaggcatgagccaccgtgcccggcccggaattcatcctttagaaagatttcttccagctgttcctcagttctctgcactcccttacactttccaccttatctgtctgggaactaatttagtctttatgttggctgctttcttttcacttttcaggctaagatttcctttctcttggaaatcagacgtttacttggtcctgcagctctctctctgtggaccagtcttttttgttgttgttgttgccagatactcaccgcctctactgtttatccacccatttcctttataactctgaaaagtagctcctgcctctgcttgattgctgttttcttgaaagtgattacttctggcaaaacatagtggtcattgcttagttgtaatgccactgtgatgttccactccccccggaaaccaatctcttccagttcccaagacacaatacttttctactgaattggagttccttagcgggggtcttagttttgttctgctattcagtgcctttgtccctatcctagccattagctttcctatagatccttgatttcctcatctgttgaaaaagaaatggctagaaaatcttttagattctttcaagtttaaatattcgatgattttaatattctaacagcatgtctctgtgacccagcagtctattgggagctgaccccacttgatttaccaaactctttcccattatgcctctgcatgcacctatgttccaggcaggtcacctcagtctcttctgtgtgtatcatgcttcttcccacttcttggcctttatttctgccagtctctgcctgaatgctttaattcctcctttgtgcttttctaattcctgtccatccttcaatgttcagctcagatttcattttttttttttccccatgaggttgtttcagactaaactctgctatctcacttcttggtatccttgttacctggagttttacagaaccacacagtaagttttcttcctttaggaggattgtttgaacacagcttggctttgttttctttttttcttgtctttttatcaaatggagtgcatactttctgaaaagcaaagaacgctatttgaattctcttctagtcaccccagtgcccagcacagtcttaaacacacagaacattgatggaatgtttttcatatgattcctggttgaagggtagactggctaaataaaaaaagtggtacttttggctttgttttactgaattttacttccatgtttgcaatagcctaggtctgataagtgatattttaactaggaatgagtaagaaaattagcataaagaaggaatttatacatatttatatttcctcccatagagcaaacatgttttttgaatcaggtttcagatctgatcaactacttttgtaattttggatttgtcacttactgttaggatattttgcaatggtgtgatagaatatgaatgtgaagcactttgaaaagtctaaaatttttctaatataagatttatatgttttctttatagcttattattattattattttttgtgtgtgtgacagagtcttgctctgtcactcaggctagagtgcagtgtagcttattactgattattgtgttttcattaaataagggagagtaggccaggtgcggtagctgatgcttgtaatcccagcactttgggaggcccatgtgggaggactgcttgaggccttgaattcaagaccaggctgtgcaacatagtgagatgctgtctctaaaaaaaattagttgggtgtggtggcatgtgcctgtagtcgcagctactcaggaggctgaggcaggaagatcacttgaacccaggagttcaagcatacagtgagccatgattgtgccactgtactccagcttcggtgacagagtgagaccctgtcttccaaaaaaaaaaaaagagagcgtgactagtctctggatattcctttgtatgtaccttggccaatatataccttactttagtatccattgacaagttctcttttttcttcttcttcatttttttttttttgagatagagtctcgctctattgcccaggttggagtgcagtggcacgatctcagctcactgcaagctccaccttctgggttcaagcgattctcctgcctcagcctcccaagtagctggcattacaggcacgtactaccacacctggctaatttttgtatttttaaaagagacaagggttcgccatgttagctggtctcaaactactgacctcaaacaatccacctgcctcagcctcccaaagtgctgggattataggcataagctgtggtgctggtctaatattgttacattttattttaaatgttcctgttttttgccctactctttttatttgactttttaaccattaggaaattagattcttttctcaaatctgctttattattattattattttgagacaagttctcgctttctcgcctaggctggagtgtagtggtacaattttggctcactgcaacctctgcctcccgggttcaagtgattctcctgcctcagcctcccaagtagctgggattacaggcgtgtgccaccacacccagctaatttttttgtatttttagtagaggcagggttttaccatgttggctaggctggtcttgaactcctgacctgaggtgatccgcccgcttcagcctcccaaagtgctgggatcacaggcttgaaccaccgtgcctggccctatttttgtatttttactatagacggggttttgccatgttggccaggctggcctcaaacacctgcctcagcctcccaaagtgctgggattacagatgcaagccactgcacctggccttaagtctgcttttaaaaaatgttttggctgggtgcggtggctcatgcctataattcaagctttttggggggctgaggtgggaggatcacttgggcctcagagtttgagaccagcctgggcaacagagtgagaccccatctctacaaaaagtaaaaaaaacaaataaaaaaaaaatcagccagtgtgcattggttgaaagtaaagaaaagaaaaaaaacagacaaattagccaagtgtggtagtatatgctacttgggaggctgagtcaggattgcttgagcccaggaaattaaggctgcagtgaggcatgattgcaccactgcactctggcctgggtgagaccctgtctcaaaaaaaatttttttttttaatatggagaaagtatttttgtttttcgttttttatttgggtaccggccactgcacccaaccaaacattttgtccttaaacaaaagtttaagtcatataatacagtagtaagaatgccttattttttacatctttgttctttaaattactcagattgctatggggcatttttgttgtagctttcaaatttggtattctggggttctatgtagactctatattgttgcattctaacgacatacttttaaggataagcagcgtattaattaaaaatgtgttttccacttgtgttccttaggtctgcgtatattttggaggtgtgtgtgtatataagtcaagggacaggaggtatcggaaggctctaaaggaagtttaaggaggagaatattctatagaagtggaaggggagatttgtggtcagcttaaactgttaaaaggcttgggatcaataccgaagcagaatatgagcatcttaatctgtttctttgcaaaggattgacttgtatttataaaagcattggcttgtttcatctgacatcttttaaagtaccccattttcttgggggcgggaagggagagatgagaccatttgttttgatcttgaaggacagaaaagtggttttacgttgtagtgactgtgaattaagtttaaggtctcagcaagttgtaaatttctgtatcatactatgtggtagagccttcagtaaacagagtactctcaggtgtttaatgctataggatataaactataactgctgtttatagtaccctcgctaaattctcttaaaggcaatccatttgaccacttcaaatgttatatgcctgtgatatatagttatattctctgcatataactggtttttaaaaattgtttattattcatttattttagaagtgaggtctctctttgttcctcaggctggagtgcagtggtgtgatcatagctcaccatagcctcgaactcctgggctcaagtgatctcccacctcccgaatatctaggactatgggcgtgcgccaccatacctggctattattttaatttttttcgtagagacagtgtcttgttatgttgcccaggctggtctcaaactcttggcctcaagcagtcttcccacctggcttcccaaagcactggaattacaggcgtgaactactgtgctgggtcctgagtggcttttgagccactgactatatcatcaaaaagcttctgttgagacaaagcctcaagctagtgtggagttcatcctactaaaatgaagaattggcattatgttctaaaactttacatattcttaccataaatggtactaattactttgcagtagcagtaacttgaggtgcaaacttccagattgcatattttctttaaaccatagtctggcactcacggtttggcttagggttgccactgcagtccacaagctgtcgcctgcccttattcatattttatagctttgaatgtcttattccattgaacttcagataactttttttttttgagatggagttttgctcttgttgcccaggctggagtgcaatgttgtgatctgggctcactgcaacctctgcctcccaggctcaagcgattttcctgcctcagcctcccaagtagctgggatgacaggcatgcgccaccatgcccagctgattttgtttttttagtagagacagggtttcaccatgttggtcaggctagtcttgaactcccaacctcaggtgatcctcctgccttggcctcccaaagtgctgggattacaggcatgagccaccgtgcccggctgagaacttaactttttctgatgaaattctttcctgctccacctaactcccgtgtcccacccccaccagcagagtggtatatctagcacaagaggcatgaaattaatttagtaaatagcaggactactagaaacttttaaggattatttaacttatttttaatcaaaattttatactcagataatgaccttttgggaagttatgtctcttaatgatctcaagtggtgacacttttctgttgacacggtttctcttgggtagttctcatagtagtttgggcatgagaaaacaacttttaccactttagacttgtgagggcagcctactatgtagtaaaagaaaaagcttttgattgtgcaacttgcagtgtggtcttggggaagtctcttaacctctctgaacatcagttttctatattttcatgtgtaaaatgggcatgatacttacccttctcacatcatgggcttgtttaatgacttaggtatgaatcttatatgaaaggaagctgtaaacagtcataaaaatgtattagcatctgtgcagtattttttttctatccattctttataatttggtggttattatttctactctacatgagaaaaaagttacagaggcaaaacatgttcacaatcatatgattatataattaactgagttaaactagagtatggatgtcttgacccttagatcactatctttccaataaatagttttaaaagtctaaattttactaacaggtagtacaaatatgcaaaatgagggatgtatgattgcttcttcactcgaagatggtatattatgtttttccttttaagttcatgttagagtatctgaatcttttcaagttggttagatgttagaaatagatgtaaattttaagcattatatatccttgatttcattatgtattattctcctggtcactttatcaaaacttcttcagctgttagaagttgtaacattgtttcccttttatttagttatataatacacttattgtacattcttaagtgggagaatagaatttgtgagaataccaacagaaatacacatacagctataaatatgagattatgattctttcatgttggcattgcacagtctatttttgtaaagttggtttttatattctaagaacattttacttagagtttgattacatttgaggcaaacttttcaactttggtagtatttgaatgaagattcctggatgtggtttttttaattgttacatctactttttcagtttttctttttccctataacaaccctcaaatccttcatcttgtcttttggagtatttttttctatcctcctgtctttatcggtgccttctattcctgtcccaccttgggtctgggaaaatgtgcctttatgctccatgtgagtcttcttccttttgggtaatgagtgcggagggaaaaaaagcacagtatttctttccctgttatgtttcagtttttggcctctgataagtgaatctggagtagggaatgacagtgatagtaggttttgttttagtcatatattggcgacaaagatcaacgaagacctgaagctcttgttcctctcatgacacaaactacccacaggtgcatgccaccatgccgggctagtttttaaattttttgtagagacgaggtttcgccatcttgcccaggctggtcttgaattcctggactcaagcgatcttcccacttcggcctcccagagtgctgggattacaggcatgagccaccgtgcccaaccgagattctgtctctgaaaaaataaataaataaataaaataaatacataaaaataaaataaaaacatttgaagacatcttaagtacaccctagattcccacccccaccaaaaaatttcattcattcttcaaccatttctcaaagaacatgttttcaagacacctcactatcctaattgttttccttttggtgcaatggtggtcagtactcaggcataccattttttatctttcctcccaatgttgtatgagggcattatatgaaacttaaatggatttaaaaatgctgagcttgctggacatggtggctcacacctgtaatcccagcactttgggaggtgggggagggaggattgcttgagcccaggagtttgagatcaacctggacaacacagctagtatgcacaaaaaaataaaaaaagtagctaggcgtggtggtgcatgcctgtagtcccaggtacttgggaggctgaggtgggaggatggcttgagcccaggaggttgagcctgcagtgagtggtgtttgtgctactacactccagcatgggtgacagagtgaaactctgttaaaaaaaaaaaaatgctgagcttcaggtacagtatatttttggtatgcatttgattaccagtacagtatacctatcaaaaatgttaattcacatgttttaaaataaaaagtttccaacataaaagtagagagttttttttttttttttttttttttttttctgagacagagtctcactctattacccaggctggagtgtaatggcacgatcttggctcactgcaacctctgcctcccaggctcaagccatcctctctctcagcctcccgagtagctgagatcacaggtgcacaccaccacgcctggctaaattttttgtattttttgtagagacagggttttgtcatattgtgcaggttggtctcgaactcctgacctcaagtgatccacccgcctcagtctcccaaagtgctgggattacaggcgtgagccactgcacatggcctagagagatgttataaattaatccttttgtatccattactcaatttctccctagtcttatttcatccgtattcctacccatttcctgctcactacctctttattattttaaagcaatcctatatatcatttcagcgtgatttattcttatactgactttaagagctgtgtaatataaaaacaactcaattaggaatcagaagacttgactttaagtcttaactttctactggaatgagttaacaggggggcaagccaagctgtatgagccctgaattcctaatatgttgaagagagtaacacgtggtggaggggacataatgttacctgcactttttcacagggatctatgagaatcaaagataggaggtaatatgcatgaaagtattttgtctactctaaactcaaaagcaaaagtgctttacaaaggtaagattttattagtaaatgctgcttccctgtataagtgctaacaactcatgcctaatcagtcttagaattatctggatgctgacattaaattaagtccatagtattaaaatcaccctttcacctttacccactcttggattttgacaattgcaacaacattttctcattcccaatctggctcctgttacttttcatgacttctgcaagttcactgaccacatttctcttaccatatttctaaattttcatctgtatcttggattcatgtacacttgagctcaggtaaaacagggaggtgggctcttcatgctttatgtatctaagttctgatgactctcagcaatgctttttttcagatttgaagatcattttcttttttttctttttcttttttttttcttttttgagtcactgtcacccaggctggagtgcaatggcgcgatctcggctcactgcaacctccgcctcccaggttcaaacgattcttgtgtctcagtctttcgagtagctgggattacaggcacctgtcacgatgcccggctaatttttgtatttttaatagagaaggtgtttcactgtgttgtccaggctggtctcgagctcgtaacctcaggtgatcctcttgcctcggcctcccaaagtgctaggattacaggcgtgagccaccatgccttggcctcattttattttcaactagaacaattagaaataaaaattgagttgaatagttctgcttttaatgacctattggtgctggaatcatggactctagtgattcttgttcttctttcctcatctttttgatcctaatgtattttaaaagcctttacatatttttgtctttaacatttctagttattctgaacttttgttttaactcttctgttaatttatccattgtgtgtagtgtgtattttttcttaaatgtccttataaatactgagctgtgggggaggggagaggaggagcaactggtgcaggcacgctagtttctttagaaatgtcagctctgccagatcacttaagacttgttaaaagtacagatttcctggctctactaaacatcgtgtgatttctagaggtcccaggtcatttttgacataaagctgggtttgtaaaccactgctgtgtgatatacagggagaatttaatttctgggtggtatttaataggtcacagtacagtcatatatatcactgcaacaagttagaaaaccacaattggatgaactttaaaaatcaatactaaaaaaaatattggagagctatggatgtaatgaggactagatgaattagaattccagaaatagaagagatctttataggtgagcagaggattgctgacatttgctgattctggacacacactgaaggaaaaggaaactagagaggaagtgcattttactaaaactgcaacatatccctggcccagttcaattcctgattggactgaggtgatcagcctatcttatcccttttgcctaatagaggaaatagacagctcttactgaggagatatattctggggtttctatggttctttcgtttataatactatcatactattaactattctagagatgtgaaagggtggaaaaattcaagagaaaaataaaacttatagaagcagactcagaaaattgaagttcatcagacaaagacttattttaaaataactataatatacttaagaaaataaaggaaaatacggagaaaatggatgaaaattttcatagagaattggaatccacagaaagaaaccaaatgaacattctaggaatcaaaaacacaacgttggttgcttaaggtctttatttgtagtttaattagaaactttggcgcaggactctaggacactccacctccccctcattctttactgttcttaaaaaacaaaaacaaaaacaaaaaaaacccaggtaaatttaatgtatactatttaagttccacgagagcagggcctatgtctgttttgttcgttgttgtactcccagggcttagtatagtgcatgccacattaaaaaacaaaacaagacagaacaaaatcttccttaacaccaccatcacaaacccccccattaataattaattgacattaatctgaaattaattattcattgtaccggttcagtagcagactatacacagcagaaggcaagactagagagcttgtggacagatcaatagaaaatatctagataaaagcacagaaaaaaaaaaaagaatggaaagagtagaacagagcctctgagacatgtggaacattagtaaaaagtctaatgtgtaattggagacccaaaagtagagagattagcatggaagcaaatacttgaagaggtaatgataaaatattttcccaaactgatgaaaggcatcaacctataaattcaagtagtttagcaaaccccaagcaggatgaacacaaagaaaactacacttagcatatcttaatggaactgttgaaaaccagaaacaaagagaaacgcttaaaagcagccagaagaggggaaaaaaggcactgtgttcaaaggaacgatataatacaactgatggctgactttttaatacaactgtggaaactgggaaataacagacattttttaaatgttggcaaaaaaacctgccaagctagaattctaccttcagcagaaatatccttcagacaagaaggcgaaataaagacatttttagacaatcaaaagctgacaatttatgaccagcagacctgcactgtaagattactgaaggaagttttttaggcagaatgaaaatatctcaaatggaagtacaaaactgtaggaaataatgaagagcacacactcgggtaagtgtgtgagtaaatagacaagacctattgcctcttgtttttattgctgtttttaggaactttattgctttttgctattctagaataatagaatttccacagcttttaggttaaggtaaaattgccatccaatcaataaactgcacatatttaaaatgtataatttgatgagttttgatatacatataagcctttgataccatcaccacaatcaagatgaagaacatatattaccggcaaaagttttctccagcctccttataatccattcctacctccatcccatccctagggaacccttgagctgtttttgtctcagtggatatatcataagttgtttatccattcacttgttgatggataactgaagacaactcaaattttcaccattacaaataaagttgtcttgaagattcatatacatgactgtcatttctcttgagtaaatacaaaggagtagaaatgggtggatcatatggtggatgtatataataatgttacaggatattatattctgtaatattttaagaggccaccaagctgttcctaaagtgattgtatcatcttacagcagtatatgagagtttcagttgttccacatctttgccaacacttatttaaccttttcttttaaattacagccatcctagtgggtatgaagtggtgtctcattgtggttttgatttgcatttccctaatgactcatgatattgagcatcttttcatgtgcttatttaccatctgaatattttctttggtgagctgtttatctcttttgcccatttttaaaaaattgggttttactggagttttcagaattcataatatatgctgaatacaagttcatcagataaatgatttgcaagtcttctagtttttccttgtttttttgttctcaaagtctttcaaaagcagatgttcttaatttttctgaagtccaccttatcaattaaaaaatagatcatgttattggtatatctaaggtatctttttctaatataaggtcacaaatttttctcctctgttttctgtagaaatttaggatttatactaacgtttgtggctcatttttagttaatttttgtatttgtgctatgtgcctgttatgccaataccacatagtcttaactataaaagagcttaactatataaactataataaaatatcaagtcaggtagtataagtcctccagctttcttgtttctcagaattgttttgactagtctaggtcttttgttatccttgtatggtttcggattggcttgtcaatttctattaaaaagccagttttgatagagattctgctgagtccatggatcaactttgggaagattgccatcttaacaggtattgttttttagtttcaatttttgattgttgctaatatatagaaatacatggatgtttattgatcttgtttgtttttatttaggccatagatttttttctttttctttttaaagacagggtcttgctctgtcccctaggcttcatagctcacttcagccttgaactcctgagctgaagtgattctcccaagaagctaggactacaggtacatgccaccacgctcggctcattttcttattttatagagacaggatcttgctgtgtttcccaggctggtctcgagcacctggcctcaagctgtcctctcgcctcggcttcccaaagtgcatgagtcactgaacttggccaggccgtaaattgttttgagacagggtcttgctctgttgcacaggctagagtgcagtggtgcaatcatggcttactgcagccttgacctcctgggctcaagtgatccttccacctcagcttcctcagtagctgggactgtaaacactcaccacgatgcctggctaatttttgtagagacagggtttcaccatgttggccaggctggtctcaaactcctgaccttaggtgatccatctgcctcggcctcccaaagtgtttgaccactcagcctttatacagatatttcatcttctttacaagaagaaaaacactctaagctcttgcctaaaaagatgaaaatgttctttgtaaaaatgaggatgtccttaccctcttcccaaaatgaggagcagagtctcataattgtattgatttctgggggacattcacactatctatttctaggctgtgttaattatgcctcaaattcatagttccttctgaatatcctgttacctagggactaaattgtaaagttaacctttaataaagtttgaataacatagagaagaagagggaaggaattgatttataaacttgcccgtttccctgtaataaggaagaaaatatgtatagctgctgtagaccttgcttctgtaactggttgagagattgtagttcatatttataactacttctgctgtacattccatgtttcctttgttctcattcaagatctcagctggtggggtaacctaaatcttcattaataaagaatatggctttgggaggctgaggcgggtggatcacgaggtcaggagatcgagaccatcctggctagcacagtgaaaccccgtttctactaaaaatataaaaaattagctgggcgtggtggcgggtacctgtagtcccagctactcaggaggctgaggcaggagaatcgcttcaacccaggaggcagacgtggcagtgagctgagatcacaccactgcactccagcctgggtgacagagtgagactgtctcacaaaaaagaataaaaaaaaaaaagaaaaaaagaccatgggccggacatggtggctcacgcctgtaatcccagcactctggaagctgaggtgggcaggtcacaaggtcaggagtttgagaccagcctggccaacatagtaaaaccctgtctctactaagaatacaaatattagctgggcgtggtggcaggcgcctgtaatcccagctacttgggaggctgaggcacaagaatcacttgaacccgggaggtggaagttgcagtgagccaagatcacaccactgcactccagcctgggcgacagagcaagactctgtctcaaaaaaagaaaaaaaagaatacaaatctttggtggtcctgcttcatgtgtgtgcatgcctgtggctgtggttttccattaagttttgctcttatatatataggtttagaaaaacatttcagggaatcctcagggttccagacatagtcctctttgtccccattatgtagcaacagtacagtatcacctagtaataggactgaattacatcagctaatagaataacccccttctttgactgttgatgtagtgcggtggttcttaggacagttttacctcccaggggacatttggcaatgcctggagacatttttaattgttatgactttcgtgggggtgggggaatgctactggcatctagtgggtagagttcagggatgctgtcaggcatcctgaaatgcacaggacagcccccaagagtagagactgatccagtccaaactgtcagtagtgctaagattgagaaattctgatttagtggtatggaggcagtggtcatgaggtagttgttacttccagttcagtggaactgtgtggaatcattccctgcttgggaaccaaggcctccaatccagcagatatcaaagtcgtaggtacttgaaacaaaacttctgctaatggaatttttaggaataatagaggaactacttctacttgtgccccttgattctcaggcctttgtattctagctatggggaaaacaatattgtatattgctcattgatccactgtaactgagtgagtcttcagtagtccattctgttagaccagctgcttctgggtgatggagtatgtggtaagaccagtgatttccaagttccataacccattcctgcataaccctttttctgtgaaatgagtaccttgatcaaagtcttgttgagtagtataccttgatgatgaacaaggtgtcgcccatgtccttgatggtgatgctggcagaagcactgtaggcagggaatgcatattcatattcagaatatgttggtgccagtgaggacaaattcttgtcccctccatgtatgtagagtttttgttttgttttctttttttaaggtatggtattatccactgtcattaatattttggagcattttacttccacattaaaaaagatcaaaataggtaataattatctgaccaagaaatgttttaaataaattgtagacttatgacagctatatcatctatctaaaaaccttggagtaactgtaaaatagtgacttttgaactgtagactttactcatgcagatatctcactaattttgttgaaatctaccagatagaaatccattgttatgggttgtatggttgaaaactttttaggctgtcatttgtttcaagatacagattgactcggtatactttaacatttctcatagttggccaaatttaggtaaaactatttaatttcattgaacgttttagggaaaatgcctgaatattaatagagataggatgaattaaattaaagaacttaccctttgaaaaattgccagggttagcaatttttatgctaaccctgcataaaaattgtgcgtggtggtgtgtggagtggtgtatatgtttcagagaaataatataaatgttcagataagagtatctgcgtaatctaactaggacctgtctaacctacctgcttaaggatagaggaaatcttgagagacttgaaattgaagaacttaaaattttaagtcttccctttcaaggccctatcaaaacatcatgaccacatctttgaaatagttacttttatcactcaatatagttagaaaattttatttttagaactccaaaatcattttattttattttatttatttatttttttcgagacggagtcttgccctgtcgcccaggctggagtgcagtggcgccatctccgctcactgcaagctccgcatcttggtttcacaccattctcctgcctcagcctcccgagtagctgggactacaggtgcccgcccccatgcccagctaatttttttgtattttttttttttttagtagagacagggtttcgctgtgttagccaggatggtctcgatctcctgacctcgtgattcaccttcctcggcctcccaaagtgctagggttacaggcatgagccactgtgcctggctcattttatttttattattattttttgagatggagtctcactattgcccaggctggagtgcagtggtgctattttggctcactgcaacctctgcctcctgagttcaagcaattctcctgcctcagcctttggagtagctggtactacaggcgtgccgccacgcctggctaaatttttgtatttttagtagggatggggtttcaccatattggccaggctggtcttgaactcctgacctcagttgatcctcctgcctcagcctcccagagtgctgggattataggtgtgagctaccgtgcctgacctccaaaaccgtttttattaattatattctttattaagtatatgtttgataaagacaagcatttttccttttttcactgttacattctttctgtttagaatagtgatttgcggccaggcgcggtggctcatgcctgtaatcccagcactttgggaggctgaggcaggtggatcatgaggtcaggagatcaagaccatcctggctaacaggtgaaaccctgtctctactaaaaatacaaaaaaaattagctgggcgtggtggcgggctcctgtagtcctagctactcgggaggctgagacaggagaatgacgtgaacacgggaggcggagcttgcagtgagccaagactgcgcctctgcactccagcctgggtgacagagcaaaactccatctcaaaaaaaaaaaaaaaaaaaaaaaaaaaaaaaggaatagtgatttgcacatagaagggactcaataaatatttgttgaatgaatgaatatatgaaataaaatcttccatgctcttgaagagaagtatttgtcatgtgactggtcttatatggcagaatgtcccttgtttaccattcctattcccttctaaccaaatcatgatatgtatttttaggtattctttggcatttctttttgaacacctggaaaaatgctaaaatatggtttaaaactcaatgtttgtgaattaggctgttaggtgcagcctgacttaagggataagggctgaattatagagaaattgaattatgctttcaaatatggtacgcatatgaaagtaatacatggttgttttttaaactaggttaaatgtggtaaatgcactcttttaatttagtgttttattaaattttggtatatgttgtgttataagcataaaagtttctgaaagaatttttgtgcctagaaattgtgggaattgttgctttctttaacttttgatttgaaacaatcacaaattacactggattcttaaaaatgttgtaggatctttagggagctcaactgcagtccagatgctgattttttttttttttaatactttaagttctgggatacacgtgcagaatgtgcaggtttgttacatagctatactcgtgccatggtggtttgctgcacccatcaacctgtcgtctaccttaggtatttctcctaatgctatccctcccctaaacccccaccccgcaacaggcccagtgtgtgatgttcccctctgtgtgtccatgtgttttcattgctcaactcgtacttatgaatgagaacatgcagtgtttgattttctgttcctgtgttagtttgctgagaatgatggtttccagcttcatccatgtccctgcaaaggacatgaactcatccttttttatagttgcatggtattccatggtgtgtatataccacattttctttatccagtctataattgatgggcatttgggttggttgcaagtctttgctattgtgaacagtgccgcaataaacataggtgtacatgtgtatttatagtagaatgatttataatcctttgggtatatacccagtaattggatggctgagtcaaatggtatttctagttgtagatccttgaggaatcgccacactgtcttccacaatggttgaactaatttacactcccaccaacagtgtaaaggcatttctatgtctctctctcttttttttttttcttgagatggagtctcactgtgttgccaggctggagtgtggagtgtggtggcatgatcttggctcactgcaacctccgcctgccaggttcaagtaattctcctgcctcagcctctccactagctgggattacaggtgtgtgccaccacacccagctaattttttgtatctttagtagagacagcgtttcaccatgttgggcaggatggtcttgatctcttgaccttgtaatctgcccgcctcggcctcccaaagtgctgggattacaggtgtgagccaccgcgcctggccttaagagttcctgtttctccacctcctctccagcatctgttgtttcctgactttttaatgatcgccattctgactggtgtgagatggtatctcattgtggttttgatttgcatttctctaatgaccagtgatgatgagctttttttcctgtgttttttggctgcataaatatcttcttttgagaagtgtctgtttatatccttcgtccactttttgatgggttttttttttttcttgtaaatttaagttctttgtagattctggatattagcccttggtcagatggagagattgcaaaaattttctcccattctgtaggttgcctattcactcatgatagtttcttttgctgtgcagaagctctttaatttaattagatcccatttgtcaattttggcttttgttgtcattgcttttggtgttttagtcatgaagtctttccccatgcctgtgtcctgaatggtattgcctaggttttcttctagggtttttatggttttaggtcttatgtttaagtctttaatcaatcttgagttaatttttgtataaggtataacaaaagggcccagtttcagttttctgcatatggctagccagttttgccaacatcatttattaaatagggaatcctttccccattgcttgtttttgtcaggtttgtcaaagatcagatggttatagatgtgtggtgttatttctgaggtatctgttctgttccattggtctatgtatctgttttggtttcagtaccatgctattttgtttactgtagccttgtagtatggtttgaagtcaggtagtgtgatgcctccagctttgttcttgttgcttaggattgtcttggctctacgggctcttttttggttccctatgaaatttaaagtagttttttctaattctgcaagaaagtcaatggtagcttgatggggatagtattgaatctataaattactttgtgtagtacagccattttcatgatatcgattcttcctattcatgagcatggaatgttttttcatttgtttgtatcctcttttatttccttgagcagtgatttgtagttctccttgaagaggtccttcacatcccttgtaaggtgtattcctaagtattttattctctttgtagcaattgtgaatgggaattcactcatgatttggctgtttgtctgttattggtgtataggaatgcttgtgatttttgcacattgattttgtatcctgaaactttgctgaagttgcttctcagctaaaggagattttgggctgagacgatagggttttctaaatatacagtcatgtcatctgcagacagagacagtttgacttcatcttttcctattcaaataccctttatttttttctcttgcctgattgccctggccagaacttccaatactatgttgtataggagtggtgagagaaggcatccttgtcttgtgccggttttcaaagggaatgcttccagtttttgcccattcagtatgagtatacctatgtaacaaacctgcacattctgcacatgtatcccagaacttaaagtatttaaaaaaaaaaaaaatcagcatctggactgcagttgagctccctaaagatcctacaacatttttaagaatccagtgtaatttgtgattgtttcaaatcaaaagttaaagaaagcaacaattcccacaacttctaggcccaaaaattctttcagaaacttttatgcttataacacaacatataccaaaatttaataaaacactaaattaaaagagtgcatttaccacatttaacctagttaaaaaaaaacacaacaaccatgtattagtttcatatgcataccatatttgaaagcgtaattcaatttctctataattcagcccttatcccttaagtcaggctgcacctaacagcctaattcacaaacattgagttttaaaccatattttagcatttttccaggtgttcaaaaagaaatgccaaagaatacctaaaaatacataccatgatttggttagaagggaataggaatggtaaacaagggacattctgccatataagaccagttacgtgacaaatacttctcttcaagatcatggaagattttatttcatatattcattcattcaacaaatatttattgagtcccttctatgtgcaaatcactattctttttttttttttttttttttttgagatggagtttcgctctgtcacccaggctggagtgcagaggcacaatcttggctcactgcaagctccgcctcccgtgttcacgccattctcctgtctcagcctcccgagtagctgggactataggcacccagctgtgggtttgttataaatagctcttattattttgagatgctctccatcagtacctagtttattgagagtttttatcatgaaggggtgttgaattttatcaaaggccttttcttcatctattgagataatcgtgtggtttttgtcattggttctgtttatgtgatggattacatttattgatttacatatgttgagccagccttgcatcccagtgatgaagctgacttgatcatgggggataagctttttggtgtactgctggattcggtttgccacaattttattgaggattttcacagatgctgaatttttttctgggaagaatttactttgactttttcatcctacaaaaattattctggttctgaaggatgcaggtgtttcaatggtgtcccattaatatccccaggcttagcacagttcttgcttggttataataggcaattaagtgttgaatgaatgaaagaattttaactttattctgtgggttcagggagctgttgaagagtattaagcaagtgagtggcatgctcacatgttctgaagagtgtttcctggtagtgatatagaagatggatttgaagggacagtaaaggcaagaataataattaagaaattgttataatagggatgatctgagccagggtactcattataggaaattaggggcaaccttgtcatgagatttgtttaggagatgaaattggaaggcttcagatggatgataggggtaaggaggaaaggaggagatttaagtgaataagagttgaggagagggaggagttgtaaatgacaagtttcttgtttattgttttgaataaaggggaaaattgttttcagttattcataaaggacttaaaaatgggctttgatcccaaaagttgttttgaagttatttcctgctttatctttggagacccttcttcccacccccacatcaaagcaaatgccctcaactgctttagatgcagtcttgcattgaaataggtatcacattgttttattttgcttgaatgggtgctgttggcttaaacatctaattgcatctgctttgtcttctttagttgtgtctacttatgggccaaaagagcatttctacctctgtaatttcatttgcatattggttttcagataaattgaagattaattatatgaagtatatggtttgtaatctcaattgaaggtgaattttttattttcctggttgaatataatggaatcattttggtatggagaagaaatggttaaaaatagaccagtgggtcatctcagtgtgaaagtcaagaggacttctaggcttaagcctggtagctaaatttctgttggctctaccctcttcatgatgagtccaagtttattttgatctgcatctttcttttttttaatgaatgaaattctccttcattcagcctggtaagtaacctggccattagtacgtgactaaatagctgaagcttctggcttgaattaagttataaacttagcacagtggcaggtgcttgaactgccatgttaaaactagcgcatagaatctttgccattcaaaaactgttttctcaatcccatgaaggagatgaagcctacatgggaatcttcactgattgtgctgacttttcttctacaatttttagtttataacatgtatagtttgtcaattgtgctaggatattttgttaatatgttcttaaaaattcaaatcccaggggtaaacatcaaataatttaattgtgcctatttgactttatgggagagttaacaaccatatttatatatatggttaaatgtgtataatcttcattctcaatctttcagaatccttattttccattttcatttttagcattagctgcattatttctttatacaactaggaaaagggattattcagaaatttggttgatggctttttattttgtagagacagggtctgtctctgttacccagcctagtctctaacttctagtctcaagtggtctttccacctcagccttcctagtgttgggattacaggcatgagccaccgcactggccagatggcattttaaagaataatgttaggaaaataattaatttttgcaagtgaagatagttgaaatgttagctaaaatgatgacctagaggcagcttgttttggtaaatatcttagtcagtttaggctgctataacaaaataccatagatttggtagtttataaacaacagaaacttacttctcacaattctaaagtctgggaaatccaagaataacattcctttaagcaaggttgaatgtaccagcttgggcgatagtggcaagtagcctcctattccattttgttctagaaagcattttttctcttttctattatttttgtctctttatatgtttatgtgttagggggagaaggagagagaatatttttatatttttcttttggggggatatttttatttttaaattataaatacttctaatttgcaaaggatcccagaaatagttgaagctgtctttaaacccctctctgatcccattctatcctttctgttaactactattctgaagttaatttgtactctgtccatttttatccttttattacatatgtttgtgttcataaaaaaattacagtttaacatttttacataaaaaatgttcttgtaaatattctgcaatttgcttttttaaattttattttttatttttaatttttttttgcagagccagggccttgccttgttgcctaggctgatctcaaactcctggccccaaggaatcctcttaccttggcctcccaaagtgctgggattataagtgtgaaccaccactcctggccttgcagcttgctttttaaacctattctaagacttgctccctatttatacatgagtattaagttaactcattttaactgcacgtataatattctattatcagtatgtcagtttatccatttctggtatagaggaacacttaatttgttttcagggttttttttttttttgcttgtgtttttgttttattataaacaatgcttcaggaagcatatatttgtattcttgaattttttttttttttttttttttttgagacagggtctcactcttgtcgcccaggctggagtgcagtggtgcgaactcggctcactgcaagctccgcctcccaggtttatgccattctcctgccttagcctcctgagtagctgggactacaggtgcctgccaccatgcgggctaatttttttttgtatttttagtacaggcggtgtttcactgtgttagccaggatggtctcgatctcctggcctcatgatctgtccgccttggcctcccaaagtgctgggattatatgcgtgagccaccgtgcctggccttgaatttttatttgacttaaaacatactgtgaaacttgtaagattatgtgaatcatgtttgtacagtttatacttaaaaaaaaaaaaacatggtgaactcttatcaattcacagagtaaaaaacaacattcccaatgctgtggaaacacctctatggcccaaatcacagttcttttcttaccattccccctaccactatcttgaattgtattttaaaatttcctttcttttctttatgtctccatgaacaatgtattgctttgtttacttattttgattttcatgtaatggaataatactgtaagtattctgatttcttttgtaagcatcatttttcttttgagcgttaatctatggtattgtatgcagttcattcagttttactgctatacattagttcattatttgtatatattgtatatatatatatatctgggctattgatgcacatttggattgtttctagttttttgctattactaagaatgctgcttacgaacattgttattcatgtcttttgtgcacatgcaggaatttgaagtatatgtctgggagcagaatttttcattttatggggtatgggtttgtttagctttactaagtaatgccaaatttttctaatttttaaaaatttttaattaattttttttttgagatggagtttctctcttctcccccaggctggagtgtaatggcacgatctggactcactgcaacctctgcctcctgggttcaagcgattctcctgcctcagcctcctgagtagctgggattacaggagcgagcaccatgcccagctaatttttgtatttttattagagacggggtttcgccatgttagccaggctggtctcgaactcctgacctcaagtgatctgtccacctccgtctcctgaagtgctaggattacaggcgtgagccactgcgcctggccaccaaattattttttaaagtgattgaatcagttgacactcccaactgcaatatagaagtattcctattgctctgtgtccttgccaaagcttagaattgtttctttaaaaaattttatggggccgggtgcagtggcttacacctgttcaaggccagcctggccaacgtggtaaaacccggtctctactaaaaaatacaaaaaaattagctggacgttgtggcatgcacctgtagtgctagctactcgggaggctaaggcaggggaattgcttgaacctgggaggcggaggttgcagtgagctgacatcttgccattgcactccagcctgggcaacaagagcgacacttcgtctaaaaaaaaagaaaaaaaaattatgtatctggtgggtaagaaatgttgtttcattgtaatttgaatctgtatttccttgactaccaatgaggtttagtttcttttcggatattcatagagcatttgtgttatttattctgtgaaatgtatttgtgtttcttattctgtgaagtgtctgtatatactttttgcccatttttctgtttggattgtttaatttttcctgattgattcatagcaattttttatggttttagatctaattctcttgttttttgagacagggtctggctctgtcacccaggctaaagtgcaatggtgcaatcttggctcattgcaacctttgctaggctcaagctatcctcccacctcagcctcttgagtagctgggactacaggtacgcgccactgtgcctggctaatttttgtattttttgtggagatggggttttgccatgttccccaggctggtcttgaattcgtgagctccagtgatctacccacctcagcctcccaaagtgttgagattgtagatttgagccacagtgcctagcctagatctaattctagatttgtgttgcaaatatcttttccaatttatgattggattaaaaaaaacttcggtgattgaaattcttgatcttactgcagctgaatttatcagtcttctatgatttatgttttaaaatttttttgtgtcctatcattaagataattctctattttctaaaagttgtttgcttttcacttttacattgaagtctctaatccacatggaaagactttttttgtaaggatccacttttatttttttgccatatgataacagataactgattgttccagcctatttattgagtagtgcattttttctcctgtgatctcagtgcttgcttgggtgaatattaagtgtcagtatatgcacaggctcagtttctagactctcagttcggctctctcctctagtgccagtaatccacttgattatttgtcctgattgtggttgctttataataattcttagtataaagtatggcaggtccccaaaagacttataataatgcctttccatattggttttacagtcagtttattgatttccgcaaaaaatgatactgggattttgaatggtattgcattgagtctttggatcaagttgggaagaattgattgacattgttatgatattgaggcttcctatttaagaacataatatgactttctatttattttatgttttaaaaaatcattccagttaagttttataattttctccttatataaagaacttctacataaaatgtcagtttttcctagaatatttttattatttatacatgatatttaaaaagttatattttctgattgtatatagaaatgaaattaacttatattttgtctttatactttttttttttttttatttaaagaaacggggttttgctatgttgcccaggctggtcttaaactcttggcctcaggtgatcctctagtctcagcctcccaaagtgctaggattacaggtgtgagccaccacatctggcctgtttttgtgctattactgacttatatctagattctttggggttatctatgtagacagtggatgatctacaaatagttgtagctttgtttctttatcttcaatctttttttttctctgtgcatctgttgagggcttttaatgttgaataggggagatgacattgggaagctatgtgttgtttttaattaatattttttttgtacattgacctcttctgtaccttgcacttctgttttgttttgtttggttttgtttttggaatgcagtggcgcaatcacagttcactgcagccttgatcacctgggctcaagccatcatcccacctcagcctcccgagtagctgggaccacaggcgtgtgccaccatgcctggctgatttttgtattttttttttttttttttagagatggggtttcatcctgttggccaggctggtctcaaattcctgagctcaagtgatccacctgcctcgacctcccaaagtgttaggattataggtgtgagccactgcacccagccccagggttgttgcttctttattgagcttgtcactcagtgccttttaactggggcatttagcccgtttacattcaaggttagtattgatatgtgtggatctaattgtgtcatcatgttgttagctggttattatgctgacttgttggcatggttgctttgtagtgtcactggttatgtacttaagtgtgttttttttagtgtctgataatgttctttcctttccatatttagtgctgctttcaggagctctcgtaaggtaggtctggtactaacgaattccctcagcatttgcttgcctgaaaaggatcttatttttcctttgcttatgtagcttagtttggcccaatatgaaattctgggttggaatttcttatctttaagaatgttgtggctgggtgctgtggctcacacctgtaatcccagcactttgggaggccgaggcgggcagatcatgaggtcaggagatcgagaccatcctggctaacaccgtgaaaccctgtctctactaaatatacaaaaaattagccaagcatggtagcaggcgcctgtagtcccagctactcgggagcctgaggcaggagaatggcgtaagtaaacccgggaggcggagcttgcagtgagcctagatcgcgccactgcactccagcctgggtgacaagagtgagactccgtctcaaaaaaaaaaaaaggaatgttgaatatagacctccaatctcttctgacttgtatagtttctactgagaggtccattgttagtctgatgggctttcctttataggtgacatgtcctttctctctagccacctttaacatttttttctttcatttctgccttgaagaatctgatgattctgttttttggagattatctttttgtgaaatattttgtgggagttctctttatttcctgaatttgaatgttgacttctctagctaggttggggaagttctcatgaatgatatcctgaaatatgttttccaagttgctgcctttctccccatatctttcagggataccagtgaatcatatatttagtctctttatataatttcatatttcttgggggttttgtttgttccttttcattcttttgtctttattcttgtctgtcttcttatttcagaaagccaatcttcaagcgctgagattcttttctcagcttggtctgttctactgttaatacttgcgattgcattatgaaattttttttttttttttttttgagacagagtagtgacacgatctcagctcactgcaacctctgcttcctgggttcaagcgattctcctgcctcagcctcctgagttgctgggattgcaggtgcctgccactacacccatctgattttttgtatttttcgtagagacggggtttcaccatgttgaccaggctggtcttgaacccctgacctcatgattcgcctgtcttggcctcccaaaatgttgagattacaggtgtgagccactgcgcccggccatgaaattcttatagagtgttttttagctgtatgaggtcgtttatattcttttctatactggctattttgtctgtcagctctgtatcgttttattgtgggtagcttccttacattgggtttcaacattctcctgaatctcaatgattttcattcctatccatattctgaattctgtttctgtcatttcaaccatctcagtccagttcagaacccttgccggagagctagtgcagtcgtttgttttagaggaaagaagatgctctggctttttgagtcatcagagttcttgtgttggtgctttgtcatctttgtgggctgatgttccttcagtctttgaagtcgctgtttttttttgtttttttttttttatcctatatgatgaccttggatgtttgtggtacaaggtaggttcagttaactggcttcattactggaggggccagggctcatctcaggactcccggagtacatgggtcctccaactctgggggactggcattgggccccagctttgttctctggttctttaaggttaggaacctgctgcactggaggggccgaggtgctcctggacctctggtcacaatactcccgtgggttgtgccagccaaagtgtagggggtggcagtggaatcaattcttgttcgcatgtgccagtagcagtggcagcaaggccacagggtgctggcctccatgtgggcattggcagcaacagtggcagtaaggccagggcggggggctgctggtacacatgcactggtggtggtgttagcacaggggcagggtgctggtgggtgcaggactgggtgtgccctctgtgcacgttcatgctggcttcagtggccggtaaggggtgggggtgggtcctctgttttctctgcctagtttcatgttggtgcaggggctcagtgctggtggggatggcactggtgggctctgtacctgccagtgctcccttgacaatggccatggagggataggcagggtgtactcacgctggctgcagtggcatgggagggtgcttgcacgcatgtgtgctggcggggaagggaaaacaaggtacacctgtgcacacgtgtgggcaaagcatttggagggtggccatgggcgagtgcctgcaggcaaagcagcatggagcagccttcggtgggaggagggtattggcaggctcgtgcttttccacagggatcactgtggttggagcactctgcctgtcagcaccttgtcagtgcaggagctggtatgtggccccccccggcagtactgcaagcatcctggccaggctggagccccatgagagaccagcagactgagggtactcaggtcacaccacccccaccttatgggcaagactgccctgcagagttcaggtctggcagttcctctagggctaaagtctcctatgggagcaagtcgagccttgggggatgggcactcctggccctgttgcactacagatgctccagcaccaaaacctctgagctctgccctggctggagttctgcccctaccacttctctaagcagctttccctgccagctcaagtgtccttggtggttgaggggtctccttgtggtggaggagtctccttctgcagggattccagagtcccctggtgagagtgggttgctgcttccctgttcaactcaactgcctcttcaggagtcactgggggccaggaaaaagtcccggtgcgtggtagccctgtgcagggttccttacttcttccctcgtcagttcagcatctgtgtcttccctctgtcagcactcagtgctttccctctgaagatctgctaagagtgtgccagtcatcctgatcctctgggagatgttcctactggctgcagctagttggccatcttggagccccctccctgtggcttttcatgatttctaataattacattgatgttacattctgtgggctgttcttattgaaatgtataaatttaacaaatcagttgttggtgtaaacttgctgatattttgtttaggatgtttgtatctatgagtaagattggtttgtaattttcttatatagctgttgtctggatttcatatcaaggtgattctagccttataaaatcaattggggagtttatataatctatttaatctctgtgttaactgaagttgtgtctaatatttcacccctaatgtttatttctttattttttcatgtttttttttctgtttgtgtatttcgtttttatttttttgagacagggtcttactctgtcatccagactggagtgcagtggtgtgatcactgttcactgcagccttaacctcctgggctcaagcagtcctcccaccttagcctctcaagtagctgggactacaggcacatgtcaccatccctagctaatttttaaattttttttgtagagacggggtctcaccttgttgcccaggctggtcttgaactcatgggctcaaatgatcttctttcttggcttccaaaagtgctaggattacaggcgtgagccactgtggctggcctcagtgtatttttaaagactcatttctaggccagacttggtgggtcatgcctgtaatcccagcactttgcgaggctgaggtagatggatcacttgaagtcgagagtttgagaccatcctgaccaacatagtgacaccgtttctactaaaaatacaaaaactagctgggtgtggtggcagacgcctgtaatcccagctactcaggaggccgaggcaggagaatcgcttgaacccaggaggaggaggttgcagtgagtggagatcatgccgctgcattccagcctgggccacagagcaagacttcatctcaaaaaaataaaaagactcatttcttagctttttaaactttgttttctgttttgttaattttgttgttacattttctttccttgggtttattctgctatgcatttttcccctaactttttaatgttacttatttatttattttttgagacggagtttcactgttgttgcccaggctggagtacagtggcgtgatctcagctcactgcaacatttgcctcccgagttcaagtgagtctcctgcctcagccacccaagtagctgggattacaggcgctcgccaccatgcccggctaatttttgtatttttagtagagatgggatttcaccattttggccaggctggtctcgaactcctgacctcaggtgatccacctgcttcggcctcccaaagtgctgggattacaggcatgaaccaccgtgcctggccttaatcttatgtttaaatgtggaaaaatgcacataacataaacgttaccatcttaactgttcctaagtgtatagttcagtagtattaagtacattcaccttgttgtgtaaccaatctacagaactcccttcatctcaaaaaactgaaaccctttactcattaaactagaacttcccattcctccatgttcccagccactggaaaccaccattctactttctgtttctatgaatttgactaccctggatacctcaaataagtggcgtcatacagtatttgtctttttataactggcttgtttccgttagtgtaatgtcttcaaggttaatccacattgcagcatatgtcagaatttcctaccttttaaaggctgaataatattctgttatttgtgtaaaccacattttctttatccattcaggacatttgggttactttcaccttttggttattgtaaataatgctgccatgaacatgggtgtgcagataccacttcaagaccctgctttcagttcttttgcatatgtacctagaagtagggttgctggatcatatggtaattctatttgtaatatgttgaggaactgttttactgttttccataggtatatgcactattttactttcccatcagtagtgcacaagggttccaatttctccatatcctcatttacgtttgttattttgtgtctttttttttatttttttgagacagagtctcactctgttgcccaggcttgaatgcagtagtgtgatctgggctcaccgcaacctccgcctcccgggttcaagcgattctgctgccttggcctccctagtagctgggactactggcacctgccaccatgtctggctaatttttgtatttttagtagagatggggtttcgccatgttggccaggctggtcttgaactcctgacctcaagtgatctgcctgcctcggcctcccaaaatgttgggattacaggcatgagccactgcgtctggccttatttcatgtctctttttgatagtagccatcctaatgagtgttaggtggttttatgactttttggtttttttttaatagaggtttttgctctgtcatgcagactagagtacagtatcatgagcatagctcactgcatcttcgaactcttggactcaagcaatcttcctgccttagcctccccaaagtgctgggattataagtggaagccactgtacctagcacgttttctgacttttagagttatatttaagctcatcagttttgaatatttcatttgattgtaagtattcaaagttataaatttattaaatgctgctttaattgtatcctacaagtttcaataattggctttttatttttcaatttcatatttccatataatgttttcaattatgatttctcctttcacctagagtgtttcatatgaatatgaaacatgttatggtttatatgttaccagtaatttcaaatttgaacttagctttatgaccttgaacatatttattagttatttattgttatgttataaattattcccaaatgtagccgttttgtacaacaaacatttattatcacataaagtttctgtccatctgaaatccattagtggctgaactgagtgtttctggctcagagtctttcatgaagctgcagtgacagtcttggctgggtctgtagtaatctgaaggcttgactgggggtagagcatttgcttccaagtaaattcacttacatagcttttggcaggaggcctcagttctttgctggccatttgtaagaggtctcagttcctttctacttgggcttctccatctggctgcttgtaatgtggcagctgacgtctcccagagtgagtgatctgagagaatcaaaagccacattctttcatgatccttagaagttacataccttcctgcttgccgtataatattggttatgcagaacaacccgaataccagatgagagaggatgacacacgggtgtggatatcagaatgtaggaatacttgcagaccatcttggagtctggctaccataagcatacagtccatttttataaagttttcatgtcttcttgaaaatgatatgtagtcccaagttcttgagtgtgatttttacataggagtttgatcaagtttattaagcagttcaactcttctaaattctgattcttttttgtctgctagatcttactactgagaaaggtaagttaggaaatctttcactgaattagtatgtttatgcttttttcttgcagatgtgtcagttttgtgtgtgtgttattaggtgcatagaggcttacaatatcttacagttgatttgagtcctgtatcatcatgtagtgcccctcttgatctctagtcctttttatcttagtccactccagttttctcttgtttctatttgcctgatagatctttttccatttcttaactatcaatatttctgtgcctgtatgctttatgtttgtctcttataaacagttcatgggaaaccagtctgatggtttttttttcttctgcctggagagtttagttcatttacattcattgtgatgactgacatctttggattcctttctgccattttctttttaaaatttaatctaattattattacttttttgaaacaggggtctttctctgttgccctaacttgagtccagtggtgtgatcatggctcactgcaacctctgtctcctgggctcaagtgatcctcccagctcagcctcctaagtagctggaactataggcatgtgccatcttgtctagataattaaaaaacattttttttttttgtagggacagcatcttactgtgtttcccaggggctagtcttgaactcctgagctcaagcgatccacctgcctcagcttcccaaagtgttgtgattacaggtgtgaaccaccacccccagctctgccattttcttatgtgccttttattcaactgtttcatttttttaccccttgagtctcagaatttacctctgggttcattttacttctgcttgaagcatattctttagaatttcttttgatgagggtctgttgcagtaattgctcttactttcctttctttgaaaatacagggccagcgcggtggctcacgcctgtaatccgaacactttgggaggccgaggcgggcggatcacaaggtcaggagatcaagaccatcctggctaacgcggtgaaacccccatctctactaaaaatacaaaaaatagccaggtgtggtggtgggcgtctgtagtcccagctactcagtaggttgaggcaggagaatgacgtgaacctgggaggcggaggttgcagtgagctgagattgtgccactgcactccagcctgggtgaaagagcaagactctgtctcaaaaaaaaaaaaaaaaaaaaaggaaagaaaatacagtagtctccccgctccccccacaaccacttatcagcagttttgctttctatggtttgttgcccacagtcaactgcagtctgaaaatgttaaatggaaaattccagaaataaacaattcataagtttaaaattgcatgctgttttgagtagtgtgatgaaatctcacacagtcctgcttcgtcttacttgggatgcaaatcatccctttgtccagtgtatccacactgtgtatggtacctgcctgttagtcacttagtagccatctcatttatcagattgactgtcatgatattgtagtgctgtgttcagttaacccttattttatatagtaatggccccaaggaggaggagcagtgacgctggaatattgttataattgttctttttttaaaattagttattattgtcgatctcttactgtgtcttataaattaaacttttttataggcatgtatgtgtaggaaaaaaacatagtatatatatagggttcagtactatccctggattcaggcatccactggggctcttggaacttatgccccatggataaggggagactactgtatctttatttctcccttattcttgaatgatagttttgctggatatatagaattctggacagttatgtttccctcagtatgttaaagatactatttcactatctgtctgctatcatagccattgagaattcagttgacataattgcctttattttataggtgacattttctctccagttgtttttttaggtctcctttttgttgtttgttctgtagtttcaccaaaatgtttgtaggtatatggatctctattctgctttgagtttttggacttcttgggagtgacatttgttgttgtctaacagttctaaaaagccattaccttctcaaatattgtttcttttctgtatttctattagttttcttctggaactacaattagatgtatgtaatattgtttgaggctgagccaagtagtgtactgtgattaagtttactttctggtacaactttttgtgtctcctaaatgtaatgtctcatttagcctcatttttttcatttgcttcagtttttatgtagctattgttatttctttccatcattaacacgttctcagtacagtttttcacatagggtcaaacctgttaatctgttcagtgtgaccattttccttgaggatttcctcccatgctagtgtttagaattggctgcttgctataccaggtgtgcagctatcatcctgtgttctcccttcagcatcattttggaaattcctattgcttgtctcctgtgttgattcccttgttttgtggatctcattcatttacaacacaccttccactagcttgctggaaaaaaaaaaaagtacaaaggagataaattttgagaccttgaatgtttgagaatgtctttattctaccttttttgaaaaaaaaattgataatttgtctaggtcttaagttctaatatgaaataattttttttctcagaatttggaaagaatttctccattgccttttagtttatcactgagattattgctaaccccaatgccattctggtttctgttacgttgtcatcaatctgtttattttttcttttctagaatccttggaatttttttttatttgtccttgctattctgcagttcaataataacatgttgggataccaaatgggtcttacttagtttagagactcttcaagtctggaaaacttcttgtgttattctctggcaacgtcttcctatcttatttattaatttttttctttttttcacatgttggaattgattactcatgtaatgttttacatttttttctttcatggtctttcttttgttctttttttgtagaaaatatcttgactttatcttccaactctttaatgttttctttctttctttcttttttcttgagacagggtctggctctgtcgcccaggctggagtgcaatggcacgatctcagcactctgcaacctccacctcccgggttcaagtgattctcctgcctcagcctcctgagtagctaggattacaggtgcctactaccacacctggctaatttttgtatttttagtggagacaaagtttcactatgttggccaggctggtctcgaactcctgacctcaggtgatccacccgcctgggcttctcaaagtgctgagattataggtgtgagccactgcacctggcctgctctctctattttaaaaatagcattctttagtttttttttttttttgagtcagcgtctcgctctgttgcccaggctggagtgcagtggtgcaatctcggctcactgcaagctccgcctcccaggttcacgcaattcttctgcctcagcctcctgagtagctgggactacaggctaattttttttttttttgtatttttagtagagacggggtttcaccgtgttagccaggatggtctcaatctcctgatgtcgtgatatgcccaccttggcctcccaaagtgctgggatcagaggcagcattctttaaatttttaagtattttttaagatactaataatttaccgtattttgaagttttcttctcattcttcattatcttttttctcaaaattaattgtgtgtacttggttctttttctttcatgttaataaggtttccttatacctggtgattctgagctgttttcactttaaatatctaagttttgtttgtttgttttttgagacagtctcattctctcgcccaagctagagtgcggtggcatgatctcagctcactgcaacctccacttcccaggttcaagaaattcttgtgcctcagcctctcaagtagctgggattacaggcatgtgccaccatgcgtggctaaattttgtatttttagtagagatgaggtttcaccatattggccaggctggtctgaaactcctgtcctcaagtgatcggcctgcctcggcctctcaaagtgctgggattacagcatgagtcattgcgcctggcctactcttagatcttaaatgttttacacagacacacacacacacacacacacacacacacacacacacggtaactgtgatgatggatgtgtcagttgatcgtggtaatcatttcagaatgtatacatctattaaattatcatgtagaccttaaattattatttttgtcaattatacctcaagctggaaaaaaatgcagatctactcttaaatgtgagataattggaagctcatgtgcatgggctagggtaagttggtggagaactaactttattgttggaggctttctaaatgtatgtcttttctttgaacattagtttgttccagaaaatattgcgtggttggttgcctgggaagatgtatgtctgattttcggacttggaagcaagataaaggaaagaggctgctggtttatggtatagagattttcactcgttaagaaagtaacaaagtaaggaagtaggattattgtagaaatattattttacagttcaagtttgtaaaacacaggtgaaggtaatcgttggtgggtctcttcctctgagatcaccaaattatctgtagactggttggtagacttggagagaccacttgttcttggacaacagttagaagcatactgccctaagcagtaaaaaggtgattgttgagggcagcaagaggcggtgtaacataccagttcatttttcttttcttagcaagcatgtactaattgccttttaaaactcctgaccataggggataaaacgattacaagaaagataccttccctgctcccatggaatttacattctagcacaacagtggatattaaacaacgtatcatctggttatgtaattacagtaataagaatcatgtaggagaggtcaaggaagcttactgctgtggggttcaggatggcatctccgaaagtatgaataaggaaagtggtgggagaataaaaggagagtggcagagactcagactgagagattaattgagataatgacaattgtgggattcaatgaggtgtataatgtgtttagtgcctggtacttgtgctcagtaagtgctaattagtagttgtttatagcaatactgttatcttggatgatcaaatagaagatccctagcaagtaattttataaagacaaaaatttcgtgtcaactctgtaataaaacaatatatccttagaatcagttatcacttaaaatccttattttatagaaatttttgtgtttcaaaagtatagctagggcaagtcccccttcagggtggatacttaaaggagatgaaatcacttcataaaggtgtctgcactcccatgttcattgcagtgttatttacaaggtagccaagatatggaaacaacctaaatgtctgttgatggcaaattgataaagaaaatgtgtgtgtatgtgtgtgtttatacaatggaacgttattcagcctttaaaaagaaggatattctgtcatttgccacaacttggttggaccttatgctaagtgaaatagaccacgcacaaaaagaaaaatactatataatctcacttatatgtggaatgtttttaaaaagtcaagtatacggagacagagaataaaacagtggttaccttgggcaggaggaggaaggaaatggggttatatagataataaaatagcagatatatagaatgaagaagtctggagagcttatgtataacatgaagactatagttaataaaacaaaactgtattaaggatttttattaagtaatttagctgcttgtaacacttacacacacacacatagtaactatgatagatgttttcactgtagtaaccattttgctgtctatacacatcccaagatatcagcttataaatctcatatacacagatttttttttttaaaggtattgttggggcagggatcaggcttaactttgtggttgtatctgtagtacccagcacagtgcctgacacatagaaggtgttaatcttgttttttttttttttaggtatctgaaatacttaccagaaattctattctttcagatgagagacatctatgtgattttaggtattaataaaagaaatattcttccttttttcttactacggtgttggtagtggtgctctttcttcagggacatcattgatggccttttagttagaatttaaatgttatcctttctgtagccagcagggatctgttgggataaagtcttatttttcttttcttgggagtaattggtgctttctaacttttcagcacttagactcacaatgtattagttatctattgctgcaaaacacattacttcaaaacttagcagtttaaaacaacagacatttattatcccacagtttctatgggtcaggaagataggggtaccttagctggatgcctctggagcacggtctcttgaggttgcagtcaagctgttggctggggctatatcatctgaaagctttactggggcaggggatgatgtacttccaagttcactcccatgattgttgggaggaggacttaattccgtttcttgtgggcttcttcctggtttatgtttgttacctggtgtctagagctgatgtattgggtacttcccctctagcatggttattttctttgttttttctctcatttaggtgaaaacttaggtgaattttaatgtaaaccctacccccattatggtctaaggggccttttagaaaatgagtagaatgtacacagaggcaaaaattttagcctgtgaccttttgaagaattttctaagtgaaactagaaacaaattaaccattgttcacagagtgctttgcttaatgttatgccttcttttgctaaatcctcttgtttgttgaaatcttacatcttaagttgctgatagtttgttaatagagatcataattaaaaggtgattatatttcttcatgcagtttagctttacatttcttccattatacccaaagatttctataatatagcaagaaatgtttttaaaaagtgtttttcctcaattgtgtgaaagtaatgtatctaactgaaaagaagagaaactcataaaagtaaaaattttaaaaaatcaccttattcttacctctcaaatacaatgacctcatattttaaattttgctcaaggttttttcctcctcattctaggcataattattttcttatatgtgtttcagtattactttttttgtgaaaaatatggttacaaatgtggtctaatttcattttgcactttaaaaattattaatgaggccggaaatgaggccgggcactgtggctcatgcctgtaatcccagcactttgggaggccaaggtgggcagatcacgaggtcaggagttcgagaccatcctgggtaacacagtgaaaccctgtctctactaaaaatacaaaaaattaaccgggtgtggtggcaggcgcctgtagtcccagctactcgggaggctgaggcaggagaatggcatgaacccgggaggcggagcttgcagtgaaccgagatcgcgccactgtactccagcctgggcgatagagcgagactctgtctcaaaaaaaaaaaaaaattattaatgagatggtcatatttttatgttatttactgatcacttacctttgaattgccccttgtttcttgaagtttttccaataaatattcttattaataggcaagacaacctgatctgttagttatgtaaactttttggtagctaattgtatgtgcattcttttacctcccgtttgtttctttattagcagtgtctttttgttatagaatttatacattttcttgtaagcaaatatcagtgtttttattataggtgctgtatgtttgtcttgcttaggaaaatctttattactccaatattattaaattattctttagtatttgtcctaatagctttatggctttgttttttttaaatcacacacacacactcacacacacacacggacacacacactctttgagacgggtcttgttctatcacccaagctggagtgctgtggcgcaattatggctcactgcagcctcaacctcctgggctcaagatatcctcccacctcagcctcccaagtagctgggactacaggtgcataccaccacccccagctaatttttaaatgttttttttgtagaaacagggtctcactttgttgcccaggctggtctgaaactcctgggctcaagtggtcatccttcctcagcctccccaaagtgctggttttacaggcatgagccaccacacctggcagcacccatatattttaaaatttagtatgaattagtcttttctttttgatgtggcataattgtattgactaatccattctttaccattgatttgaaataccacctttattatattaaatttgtgtgtgaatatgaatatcttttctgtgattgcaattaatttgtacttgtacagattgtgctgtaagagcttaacagtatatttcagtacttggtcatgtctcttgttcttgtttttcttttcttttcttttttttgttttgttttttgagacagagactcgctctgttgcccaggctggagtgcagtggcgcagtctcggctcactgcaagctctgcctcctgggttcatgccattctcccgcctcagcctcccaagtagctgggactacaggcgcctgccacgacgcccagctaatttttgttgtatttttagtagagacagggtttcaccgtattagtcaggatgatcttgatctcctgacctcgtgatccgcccgcctcggcctcccaaagtgctgggattacaggcttgagccactgcgcctggccttgttcttgtttttcaaaaatttctttggtattctcacaagtttattcttccaaattaacttcagaatcagcttaccattttaaataagcaccccccttctaaatctattataacatctcactactttctcttctattcatattagcttaacttaagctaccatcctctcttgagtaagactgttttctaacatacagcaacaagagggttctttttaaaacataaatcagattatgtcattcctttgcttaaattcgttcagtgcctttttcccctgtcttttggttatctattgctgtataataagctactccaaagccttgtagcctaaaaacaaccattttattgtgctcacaatttttgggggtcaggaattcatgacaggttcagctgggcagttcttctgttccatattgtgttgctgacactggagaatcccttccattatggcttcttcagtcacatgtctggctcctcagtgtttcttggcctctctctccacaatggcgtcccattcttcagaatctctgcatgtggcctcggcttctcacagcatgctgatctcagagtagtcccattttttacatgacaactggcttctaggaagagggaaataaaaactgtcagaccaattaaggactatggcctggaactacacagtgtgcctttaagccgtattttattggtcagaatagtcactggacctgctagatgaaaggaggtagaaaaataaatttcttttcctaatgagggagtggcaaaatcttattgcgggaaagcatgtgggatgagagatacttgacagttggaaaatataatccgtgacatcgtcaaattcaaaataaattcagagttcttaaaatggcctataaggcttttcatgatctgactcctgcttcttgaatctctgaccgcatcccctagattttcctcttcgttccctttgggttaaccacattggccctcttgctaggctttgaacatgccacacccaacatcagatccattttacttgcaactactgccgtgaatgctcttctttagatctttgcatgggtcttcccgttctcattcattcattcattttgagacagggtctcactctgttgcccagactggagtgcagtggcacgatctgggctcaatgcaacctccgcctcccgggttcaagcaattctcccacctcagcctcctgagtagctgggactgcacgcatgtaccaccatgcctggctaatttttgtatttttgggtttcacgaggtttccccatttggccaggctggtctcaaattcctgacctcatgtgatccgcccgcctcagcctcccaaagtgctgggattagaggtgtgaaccactaatcccatggctggtcttcccatttttttacttcatttaggtctctgctcaaatgtcacatcttcagagagcttcccctgaacaccttatctgataaattcttggttacttagaactccttaatcttgatttttttttccttttcatagaatttggtgctgttagtaggagcctggggggcctaagtaccacttttcttccttccctgcctggcttctgagcaagttgagaaatgagtaaaggtggaggccaaaatatattttaaaaattcttctgactaaagggagatgaagtaaagggaacaaaagaagtatcatgaagattctcagatgtccgacatgggaaactgggtagattgtggtactatttaccaagacaggaaacatggtaggaagattatgaattaagctttggaaatgttgagtttgaagtgcctacaagttatccatgtggagaaaccaaatggacatttggataacacatctgaagctcaggagagaagtttccattacagattcaggtttggtagttgttctagttttctattgctgtgtaacaaactaccacaaacagtagcctaaaacacacaaaattactatcttacaatttctgtgggtcggagtcaaggcattgcttagctgtgttctctgctcaggttctcatcagcctgaaatcaaggttttggttggggcctcagtcttatctgaggcttggggttctcttccaggctcattggttgttggcagacggttcaggaatctggggagacaagatttttgggagcgccaacccagatgtttccattccatgtgtcagagtcttgttctttcctagccaggcccctgatctggacgtaggagacctgctgcctttgggagttcaacctttgaagcccaacacatacagatttagatatctaatctgtctgtccatccatccatccatccatccatccatccatccatccatccatccatccaatctgtatatctctgagatatataagtgtaataaatgggcgataatcaagtgctggttttggtccttaggtttctctgccctcctgctgcaggagaggagaatctctgtgttttcagagaggttctctggctttcaaacttagttttcaattggaagttaatcagcttttttgtttttatcttttttctttgaaatcaacatctgggagtgaggagcactgggcaaatgcagtgcaggcccagcaccagctttggccaacccccacggggagcctggagcgagaatgggagcctgggacaagaatggctcttctgagttgcccagaattgcggtggctgatgtgtccaggccttcatattgccatatcaattagtcatttgatgtgggttatcttgggaaggatatgaccttgaacagggttgttccttgtaggtgaggcaatccctgaaggggctgactgacagcactcccagcatttaaggtaagtccttttttgaaggaggaactgggtagcacctcagtgtctaccacgatttctctgtatccaccaaatggccaatttgtttttgttttttattatcattattcattcatggatttaaacatatatttagcaaactttctgttaaattatgtgtatagaaaagggcacaaattgtaaatatacagctcagttaaatgttcacaaagtaaacacaccagtgtaaccagtatccagatcaagaaataaaacaatactgtgaatctaggagtcctcctcgtgtttcctttcagtcactgttttccagggatctatcctgacttctaaaatcatgggttgaatttagcatggttttgaaatttatgtaacatcatacaatatgtcttgttctgacttctgtctgtcagtattgtatttgtgaaattaagctcacaattgtaagtcattctcttgctgtatattttttcatggtatgactataccagtttttaaaaaccatttctgctattaacatttggattgttccagttgttgggaattataaaacatgctgctgtaaaacattgttgtgcatgtcttttggtgaacatatatacatttctgttgggtatatatctagtgaaattgctgaatgtgtgtgtgtgtgttcagttttagcagataatgccagtttccaaggtaagtactgagttacatgcctactagtagctcctaagatttccagttgctgtaatttgctcctgtttgtagaagacacagccttcgagggcttatcactgagaactgtatttactaaggtctccactagcagattctgaactcttttgtcctctcgaagctgcaaggctttcaaattctgctttgcttttcagaagtttttagtttagcctttttaccctcttccactcactgaggcatttgagattccctcacgtcttcagttttgccaatctagccctcagtgaacaccagaatctctgatggtttcttcttccattagaggtacattgcctgggaaaaaagccttatttctcaatctgttttcctgaccagaatctgcaaatgccccaggggaaaagcagctgcagaagatccccttacctcattatagctcactctttttggaatcttagtgttgctaatccctattccttcagtagctctctgaattcttcaaacaggtgatttttatatttcatcttttgttagaaattaagtttgtggtgggagctattgttttgcagtaaattattctatcctacatggaaacagtagtatggatttaaatatatttaatatgtttcaataaattgccatccttaagtgttcaaattattacacttttggccagtgggggcctctttaaaattcattcctaaccatttttggcttgaccgttattagtcagtgctgctatctggtatgacaagatgttccggggtcattatgtcttttttttttttttttcctccagacatagaagcagccatttcctaaaggagtccagattccttttactgggaaatggtcgttcaagattacaactgagtgaggattactatgggattggtcattagtcattactatgggattggtcattgtttctaggcattttcattggacagaaatagaaatatgttttttaaagtacaaaataaaatatcttgacttcatatagatacttctatttcaaattcaagactacatttctttactttaccattacttttatttcccatgctgaaagtcttgggtttttagaggcactaggagtcatagaattaaaataccacagaattatttagttcctctctttataccattaaataattagatacatttataccattaaagaattagatacagttttcagttgatttgtttatttttgatttctagacttcttaaaattttaattttatgtttatgtaagttacgtagttctaaaatgaaatctacaaaaacaatatgtattccatatagaatatggattctatccttttcacttctactttcttttcatttcctaaaggcaaccactaatttttttgagcatttcattcttctactgttttgttttgtttcttaatataagaaacatatatttctatctcctccctcttcttagatgaatggaacatactgtgtatattttctccatcttgttttttttttaacttaagatgtgtcctggagattattctatcatttaatgaatttggattcattttttggttttacgttacattttatacatgtcttttatttaagtgtcactgtgttcatgttatttgctctttcagcatatataaatatatacacttatatacatgtacacacacacacatacacacacacacacacacacacattttttgagacagagtcttgctctgttgcccaggctggagtgcagtggggcttagctcactgcagcctctgccccctgggttgaagcaattatcatgcctcagcctcccaagtagctgggattataggcacgcgccaccatggtcaactaatttttttgtattttagtagagatggagtttcagcatgttggccaggctggtctcgattgcctgccttggcctcagcatatatttttgtatttagaaagatttattcagaccagcgttcatactgtgtaatgataaggaatttattgtagaaattagattgtatacagttttgaggggactaagtgaggtgagtatctggaatggggaattggaggatcagaggagtccactaaccagatcgtccaaatcaatgacaatgggtagataagttggagctgttggggaaatctgagaagtcaaatatatccagccactgaagtgagattatgaaggaggagcttgaggagggcactgtgggaagctcttgccatgtaaggtttgtcttacaaagccctgtaggtttgcacccaagcatctggtggtaggtttgggctagtattggtcagcaaagtgaccactggtccaaagaaagagctggacatggagtgaaagagagagagagtaaaagctggaactttctgggtgcctctgtatctgtctctcattgtatgttactgtgaaaccttcagaataatagctgctgcttcgcttccacatttcaaacaaattttatacaggtcgagtatcccgtatctgaaatgcttgggaccagaagtgttttggatttcacatatttttgggttctagaatatttgccttttactcaccgtgatcatccctaatctgaaatgagcatttcctttgagagtcatgttgttgatcaacaagtttggattttagagtgttgtaggtttcagatttttcaattagggatagacagcctgtacaaattaccctttagaccaactctaaccagaaccatatagtgagtgggatctgggaaagtagttcccagcttaacagttaacacaccacgcaccaccagtacaatttgtgtttttgttctggtggttaccattatattaatacctttatatggtattctaatttccttctcttttggggtggaggggtattatgtgttggttttttactctgagcaatattgaaatgaactagaaacctcctttcctcatctcctttttccctagcattttactctcagttaataacaagacaatcaagaaacatattctactatttatatgctctcaccaccctccctctcctcattttgataattgtattgtatctatattatcaagtacataaagcagtcacctaatatactttctcccttattgccaccattctcagttcttttagaaaacacagtgatgctccggctgggcacggtggctcacgcctgtaatcccagcactttgggaggccgaggtgggtggattacctgaggtcaggagttcaagaccagcctgaccaacatggtgaaaccccgtctctactaaaaatacaaaaaaattagccaggcaatggtggtgcatgcctttaatcccagctactagggaggctgaggcaggggaatcgcttcaaccttggaagcagaggttatggtgagctgagattacgccactgcactccagcctgggtgacagagcaaggctctgtctcaaaaaaaaaataaataaataaataaaaatacagtgatgctccacataatgacattttggtcagtgatggactgcatatgtaatgggagtccctcagtattataatatggtatcattaccttttctatgtttagatacacaaacaccatgtgttcaagttgccaagagtattcagtacaataacatgctgtacagttttgtaccctgtataccatatagcctagaggtgtggcaggctatactatctaggattgtataagtacactctgtgatgttcacatgacagtggaatcatgtaaggacacatttctcagaacataccccatcactaaatatatttaatgattcctattaatgtggatgtctttccaattattctggtcatctgaagcatattctctagtatatcctccaggaaaaggaaaagggaacaaaatttccagggttcttgccgtttagcacagtttgtcattgctataaaattgtctctcagtatctgggacattggttccaggaacctccatggacggtgaaatctgtagatgctcaagtccctgatatgaaatggtgtggtatttgcatatagcctacacacatcctcctgtgtactttaaatcatcccttgattactgataatacttaatacaatgtaatactatataaatagttgttatacactattatttagggaataatgacgaaaagtctgtacctgttcagtacagacatactaaaatttattttttgatctgcagtttgttgaatgcatagatggagaactcatggattcagagggctgactgtatttgaattcagtttggctagatataaaatccttggtttatgttttcttctttttttaattatactttaagttctagggtacatgtgcacaatgtgcaggtttgttacatatgtatacatgtgccatgttggtgtgctgcacccattaactcgtcatttacattaggtatatctcctaatgctattcctcccccctccccctaccccacgacaggccccggtgtgtgatgttccccttcctgtgtggtttatgttttctttaaatatcttaaatttattttactttattgttttctgacataaaattttgtcaaagtctgatgagagtctaatttttgggttttttttgtataaataatgtcctctttctgcctgtaagttcaaaagattttttttttcttgttcacggaagttcaaaatatgttaaggtattggtcattctgggtcacttttccaggtgtgtggtatgcacattaaagatacagtttcaagtttttaaaaatttcaataataatttcagcaaagttttcttgaattctagtttctaatatccactttattccattggtttggtttctttctttggtgactcctgttatatgtatgttgaatcttctttttctatctttttttgtcactttattgtaaatttttattatctcgtatgtaatttcttttttatattacaactttcctccttagtccccccttttttttcaacatttgtttactcttaaagcattatcttctgtgttaatttactcttatgtatcttctggttagttttcatttctgaaatgatttatcttctaattctttcttgagttctgtcaacttatttctatctgtaattcttatttgtgttattccacatcttttgtcattttcttaatttctcttggctcactttgaaataataatttacagttttcatctgttggtggatatgtctttttggaaactttgattttctgttgtttagacccttatttttatgtttttctgtttcttactcctttttcttaataataactttacatattatttgaccatagaacttttctgttggcttatttttatgtgaaattaatttttctgaattggtaggagggatttgtaggccaggatagctttgtagctttatgtctctagagcttattctttttttactttcatgaaataaaaaaaaaatggtctcattctttcagagatctcttgttcatctctctctttttcatttttatttggacctttttccttttctccctttacccctgttttcagtttggagttcattctcagcagtttcttctcagtgtgggctagaactgtgctgtccagtcagatctaataattacatgtgtggctacttaaagctaaatttaaataaactttatttaataataacttaaataaactttaaacttttgatttcttgtctataccagctatgttacaagtggttaatagctacatgtgacgactagtggctgttgtattgggcattgcccatgtagagcactatcattaccacagcaaatcctattagacagtgatgcttttgagtgtgctccattctcttgagacttttatcataggcctttttcattcatctgcaaattgcaatgagcataactaccctctgttttggctaatattcctaaattgggctgctgtgctttttattaaggatgcagtacattgggaatctcctcttgtcagatccattagacattctccttccacctgctttctcttgcatagatgcttataccacattagtatttttgttttttgttttccagacacaggatctcgctctgttgcccaggctggagtgcagtggctagatcacagcaactttctgggctcaagcagtcctcctgcctcagcctcttgagtagctggattacaggcacacactaccaagcctagattttttttttttttttttaaagtaaagatgaggtctcactctgttgcccaggctggtcttgaactcctggactcaagcagtcctcctgcctcagcctctcaaagtgctgggattacaggcatgagccattgcgcatgtccccaaccagttttgtaactataaatggtttgtttctatttgttcacttctctgggtttgggaatgagggaccttgtcccttcattttcatgtagatattcatcagtttgtgtttttactagagaagttctagtttctttgattttttttttttttttttttttttttgagacagagtctctgttgcctaggctggagtgcagtggtgcgatctcagctcactgcagcctccacctgctgttcaagccattctcgtgcctcagcctccctagtagctgggattacaggcatgtgccaccacgctcggctaactttttgtatttttagtagagacagggtttcaccatgttggccaggctggtcttgaacttttgacctcaagtgatccacctgccttggtctcccaaagttctgggattacaaatgtgagccaccgcacctggccatttctctgatttttatgggatacttagggagattcaccagctgcattttatgaaaccctagttcaagaaacatactggaaaaggagatatggtcacaaagaataggagatgtttctaagggaaataataaattaaaatgaaagttacagtgacttgtgctcactgaatctaaaacccagctgattaaaaatttggcaaaataaaattaaaaaggttatctgtgctcgtaaacaaaagtcccatttttggcctttcaggtttttttcctccataatctttataattaacattacgaagttctgtagtttctgttctgccccctcctttacactctaaaaatgctgccccaccccgccaatttcatttagtatttccttttttttttttttttttttttatttgagatggagtctcgcccgatcgccaggctggagtgcagtggcgtaatctcggctcactgcaatctctgcctcctgggttcatgccattctcctgcctcagcctcccgagtagcttggattacaggcacgtggcactacacccagctaatttttgtatttttagtagagtctgggttcaccatgttggccaggttggtctcaatctcctgacctcgtggtctgcctgacttggcctccgaaagtgctgggatgagccaccgtgcccagcctatttagtatttctttactatcaaaataatcgtccattattaactgatttagcaaacttgggcatgcccctcggtctctttccacctttagttgtactatgttaaaaatgagaaagttatattcaggtttgtttttttcacagaggaacattgctaggtttctctgttagcattagcagggtttaatattaacagtaagtatgtccatgatgctttaaatacagaatgctatttttgagcagagtagagatgaacttctagacagtggaacttaactcattcacagagaaatgtaaatgtggtcttctcatagaatattttttctcatgggatttgtctgcttgtgttctgttatcccttcaattgtgtagctgagggtgcttatcttactgagtgagtcttactgttttttccccaggttttatagtttgttcttgcttctgaacaatcagcagttgtttgccattattgacaagaagtctagggcatagattttcttgatctgtttttcttttaatgtttgagttcaatggataagggaaacggttgtatgcattttattgcagacattctctgaaataatttttagccacaagcaaatagctctgtttctgtgagtcatcatttcttcttatatagtgctggataaagaattctattttgtagatagagatttatgacttccagaaagaaagctgcaaaaatggaagtttccaaagaatttaagatttgctataataaatgctatcatatattggtgtttgagatgcaaatgtacatatctgtgtatcatatattggaggttgattgaaaatcggagtttgagatgcaagtataggtatctgtggttgatgcagttttcctaaaacgtcatgattttcaatggcaagtaagttatttatggtcgtttttaaggataagctgttaacgtgttttttttttctttttttttcagcttccaataaaaacaggacagcagaacacacataccaaagtcagtactgagcacaacaaggaatgtctaatcaatatttccaaatacaagttttctttggttataagcggcctcactactattttaaagaatgttaacaatatggtgagtatttgggttactgtgttttggggaatttgctttcttttctttttgattaaaaagtttagaacagcatattttgaagtatggaaagtgattttctgtggactttggatataaccattaatcttattttgtttacgagcacagataaccttttaattttattttgtcaaatttttaatcagctgggttttagattcagtgagcacaagtaactgtaactttcattttaatttattatttcccttagaaacatctcctatcttttgtgaccatgtctccttttccagtatgtttcttgaattaggatttcatagagcttttgtggcctacacgaattgaccacagtaatccattacacatatttttctttagcatcttgtttgaatttacttacggttgtcccagccctaagtagatgataaaatatgatctcatagtcctaaaatgtggattgatttttttatgaagatatgtgttttttcttccttctgtaacctgtgacagattctgtagtagttaccctgttgttgaaacagtttttctcaaataccagtttcatcaaataattccactgttaaaagctcataatttctttcttcttcccattttctaaaatcgattgacgtttcctagacttcagagtactccagctgtcctccctctgtacctttgaacatataacatcttttgtctttctcaagtgatcccttcctctctctaaattcctatttaacatctccattctaagctgtttcaaactaacatactcagttcatggcaactgatctggatttttcttgattaactctgaactctctgctggtgtttagcatttatttatttatttatgaatgaataaatgaatgaatgaatgaatgacagggtctcattctgtcacccaggctggagtgcagtggcgcaatctcggcttactgtaacctcccccttcccagttcaagtgattttgctgcctcaggctccccagtagctggaattacaggcatgtgccaccatgctcggctaatttttttgtatttttagtagagacgaggtttcactattttggccaggctggtctcaaactcctgacattaggtgatccgcctgcctcggcctcccaaagtgctgagattacaggtgtgagccaccgcgcccagcctgcatttataatcccagtttgtatttgtttgtattgagttgtgaaacaacttctggttatagattgtgaagattgttcccccttccttttttttgagatggtccttaggtttattagataatattctagtatgacattgaaaagacatgaagttacctttttgccttattcccatattttagataatttttctcttgttctattttatttttaactggcatacaataattgtacatgtttatgggtacatattgatgtttcaatacatataatacatagtgatcccactagggtaattagcatatccatcatctcaatatttatcatttctttgtgttgggaatattgaatattctcttgttatttgaaactatataatgttaactgtaggccaggcatggtggctcacgcctgtaatcccagcactttgggaggccaagacgggcggatcacgaggtcaggagatcaagaccatcctgtctaacatggtgaaaccccgtctctactaaaaaaaaaaaaaaaaaaaacttagcggggtgtggcggcatgtgcctgtagtcccagctactcaggaggctgagacaggagaatggcgtgaacccgggaggcggagcttgtagtgagccaggatgcgccactgcactccagcctgggtgacagagtgagactccgtctcaaaaaaaaaaagttaactatataatgttaacatagtcattctacagtagtacagaacactaagtcttattcttcctataaagctatatttctgtatcctttaacaaatctctacccaccccgattctccctacccgacccttcttacctctagtgtcctctcttctactttttactctttttagcttccacatatgagtgagagcatgtggtgtttaactttttgttcgcatcatccttggtgtgtttccttttaagaaagttgcttacacaataccctaaacttacaaaactaataaactggaggtgtagaaaatcatttaccttctttatggaaaaaattagtattttccccccaaaagcaggaccatttataaataggtaaagagatttacggaaagacatttaacattttttgtagctcctctgttgcagtgtgtggggcacagtttagtatttgcacatatgaatatgtggctgtgttcccagttatattgaaatattttaatatttgggaccctcttttcaaaacaaaacagcattgttatattggcgttcatttagtgcttattaaataagttttcaaaaccatagtctcttgttaataaatacatatgtagtattcattttgaggatagtgagtacttaaaattcactgtggtgctatagcatgtttttgctataaaaattaagactttgatcatttcgtggcataaaagtatagttaaatccccaattcaagattctggtacaggtctatatgtgtgtctaaatcctacatatttttaaagcatgaagcaaaacagcatcttttactgttacaaggttaatggcagactctaataaatgccatttctgtttgccttagactttagtttttatgaggattaggataaaatcagaaataatatatttaagtatagtataatctgggaggtaaaatggaagactattgttgatcttttagtctttcacttttcagatgtgtgttgattggtagcagaaagtgaaactaacttttatgttctgaatatcttttctgttagagaatatttggagaagctgctgaaaaaaatttatatctctctcagttgattatattggatacactggaaaaatgtcttgctggggtaagtaaattgatcttaagtaggcaggctttgtgaatttgatcttgagaatgatcttatgtcccaaagtacagatgtggaccaagaggacagtcctatggacttttgtctgagacatataaatatgagttttgttaatatagctgacctggtgacagacaatttttcatgagaaaattttctcatcttttgtaaattaaacagatattaagtttacttataaaatgttatgtttcagccacgtatctgtctctcaggtttttaggaaaatattttatgaagagatcactatttgatttaacggatctctcagagagttgtgggagagtgcgattcagaagtccaagagtaatcttgtatttcctcctatatgaatatgattttaatattctacttttgaaatttatgtaaatgagaacttaaaaattaaacctattaaggatagatgttaccttgagaacacttgttttatgtagacacacaaatatgcgataggtatgtggaggaggagagtaccaaacaattatttctctggtttcctgtaagttgttaccacagtgtatttcaaccatgacttaatttgaactttttcaagagtatttctattgtgtaaagaaagtatttctatacatcattatccttaattcttcctggaacatggtaagagtttatataaatatataaattaaatacctctgttttaatgatctgcctaatccatgtgtattgaaattaactcatttcttatgttctctcttcctttggctcagaattcagaattttgttttgattcagaattgcttccctcttcacatatgttgcagttctctatagtgaaactagttgaaagagaccttaatatatgaggactgatagtgtggttgagaagtgttggtggaagcattggggtagggcattgaaaaaaaaattatattgacacaactgtgtatccctagggaaggctgtaagcgaaaaaatgtaagcataatatgtatatatatttttcttttgagacagagtctcactctgcggcacaggctgaagtgcagtggcaccctctcggctcattgcaacctccacttcccgggttcaagctattctcatgcctcagcctcccaagtagctgggattacaggcatgtaccaccatgctcagctattttttttgtattttcataagccatgggggttcactatgttggtcaggctagttttgaactcctatcctcaagtgatccgcccattttagcctcccaaactcctgggattacagatgtgaaccactgtgcctgccctaagcataatattttaaattttcttattgaccgttgaccatattccaaaattgtggagacagtgtttataagttttctacttaaaatcgaaggtgagctagttgttttagcatggtattttccgttaacttgtgatatgctattgttcatgtgtaaaatggagtgaaagagcaaaagagctgttacataggatgatggaactgggaagatgggcaaattttaaacttttcttgaatcagttttttccagtggtcttattactttgactgcaaattaccagtatatcagccacacccatgactgaatggtggggcgtggggtcatatattgccttgttcagtttcacagcttttctccattaacatttgtaattgagaggtaataatgaatgtattttggagaatgattaccgatattattggcctctgtttgatttaatactctttgaagatagcctaattgaaatgctaataagtgggcctagtataacttatgtaatgcataaaatgtatattatcttgccgtgctctactgttgaaaaatgtgtatgctttttcattaaatttactatttaaaaagtaatgctatttatattattgaacaattgttttatttccttcagtgattttacagatgtttcttgattcttacttttaaatcaaagtaaattgaggcagtttaagaagaacggagctcacaagtatacgtttgttatacatagttggaatatttaagtgaaagaaaaatacttaccaatatgttatgagtgcaattttgtagaatttgaggaatcttaagtatttttgttcctgtgaatatgactattatttaaaagatttaatacttcttagatttttatttgttagagttaacatctgtattgtttggttagcctataaacaagaaataggcattgtaatgtgaattcacaggtttttgtgaagtctgtttatgtactgtccctatgtttcagtgtatttgcatctgagagtgcttggattgcagttacagaattgagcgtagcatacaattgtacacatttttgttctttgccatcttgctcagtgttattaaaattcttatccgcatgtagttatcaagactgttaggtgaaatagtaatgtggaacagcatacctacaggatagcttatccattgattgtgtgttaattgtaaagtatatatttacaaagtagagatttcactgttaacaccgaagttatcaaacttggtgtcaataacaggaccacctggccttatgttctcatggtgtgatgtaatataacctatagtgaatcccctaaactgtttaacctcaatctaatcagaccattaggtttaaattttagcttacagaaaatatacaggccgggcaccatggctcacgcctggaatcccagcactttgggagatcgagacaggcggagagcttgaggtcaggaatccaagaccagcctggccaacatggcaaaaccccatatctgctaaaaatacaaaaattagccagatgtggtggcacatgtctgtagtcccagctacttgggaggctgaggcaggagaaccacttgaaaccaggaggcagaggttggagtgagccaagattgcgccactgcactccagcctgggccacagagcgagactccatctcaaaaaaaaaaaaaaaaaaaaaagaacgaaaatatacaatacagtaactagaagagcaaatcaacctatgtcactggaaaataattaaatcaaggatatggaacattctgtaaggcagctggcccacttaaagtcatgggaaataagagtggtgaatatgggccaggcgtagtggctcacgcctgtaatcccagcactttgggaggccgaggagggcggatcacttgaggtcaggagttcgagaccagcctagccaacatggcaaaaccccgtctctactaaaaatacaaaaattagctgggcatggtggcgggcgcctgtaatcccagctattagggaggctgaggcaggagaattgctttaaccctggaggtggaagttgcagtgagctgagattgcgcccttgcatagaatagtgaaactaaggaaacatcatgttgtaatcggtgaacttttttggatccttattgaataaaaatgcctatgaaagacattttgggggcagtggtgaaatttgaattcagacttggtattagatgatacaagggaattgtttatttttccttggtgtgttaattgtattgaagttacattagagaaaattcttttaagagatgccaaggcacatggggtgaagtattctatttataatttactttgaaaagatttcaaccaaaataaaattactttgagtaggtagtgtctgttttggtcagtctgcacaaaagcaagtgtgatggctcacccaggaatttacttaaatgtcaagacagatgacacaatgcactcatcaatcaatatgaattaagtcgattctgtaattgtagaactcacagcaaactggggattcccagggaagggctcgtttggtgaacaagagagcaagcaggaatgggaggactggtaaggatggcagggggattgaactttaattgtgattatggggtcagagatggaaccatcctctttattaaactatctatagacagatgtagcaaatatgatgaaacgttaacagttgttaaatctaggtggtgtgtatgtaaggtgttcattatttttgttctgtgtgtgtgtttgaaaattttcataatagaaaatgtttacaggtaaaattaaagtttagaataatgtgattatttctattttagcaaccaaaggacacaatgagattagatgaaacgatgctggtcaaacagttgctgccagaaatctgccattttcttcacacctgtcgtgaaggaaaccagcatgcagctgaacttcggaattctgcctctggggttttattttctctcagctgcaacaacttcaatgcagtctttagtcgcatttctaccaggttagtgtgtaaatccacatgggactactgaagtaatatgaatattagaagttttgttttttgtctacataaaaataaaaagttaatggaaatgaggtttttttgtttttgagacaagttcttttgcccctcacagcagctttgacctcccaggcttaggtgatcctcctacctcagcctccagagaaatgagtttgtctgggcttgcgtagaaattttatgcattaatatctttgacattttaattgcgtaatattgtgatattgatatgtgcaattaaataagagcactgttatgaatgtgaaagtctaaatttcagataaaaatatctgccgtgagcaggctttaaaaaacaatactaggtatgaacttttggtttggctttttaaacatattatccctttaaatgaaactacccaattagatggaataattaatgagagtagtcagaattcaaatactttcacaactctaccctttatcacaagattttaggttaccaaaaaacaaaacaaaaacaaaaacaaaaaaacctaagtgatgtgaaaacacaaggaggtgaataattgcaaagtagaattctccagaaagtggactacattttaaatgtatgtaaaatactgccatttattgagtatttatagcatttcctttgctgtctcatcctcacagtaaccttgatgatacttccctcattttacaggtgagcaaactaatactcaaaaaagttcaggtgatgtgccaaataatggaggacccaaaatttctaagtcaggctggcttcagaatttatattagtttcactataccagattgcttccctatctattttagccacattttgatgaaatctgttttataaaatatacttctgtttttaaagatgtatcaaaaatataatttaagcttttattgatgactcaaaatcatcctgagcattagttgtgatatgctacctacaggtggagaaattagtataggtagtgctctatgggatagaattataagtgacagtagcaagtagctgcaaattgttgttatgcacatgatttgcctttctaaggcaagtaaagtcagatgggttattaacttaattagaaactatagcacaaattatttagtgattcgtgaatcgaagactaataccgaatagagaaaaacaatcctctttgttggtgcctgcatctttggctcgtcagtgttgtacgaacagtggactttgattattcagatttactgattcctttgttgttttccagcaggtgtgaaagacaacatacatcaccatttgagaatttgtgttacggttttttgggggaattgattaacttcagagtcctgcaatctttttaatcaacaatgacatttctataattaagatcctaggcagcaatatttttcaacctcaatgcaattcttgatccaaagaaaattaaagttttatttaatggtatattattgataatcttgggtaatatttacatgatagaaaaatgttttcatgaaatcttttgagcagtaacgttttatattatgaataataatacagtggttgagtcagcaaggtaacaaacacctagagagtaggagggtggaaaattgtatttaataaaaaacgcaaacccttttcatttaggtgactgctaggccggccttactatttgaaacacctgttaaattaaaggtagaaagtggtacaaaaaaacccaaatgtcttgtagtctatcaatgcatgaactgccttatagaacacaacaaatgtgccaccttggaaaattctagaaaatttctagtcaccaaaggttttactttatgggattttgcagcattagcacatgtaaaaataagcaacttttgtttatttcctgaatctagttcactgttgccagaatagaaaccaagtgtctaaaattttattagctttcagaggacagaccactcagaaatggcatctgtgaaataacattgtttcagacaactgcattttcagttccatttagcttgtgtcagaaataggagctgatcttactgaaggatcactcacctaaaagaccattatgatggtttagtttaggttggaacatcttatgctgtcatcgtcatagtattaggtgacttaaaatatgtgtgtggcttgaatggtagttctttctaaagattgatcttatgttttatatataatagatgaatcagtatcatgaagatgtttcgtgtttgtccattctccccgtcaatgtttctcctttaagattaagatttggtttttatatttctgacctttacttttctttaggggaagataggctatagatttatttattttatgtttttgagacacagtctctctctgtcacctagtctggagtgcagtgatgtgaacatgtctcactgcagcctcgacctcctgggctcaagagatcctcccacctcagcctcttgagtagctgggactacaggcacgtgccaccatgcccggctagtttctttaatttttttgtagagacggggtcttgccatgttgcccaggcttgtcttgaacccctgggctcaagggatcctcctgccttggcctcccaaagtgttgggattacaggatgtgagctaccatgcctggctggctataaatcttaagatagctttatttttctctgggagtataccattttctgtggcttatagtatttatgtagcggagtaactgctttctccacagaattactccacaaatgcagttgatctagttgttttgtagtgagaaggtgcttcagaatatctcatttgatataccaccagaagcagaaaactcaatgactttaaaagtcatttggttctttacagtttactatttggttccatacaaatctgttcgttatggtttcttactctttttttaaaaatagttttcagtttttttatatgtctctgatcatttaaaacgtattttacgttctctttagtattgtttaatattgatttgtttgtgctgattcattcatagtgaattgtttcatctcagttttggaatccttgattgcaaagttatctttagtgtggcctgtattttctttgagaatccttgtagccttgggctgagggagtgttctagtgatggttttgcatttgcatttgccaggtgcccagttctggagctatttttttcttaatttctcagtcccagcctgtatgggcagtataaatttgaaccctaaactcttagaaggtaaacagctctaggtgacttttttcactttatccaaagtttaggcagagcagttaagcttctttgtgctggtaggtttttttctttttttctttttgtggggagtgggggcggcagggggagtgcattgttctttctagttcatgttttatgcagggcccaagttagaatcctgaattattagggtacaaggcgtttatatccagtctccatgtggatgttaagccccaagctcctaggttaaggagatcaaaaacctcactcatctttcctttgttgcagggctgggtcatgtacttgtgcacttaactctctggttttcagttttcttcttcttttctggacctatacatttaaaatatctttcagtatgcctagactttctagctgttttagtgataggttttctactgttcatttcttttgctcagactacgctttatttgatttctctgcttcggaaatgatgtttaaccttcacaaaatacctgctctctataagggtaccagactataaaagggacaaaatttttctcccatttttcacaaacaaccacaagagtcaacttttcagaagttggtattgctgatctatgatgttgtgttttctgaggagccgtactccatatttctacgctctttgcagcagctgtggaatttttagcattgaggacaacctcattcccagcttgaaatgctgagcttttcttaccctgatgataggaagagagttcatgtaagtgcttagaatagttgtactgttagctgtagtctaattaaagctaaagtgagtgaaacgagaatttgagaaggaagaataggattgattacattcttatcaactgaaggtttagtgtgatgattaataactcctttgcaaattgcactaaatgattgaaattcaagttaatacatataaattataagaccatatagtatttgtgccttttcaccatatctctattgctgcatttataaaagtttacaatttaattgtgctgcttatattttttatgtctattaatatgaataatgagtatgcctcattaggtagcatgatttaatagattagcaataccaacttttgaaaatctgagtgctgtggttgttggtgtaaaatggaagaaaagtttaatgccttttattaacatttaggctaagtgaatttcttttatcagtttaaaaatatctacatatttgttaagtgttaaatgtttctacgtttgtgataacttcatattcaacataggagaagctggggtttaaacagatattcctgtccttataagcttatgttctgtgaagtagggatattaagcaaataattacataaatacatgtacaaactgtgaaaagtgcaatgaaaaaaggcttactcggttttcaaatacaaagtaaatgtaccctgtgaatataaagtttcattcgtgtttcaaaaatctagttgataaaagtagaagttagtaaaatcaagtttacttattatagttttagtcttaattcaaattatacttttacttgtaattggaaatatgaatttttaaaactattcattgtggaaaaatggaaaaatacacatagaatagtacttcaaatccccatgcatctcttactctgctttaactgtttctggcatgctatggtttctcttcttcccttttcagtaatttaaagcaaaccccagacatcatttcacctgtaaatatttcagtatatatctctaataaatagatttttaagcatttaactataatattgtcatacctatcaagaatcataattccttaatatcatgcattgccaaatttgtgggttttttcattatctcagaaatggcttttttgttttgttcaaattaagatacaaataggatgcgtactttggaattggttgatatttctcctgagcctctgttaatcagtatcatttcttcatttcttcaccttgctctccattttttcccatgctgtttatttgttggactgcgttatttgcctttctacattctgtatttgggtttcattggattcacgttcatttggctggggggggacaagaatactttactgatgatgctatgtggttcctaatgaatcacatcaggaaacatgtcctattattgacttttaatgttatgatcagtgattggatttcgatgttatcagcattatgtattcattatacagtttcccataaatttttcctaatgtttttagtaatcactgatgatcactgcctggattccacttcattgggggctgcaaaatgaaacgttttctattctgtcattcattctttattttaaaattgtgacttctatgaaagatttttgcttcattgtgtgtttagttatcttgcaatacagtccatgtagggaatgcaggatacagacttgacttccattattcgttatcagaatgagttggtaccctaacagttgcgaaaggttacccatgaagttttttctttcaatattataacaggcttgtgtgttttaatttattgtatgtgtttccattgtagacataattcttttgatcctcagattatcccatttttgacagttgagatgcctaaagtgcatacctgtgtgatatttgacatggttctgatagttgttgatagtttcctgttttcaagcccaaggtgacctgccctcaccttgtatatctcttgcccccatcctggaattaactaattttcccaaagaaccctggccgaaagtcggcaatatttagacacctcaatcttaaggataaggatgctacgatgctacgtttactgaattatcatggtttcttttatcatatcccttgtttgttatgttcctttaggtttttataagaaatatttattgccttatttttatatatgtctttactcttatgaactcatctttgggggaagaatctgttgaattcagaatttagggatacccgaagactttttttgtttttgttttttttaagagatagggcccactctgttactcaggctgaagtacagtggtgtgatcacagctcattgcagcttcaaacttctaggctcaagagatcctcctcccttagcctcctgagtagctgggcctataggtgtgtgccatcatgcccagctaatttttgtattttttttagagatgatgtcttgctatgttgcccaggctggtcttgaactcctggcctcaagtggtcctcctgccttggcctcctgaagtgctgggattacaggtgtgagataccacacctgtcccctaatacttaatttgataagttaattttggtttttactttttaggttacaggaattaactgtttgttcagaagacaatgttgatgttcatgatatagaattgttacagtatatcaatgtggattgtgcaaaattaaaacgactcctgaagggtaagtttaaatgtataatatatctgaaaaaaatcactgggtcaaaaactagtatcatgaatgtactaattatattaattgtgctgaactagaacaccaaactggattttataatgacatttccttgtgaaataaccagtaatacaaatgggtaattatttttcaatctttgaaaataatgcagtagagaaaatgagcattttaaatcttggcaatggaaagttttgcttaactacaatttttgttttcaatacagagaatgcaagggtgctattatttcatttttctggaatttgatctctcaagggtggctataggttatagaagctatctgtttagctattgtagcactttacaaagattgtctgtagtaggatatcaaagttttattgcagaatggaacgaggagattgtgatgttatggtgagaggatgaattgagccagagatttcatttctgacatttctgttttcagctctctactgactgactttatagcattacaaagtcccttaaccttccattgccggttttgtctccttgtagaacatgtcagtagtagttccacatggggatattataacacctaatatgtgactttaaagcttgggaagtactttacatgattatgtggattgaaataaacgatcagaaggaattgagatatgttctgtagtaagcagtgatgtgttaatgtaaatcagataccaatgagtattcataaactgagtatgatctgaaggaattgagataaattctgtggtaagcagtgatgtattcatgtaaatcagatatcaatgaatattcataaactgagtatgaatatctaaatttcattttacaaaaaaatgttttttagtttttggcattattagaccctggctaatttagatatgaaaccgtatacagttcacacatatttttatttgtaacttaaggaattgtcaaacaataatatttttaatatctgacctaaaacagattgaattatattagcttcagaaacatcagttctgcaatgtagttttcaaaatacgtgtttttgttttcttaatatttcctttaaactcaataactatctcaccagagatgtaaaaaggcaatacctatataaaggaataatataaagctgtgttctattcatattacccttgttcataatttatgattttaggtcattaccattgtgaaaccaagcaacaattaattcagtaactttaataaaggaaaatataggggtgattttagctgttatgccaagatacaaacatgtggacagcaattattttagattataataaaccaccattgaattaatagttgagatttgcaagattttgatatctattattaagcgttgagcagttgagaaactgaatggtaaaatttagagatctctatgaattaaagttaagaagtattagtgggattttatgatttttcataactattcagtgatgttttggaaacaagtctagtccaggttgcctgtgaatagctgtttaaaacaatagaaatgttcaatccgtaataattaactgaaatgtctcttctgtccaaataagagaaactaattgaatgtgtggataaatgactttcttttatactgaagtaactttcccatcgaatgcggctccctcatgaacataaatttagagtatatgctgataaatatataaagtataaaaccgatattaaataggccagcaaaatatggctcttggtgacagtggtaaaaggaatgcaccctttcagtaatgagtagtaaaggtagtaatgtgttttaaatacaactcaacaagcctttgttgagaaactatgtataagaagccatgctaagtgctgggattacaaaaattaataaaatatggaatctgtccctaaggagctcatggcatggtttatgagacaagtgatgtcattatcaagttatttgcagaaaaaaactatgataaactcaaatagggtgagtgtaaagtgagagaggaagtatatatttgtttgaggggatgagagatgagcaagatgtgaaggtacaagaataggtcagatcattttaataaaaatatggccaggcctggtggctcacacatgtaatccccacactttggggaagccgaggcaggaggattgcttgagccagggcaacatagagagacccccatatatacaaaaaaaaattagctgggtgtgctgacacgcacctgtagtcccagctacttgggaggctgaggtgggaggatcacttgagcccaggaagaggttgaggttgcagtaagctgtgattgtgccactgcattccagcctgggtaacagagtgagatcctgtctctgtctgtctctctgtctctctgtctctctctctctctctctctttctctctttctctcgatatacctatctgtatatagatatatcaatcgatatgtgtatatccagatctgtctatagatatatctgtatcttgatagatatatcgagagagagagagaaacatttgttatattttcagtctgcaccgggccttgcgctatgcagtttgcatgccttttctcatcaattcttacaataaccctgtgacgcaatactagtattaatattatcatctcttgtgtagatgaggaaactgaggcctcagtaaattttcaaagtcacagagctagtaattgttcagtaaagattgagttcacatctgctcgtctctagaacctagatacttgactgctgcactgttgtgcttatgagttacgaagctttattttagtggccctgggaagtgatagaaaggctttgaggtagagaataccttaatcagtattttattttagatatacccctttgcttgaaatttgcaggatggcttggtagagggttacctgaacttctgggacttggttatgcagtaatataagtgaaaaataatgagagttgtggagatccagatgatggattggggtagggtaaggatggggaccagtttgataggtatttaaagaagtggaggctgggcgcagtggctcacacctgtaatcccagcactttgttaggctaaggtgggcggatcactgaggttaggagttcgagaccagcctggccaacatggggaaactccgtctccattaaaaatacaaaaaatgggctgggcgcggtggctcacgcctgtaatcccagcactttgggaggctgaggcaggtggatcacgaggtcaggagaccatcctggctaacacggtgaaacactgtctctactagaaatacaaaaaattagccagtcgtagtggtgggcgcctgtagtcccagcttcttgggaggctgaggcaggagaatggcatgaacccgggaggcagagcttgcagtgagccgagattgtgccactgcactccagcctgggcaacagagtgatactccgtctctaaataaataaataaaataaaataaaaatacaaaaaattagccgggtgtggtggcacgtgcccataatcccagctactcgggtggccgaggcacagcagaatcgcttgagcctgggagatggaggttgtagtgagccgagatcacgccattgcactccagcttggacaacaagaccgaaactccatctaaaaaaaaaaaaaaagaaatggaatacatagcatttgatagtcaatttagatatatgaggttagagagatatcaccaaatattacagaataagctggttagagcagaaaagggaaggaaaggttgatggcagaagagagggtttgaccaggaaaatgataaattcagttttagatcttctgagtttgaggtatcagtaggatgtccaacaagaaacttgtagaactgaaagatactttggctttgagagtagattatggtatataacacatttaagatgtcataaaggtaaagttgttgctaaagagcactgtgaagagtaatgtcattatttggaaatcagtggagggtgagagcaaagagaattcaaaggggtacttttaaaaactgatttggagagttacttatttgcaagtccagaaaaaagactcatctctctcttagacacttacatagatgtaataaaaacctttatcccttcattaaaagtcaacaggagaagttctttgccgagggaccattgccagtaaaatcgcttatagacaggtcattttttccaaacataaatctttttctagatgtggacaataaacttaaagaagaagaaattaaaatacccaatatatttatatggagaaatgtttactgttacttgcgttaaaatgcagtctactattttgaacactccaattagcaaaataaagaaaatgaacatacttttatgatgacaaagataggatgaaggcactttcgtatgctgcttggtgatagcagcatttggcccaaccctagtgaaaggcagcttggtaatctttatcaagggccctaaaaatattcatctctttgactggacacttctagagattccttatcttaaataagcagtgatgtgggaaaagatgttgatatgaaaatatttgttaatgttatttataatagtgaaataacagaaataacctcagtgttaaaactggaaaacattaaataaccagtcacttaatacagtgacttaaatattatgaggggcatcaaagcatactgaaaagaccttggttttaaagcccaattcaatcatttattagatctgtaaccttagacacacagtttgttcatctgtaatactctgaaaacattaagattcaaaaagaattaagtgtatcatactaaaaatacatgatatgttttaatagtttgtgtaatagttactattgcatatagagccatcaaaaataggccaggcacagtggctcacacctgtaatcccagcactttgggaggcctacgtgggcggatcatgaggtcaggagttcgagaccagcctgacgaacatggtgaaaccccatctctactaaaaatacaaaaattagctgggtgtagtggcgcacgcctgtaatcccagctactggggaggctgaagcaggagaatcgcttgaacctgggagacggaggttgcgtgagccaaaattgtgccattgcactccagcctgagcgacagagcaagactccatctcaaaaaaaaaaaaaaaaaaaaaaaaagagtttttactgatacagaaataattagggatactatggaaaagaacaggtttgatacagcttatatgatctcagttatgttaaatatatttgttttctacatgcataggaaaagtggtagaagtaaaaccaccagatgttaactgtgattgtctctgaatgatagaatcattgatggttttaaaaatttcccataaacacctgtgcttttgctttttttttttttttttttttttggacagagtcttgctctgtcgctcaggctggcatgcagtgacatgattatagtacactgtagccttgaaatcctgggctcaagctatcttcccactcctgctttcgaaagtgctgagattataggcgtgagccatcgggcctggccctgtatatgttttccaaattttttaattatactttaagttctggggtacatgtgtagaacatgcaggtttgttacataggtgtccatgtgccatggtggtttgctgcacccatcaacgcatcatctaccttaggtatttttcctaatgctatcccttacctcagcccccaccccccgacaggcaccgatgcgtgatggtcctctccctgtgtacatgtgttcttatggttcatctcccacttatgagtgagaacatgtggtgtttggttttctgttcttgtgtttgctgaaaatgatggtttccagcttcatccatgtccctgcaaaggacgggaacttatccttttctatgtcagcatagtattctgtggtgtatatgtgccacattttctttatccagtctatcattgatgggcatttggattggttccaagtctttgctgttgtgaacagtgctgcagtaaacatacgtgtgcatgtgtctttatagcagaatgatttgtaatcctttgggtatatacccagtaatgggatggctgggtcaaatggtatttctagttctagatccttgaggaatcgccacactgtcttccacaatggttgaactaatttacactcccaccaacagtgtaaaagtgttcctatttctccacattctctccagcatcttttctttcctgactttttaatgatcgccattcttactggcgtgagatggtatctcattgtggttttgatttgcatttctgtaatgaccagtgataatgagcttttctttatatgtttgttgtcttcttttgagaagtgtctgttcatatccttcatctactttttaatggggttgtttgtgtttttcttgtaaatttaagttctttgtaggttctggttattagccctttgtcagatgggtagattgcaaaaattttctcccattctgtaggttgcctgttcactccgatggtagtttcttttgctatgcagaagctctttagtttaattagatcccatttgtcaattttggcatttgttgtcattgcttttggtgtttcagtcatgaagtctttccccatgcctatgtcctgaatggtattgcctaggtttctttctagggtttttatggttttaggtcttatgtttaagtctttaatctatcttgagttaattattgtataaggtgtaaggaaagggtccagtttcagttttctgcatatggctagccagttttgccagtaccatttattaaatagggaatcctttccccattgcttgtttttgtcaggtttgtcaaagatcagatggttgtagatgtgtggtgttatttctgaggcctctgttctgttccattggtctatgtatctgttttggtaccagtaccatgctgttttggttactgtagccttgtatagtttgaagtcaggtagtgtgattcctccagctttgttctttttgcttaggattgtcgtggttatgcgggctcttttctggtttcatatgaaatttaaagtagttttttctaattctgtgaagaaagtcagtggtagtttgatggggatagcattgaatctataaattgctttgggcagtacggccattttcacgatattgattcttcctatcgatgagcatggaatgtttttccgtttgtttgtgtcctctctggctggcatctggcaggtgcccctctgggacaaagcttccagaggtaggaacacgcagcaatctttgttgttccgcagcctctgctggtgatactctggcaaacagggtctggagtggacctccagcaaactccagcagacctgcagcagagggttctgcctgttagaaggaaaactaagaaaggaatagtatcatcatcaacatcaaagaccaaaggtagataaatccacaaaaatgggaagaaaccagtgcaaaaaggctgaaaaaaaaacgagcacgcctcttctcctccaaaggatcacaactccttaccagcaaaggaacgaaactggacaaagaatgagtttgacaaattgacagaagtaggcttcagaagatgggtaataacaaactcctccaagctaaaagagcatgttctaacccaatgcaaggaagctaagaacctggaaaaaaggttagacgaattgctgactagaataaccatcttagagaagaacataaatgacctgatggagctgaaaaatacagcatgagaacttcgtgaagcatacacaagtatcaatagccaaatcaatcaagcagaagaaaggatatcagagattgaagatcaactcaatgaaataaagcgagaagacaagattagagaaaaaagagtgaaaagaaatgaacaaagcctccaagaaatatgggactatgtgaaaagaccaaatctacatttggttagtgtacctgaaagtgatggggaggatggaaaaagttggaaaacactcttcaggatattagcaggagaacttccccaacctagcaaggcaggccaacattcaaattcaggaaatacagagaacactacaaagataatcctcgagaagagcaaccccaagacatataatcgtcagattcaccaaggttgaaatgaaggaaaaaatattaagggcagccagagagaaaggtcgggttacccacaaagggaagcccatcagactgacagcagatctctaggcagaaaccctacaagccagaatagagtgggggccaatattcaacattcttaaagaaaagaattttcatcacagaatttcatatccaggcaaactaagcttcataagcgaaggagaaataaaatactttacagacaagcaaatgctgagagattttgtcaccaccaggcctgccttacaagagctcctgaaggaagcactaagcatggaaaggaacaactggtaccaaccactgcaaaaacataacaaattgtaaagaccatctatgctgtgaagaaactgcatcaactaatgggctaaataaccagctagcatcataataacaaattcacacataacactattaaccttaaatgtaaacgggctaaatgccccaattaaaagacacagactggcaaattggataaagagtcaagacccatcactgtgctgtattcaggagacccatctcacatgcaaagttacacataggctcaaaataaagggttggaggaagatttaccaagcaaatggaaagcaaaaaaaagtagggttgcaatcctagtctctgataaaacagactttaaaccaacaaaaaagatcaaaagagtcaaagaagggtattacataatggtaaagagatcagtgcaacaacaagagctaactaccctaaatatatatgcacccaatacaggaacacccagattcataaagcaagtccttagagacctacaaagagacttagactcccacacaataataatgggagactttaacaccccactgtcaacattagacagatcaacgagacagaaagttaacaaggatatccaggagttgaactcagccctgcaccaagtggacctaatagacatctgcagaactctccaccccaaatcaacagaatgtatattcttctcagcaccacattgcacttattccaaaattgaccacataattggaatacaacactcctcagcaaatgccaaagaatggaaatcataacaaagactctcagaccacagtgcaatcaaactagaactcaggattaaggaactcactctaaaccacacaactacatggaaactgaacaacctgctcctgaatgactactgggaagataacaaaatgaaggcagaaataaagatgttctttgaaaccaatgagaaaaatacacaacgtaccaaaacctctgggatacatttatagcagtgtgtagagggaaatttatagcactaaatgcccacaagataaagcaggaaagatctaaaattgacaccctaacatcacaattaaaagaactagagaagcaagagcaaacaaattcaaaagctagcagaggacaagaaataactaagatcagagcagaactgaaggagatagagacacgaaaaacctttcaaaaaatcaatgagtctcctgacctcgtgatccgccgccttggcctcagtgaaaccccatctctactaaaaatacaaaaaaattagccgggcatggtggcaggcacctgtagtcccagctactcgggagcctgaggcaggagaatggcgtgcacccgggaggcagagcttgcagtgagccaggatcgtgcaactgcactccaacctgggcgacagagcaagactctgtttaaaaaaaaaaaaaaatcaatgaatccaggagctggttttttgaaaagatcaacaaaataaatagaccactagccagactcataaagaagaaagagaggagaatcaaatagacgcaataaaaaatgataaaagggatatcaccaccgatcccacagaaatacaaactaccatcagagaatactataaacacctctgtgcaaataaactagaaaatctagcagtaatggataaattcctggacacatacaccctcccaagactaaaccaggaagaagtcgaatccctgaatagaccaataacaagttctgaaattgaggcaataattaatagcctaccaaccaaaaaaagtccaggaccagatggattcacagccagattcagctagaggaggagctggtaccattccttctgaaactatttcaaacaatagaaaaagagtgaatcctccctaactcattttatgaggccagcatcatggtcataccaaaacctggcagagacacaacaacaagagaaaattttaggctgatatccctgatgaacatcgatgcaaaaatcctcaataaaataatggcaaactgaatccaacaagcacatcaaaaagcttgtccaccatgatcaagttggcttcatccctgggatgcaaggctggtttcaacatatgcaaatcaatgaaagtaatccatcacgtaaacagaaccaatgacaaaaaccacatgattatctcaatagatacagaaaaggcctttgatgaaattcaacagcccttcatgccaaagactctgaataaactagggattgatcaaacatatctcaaaataataagagctatttatgacaaacccacagccaatatcatactgaatgggcaaaaactggaaggattccctttgaaaactggcacaagacaaggatgccctctctcaccactcctattcaaactaatattggaagttctggccagggcaatcaggcaagagaaagaaataaagggtattcggttaggaaaagagaaagtcaaattgcctctgtttgcagatgacatggttgtatgtttagaaaaccccatcgtctcagcccaaaatctccttaagctgataagcaacttcagcaaagtctcaggatacaaaatcaatgtgcaaaaatcacaagcattcctatacaccaataacagacaaacagagagccaaatcatgagtgaactcccattcacaactgctacaaagagaataaaatacctaggaatccaacttacaagggatgtgaaggacctcttcaaggagaactacaaaccactgctctaggaaataagagaggacacaaatggaaaacaattccatgctcatggataggaggaaccaatatcctgtatgtgttttatacttttttttgaaaaagcaagttattaaaagaaaaagctcacaatcattgatgtccaaggcatatttgctgtttatggaatttttctttcctagcagacaactatcgagttttgggtttatgttaggtgtctttacctttcattgcttacagataatattggagcaaaagtaatacgtaaatggaaagttattttgctctgagttgtatttgtgttaacttattctagagttaatttttaaaaattgtgttttttccagaaacagcatttaaatttaaagccctaaagaaggttgcgcagttagcagttataaatagcctggaaaaggtaagttacaacctctctggtattaaaattttgtttttgatgtaaaatttgctgttgttagcatcctgaatcaaaaagttatgacttgagtgatagtttcacattcattttcaggaagaatacattgtaatattattatgaaggaagttagaagtttgtgacattttatttactgtattacaaaaaatcactgtaaagacatgtggttctttatttataggcattttggaactgggtagaaaattatccagatgaatttacaaaactgtaccagatcccacagactgatatggctggtaaggatacgattgattttttttttttttttgtcttttaaatgcctacttgtgacataaaaacctatcatcgttttccaagttatttttgttataaaggtgcttttacatcttctattgtcaactggtgtcaaataggaaatactgtttttctcttacatttctaaattaggcccaaccctcttcctttccttggagcaaacaaagtagtttgaaatgaaggtcagatctttagagctgtgataggatggggtgtttggctctttgttgtagagaagcatgtgctctgaagctttattttgtatttagggagatgtgtataaagtagtaatattctcacctataatgtaagacacaactgcaaggcagagaatacagactcctggagaactttggtaattctttttgggaagctgttcagtctttgttgcttgggtacatcacactttgcataaggcccttcacagtgagactgaatacatgatcatccattctaaaatgtgagcttttccaggatagatcaagatagctcttctaacacatagacagtattacattgcttgtctacttaccagaatgcatttgtgtagttgcttaaatgaagttccatgtttatcttttaaaaatgttgcccttgggtttttacatagtgtcagcttttactttaatgccagggattttgttcctatctaataatgtcatttaatatatttttcatgcagaatgtgcagaaaagctatttgacttggtggatggttttgctgaaagcaccaaacgtaaagcagcagtttggccactacaaatcattctccttatcttgtgtccagaaataatccaggatatatccaaagacgtggttgatgaaaacaacatgaataaggtaaggagggcaaaattatttccattatatctagatgtgaagcagtttattttactcaaggtgtgtattactttaggcttattatttaagcaaagtatttcagggaaccatttaaatgatcattttaggtttctttgtttgatggacttagaagagacatactcatacataattttatttggcagagggaaaataataccaggcaatgaacaaagatttaaaataatcccttagtttcattcttttgtctgagaagactaaacgatacctctgttattattaaacgtagtttctctaatattcactacaaggattgccctacttgagttcatcacttttatagtgtgttatttgcatgtacttagggtatgtgtccatatagtgctactgaaattatctagtaactcattttaagtattttagaacagttttcaaagaattttgccaggaaggtaaggctctcgcatataccatctatagtgaaattggcaccatgacaactggtaattctaggaggctcttaaaatttttttaaatatcacctaggtgattgaaaaaaaaaagaactgagtattaatcctagggttttactgaaatttcaatatgcagtttgttttgcaaatattttttttttcattttttgctgcttttggagaaatactcttagctggctgaacatgagatggtttccttcatggtttgcctgtagatggagatgttcagaatcagctgaatgatttattactttgtagaagtattggaccgggaatttatacattaaagggtaaataaatgaaccaggtaatccttgagagtctgtgattgcgtgttactccacttaggtgtatatctcaacttttccattatgaggacaccatttttcatggtagattgttttggagcccttcaaaatagtaggtttgatgataaatactgagtgtcaacttgattggattgaaggatacaaagtattgatcctgggtgtatctgtgaagttgttgccaaaggagattaacatttgagtcagtgggctgggaaaggcagacccacccttaatctgggtggtgcaccatctaatcagctgccagcatggctggagtataagcaggcagaaaaatgtgaaaagagagacgggcctagcctcccagcctacatctttctcctgtgttggatgcttcctgccctcgaacatcagactccaagttctttagttttggaacttggactggctcttcttgcctcttagcctgcagacggcctattgtgggaccttgtgatcgtgctagttaatagttaatatcccctttatataaatattctattacttctgtccctctagagaaccctaatagagattttggtacaaggagtgtggttctagaggaacggagtattaaggatggagtttcttagtttgtttgggggtttctggagtttgctgcttaatatgattagaccctaaaatattaaggactctacttctaatattgtggagaacactgatagtcgttgctgtgaactgtttagagagtttgcaaaataaatgcatttgacactcctgattcaccgctaatgagaggcaaggagtttagtgaccctatacataataatacctttgaccatatatggagaaccaaggaacataatgaagctggttggttgctcctaaattcagtggacaaagtggtgaaagaaaatgatgggccgggcgcggtggctcacgcctgtaatcccagcactttgggaggccgaggcgggcggatcacgaggtcaggagatcgagaccatcctggctaacacggtgaaaccctgtctctactaaaaatacaaaaaattagccgggcgaggtggcgggcgcctgtagtcccagctactccggaggctgaggcaggagaatggcgtgaaccccagggggcggagcctgcagtgagccgagattgcgccactgcactccagcctgggcgacagcgagactccgtctcaaaaaaaaaaaataaaaaaaaaaaataaaaaaataaaatagaaaatgatgagctcagggattctgtctcctgtcttcagaagcagatactgagcctcaaatctgctaagattgacctgagtgagacccttatctcctgtagaaaaagagctgaaattgtgaaaaaacaaacacaaactcttatcatgcaagtggctgacctgcaacaaaaggtgcatgtacagcctaaccaggtgtctactgttaaagtgtgggcattgattggaaaagaatgggaccctgcaacttggaaagggcatgtgtgggaggaccctgatgaagctggggactctgagtttgtaaactctgatgaaccttttttgccagaagaaacagcttccccatccccagtagtggcaacatcccctccctgagccatgctgccatcagcctttccacttttgtctgaagagataaaccctgcgctgcctgaggcaacaggaatggcctcccctgaggcagttgccaggcaagataatgttgattctcctcagaagccacccccaacacccctgtttgcttctagacctataaccagactaaagtcctagcaggtccctagaggtgaggctgagagtgtgacccatgaggaggtgcgctacactcgtaaagaactgcttgagttttctaatttatataaacaaatcttacttggagagaccttggtcatgtttcacttccacaacatatgacactggtctattacattaatgatattatgctgattggattctgtgagcaagaagtagcaaacgcactggacttattggtgagacgtttgggtgccagaggatgggaaataaatccgagtaaaacttagggaccttctacctcagtaaaatttctagggcttcaggggtgtggggcctgtcaagatattctttctaaggtgaagaatattgctgcatttggcccctcctacaaaaaagaaagaggcacaatgcctagtgggcctacttggattttggaggcaccattcctcatttaggtgtgttactctggcccatttatccagtgacccaaagaactgccagttttgagtggggtccagaacaggagaaggctctgcaacaggtccaggctgctgtgcaagctgctctgccacttgggccatatgacccaacagatccaatggtgcttgaagtgtcagtggcagataaggatgctgtttcgagcctttggcaggcccccataggtaaatcacagcggaggcctctaggattttggagcaaggccctgccatcttctgcagataactactctccttttgagatacagctcttgacctgttactgggctttggtggaaacggaatgtttaactgtgggtcttcaagtcaccttgtgacctgaactgcctatctatgaactgggtgtgttctgacccatctagccgtaaagtgggtcgtgcacagcagcattccatcatcaagtggaagtggtacatacacgatcgggctcaagcaggtcctgaaggcacaagtaagttacatgaggaagtggctcaaatgcccatggtctccactcatgccaccgtaccttctctctccccacctatactgatagcctcatagggagttccctatgatcagttggcagaggaagagaagactagggcctggttcgcagatggttctgcacaatatgcaggcaccacctgaaagtggacagctgcagcactacagcccctttctaggacatccctgaagcatagtggtgaaggggaatcttcccagtgggcagaactttgagcagtgcacgtggttgtgtactttgcgtggaaggagaaatggccagatgtgcgattatatactgattcatgggctggagccagtggtttggctggatggtcagggacttggaagaagcatgattggaaaattggtgacaaagagatttgaggaagaggtatgtggatagacctctctgagtggttaaaaactgtgatgtttgtatctcatgtgagtgctcaccaacaggtgacctcagcagagaaggattttaataatcaagtggatagcgtgacctgttctgtggatgccacttagcctctttccccagctacccctctcctcgcccaatgggcccatgaacaaagtggccatggtggcagggatggaagttatgcatgggcttagcaacgtggacttcactcaccaaggctgacttggctatggccactgctgagtgtccaatttgccagcagcagagaccaacactgagcccttgatatgacatcattcctcagggtgatcagccagctaccttgttgattatattggacctcttccatcacggaaagggcagagatttgtcctcactggaatagacacttactcctgatatgggtttgcctatcctgtatgcaatgcttctgccaagattaccatgcatgggctcaccaaaggccttacccaccatcatggtattccacacagcattgcctctgaccaaggcactcactttacagctaaagaagtgtgccagtgggctcatgctcatggaattcactgtttttgtttgtttgttttttgagatggagtgttgctctgttgccaggctggagtgcagtggcgcgatctcggctcactgcaacctctgcctcccaggttcaagcgattctcctgcctcagccttccgagtacctgggactataggtgtgcgccaccacgcccagctaatttttgtatttttagtagtgatggggtttcaccatgttggccaggatggtctcaatctcttgaccttgtatctgcccccctcggcctcccaaagtctaggattacaggcatgagccaatgtgcctggccacactggtcttaaccatgttcccaaccatcctgaagcagctggattggtagaacagtggaatggccttttgaagtcacaattacaatgccaactagaagacagtactttgcagggctggagcaaagttttccagaaggctgtgtatgctctgaatcagtgtccaatatatggtactgtttctcccatagccaggattcccgggtccaggaatcactcaccatcacccctagtgatccactagaaaatttttcttcccgttcttgagacattatgttctgctggcctagaggtcttagttccagagggaggaacgctgccaccaggagacacaacaacgattccattaaactggaagttaagattgccacctggacacactttgggctcctcctacctttaagtcaacaggctaagaagggagttacagtgttggctggggtgattgaccctgactatcaagatgaaatcagtctactactccatagcggaggtaaagaagagtatgcatggagatccattagggcgtcttttagtattaccatgtattgccatgccctgtgattaaggtaaatgggaaactacaacagccccatccaggcaggactacaaatgacccagacccttcaggaatgaaggtttgggtcactctaccaggaaaaaaaccaccacctgctgaggtgcttgctgaaggcaaagggaatacagaatggctagtagaagaaggtagtcatcaataccagctacgactgcatgaccagctgcagaaacaactgtaattgtcatgagtatttcctcctccttttgttaaaaacatgtttgtgcatgtatacacctgtactaagaaaatatcttcattttatttcctttttcttttatcatatgacttaagatttattgacttcacatcagcattttaagtattgttaacttttagtatttgggttgggataggtgtgtttctggttgtacgaaggataattgtattatgttaggcataattatgactttattgtctttatttaaagattatgtatgatctcaggagatatgtatgggttcaagttgacaaggggtggacttgtgatggttaatactaagtgtcaacttgattggattgaaggatacaaagtattgatcctgggtgtgcctgtgagggtgttgccaaaggagattgacatttgagtcagtgggctgggaaaggcagacccacccttaatctggctggctaccatctaatcagctgccagtgtggctagaatataagcaggcagaaaaatgtgaaaaagagagatgggcctagcctcccagcctccatcttcctcctgtgctggttgcttcctgccctccagcgtcggtcttcaagttcttcagttttggaacttggactggctctccttgctcctcaccctgcagacagcctattgtgggacctcgtgatcgtgtaagttaatgcttaataaactcccctttgtataagtatctattcccttaattctgtccctctagagaaccctgactaatacagtagggtgttttttgttgttgttgtttattggaaaaatagaaataaataaataagctatagattcagtagtactcgagtgaatttacgttttaataatcacaactgtagctttctaagtgtttactggttatttgtgtatcttcagggaattgctgatttttccattgaattgtttgtcttttgttgatttgtaagggtatatgtgtacatttttacttggtttcatttttaaactttatgagttctttttactatatagatatttaaaatttgcatgtagtcacctcagccttgttcctttttgtctcctagcttttttggtcagatctctcttcccagaagatattattcattttattgagatataattcacatatcataaaatttacgtttttgaagtgtaaaattcagcgattttagtacattaacaaagttgtacaatcatcaccattgtttctgtgcagaacattttcatcttcccaaaaagaaacccgttagtaatcactccctgttcctctcgcctcactcgcagcccttggcaaccagtaatctagttttttgtctatagatttacttaattctaaactagacatttcatacaaatggaatcattcagcatgttatgtttttgtctggcaggtgccaagatttttgaagtatgctttttaatttttttctggtattttctagatttaaaagtttagatttttaaatctttctggattaaaaagaaaagtattttttttttttttttttttgagacggtgtttcactcttgttgcccaggctggagtgcaatggcacaatctccgcttagtgcaacccccgcctctcgggttcaagcgattctcctgcctcagcctcctgagtagctggaattacaggcatgcgccaccacgcccggctaattttgtagttttagtagagatggagtttctccatgctggtcaggctggtctcgaactcctgacctcaggtgatctgcctgcctcgggcctcccaaagtgctgggattacaggcatgagccattgcgcctggctaaaaaatgtatttttaaaaatgtattacaaaaaaaaaaaaaaaaaaaagctggccatggtggcaggctcctgtgatcccagctactctggaggctgagccggggagaattgcttgaacctgggaggtggaggttgccatgagctgagatcatgccactgcactccagcctgggcgacagagcgagattccatctcaaaaaacaaaaaaacaaaaaaaataaaatagtattctcacccttttctactcacattccttctgagctggttagtgttattggctggtatgtatccttccagtcacatctatttacccatatattcaaatgcaaaatatacatacgtagggtggtggtggttgtattttaaaatgaaattattttatgcacattactctgcatcgttgtttatctaagaaaatattttagctgttcctcaaaatagttgatagagatctgacacattcctttcagtattaggtaacattctgttacactaatgagcctcatttactcagccatttcactgaatgggtggatattcagatgttttcagttttttgacacttagctaagccttaagtaaatatcttgttcatatatccttgttaactgatgctcttaattctatagactagaatctaaaaactaggggttcctgtgtcaagaacatttgcatttaaaatttgtaatagttattactagatttacattccccaatagttgcagcaggtcagagtttcatccccactgaattgcctattttcctgcatttttgtcaggattagctgttgttaaatctttaaaattttgccacactaataaggtgagatagtatctcatctcaggtattcttaccttctctttcagaggtaaactgtgtgatgtgatggatatgttattaccttgattgtggtactcattttagaatgtataagtttatcagaacatcatgttgtacaccttaaatatatacaatttttatttttcaatcgtacctcaataaagctgaaaaaatgtcattcagaaaggaagcaaacagtagatactagcattaaaaatatgttgtaaattttcaagcatagaatgataacataaggttaggaacaagaatatgtgtatagatttaaatatttatctctgtgaatattaatccatagatacaaatgttgaaggcaagttacaatcttgaagaaaatgaaaattatgttgtgtacctataatatgaaaataaaaaatcacacaaaggcatataccttcactcaaggatgtatactcgagtatacatattatttataatagcgcaaatttgaaaacagcccaaatgtccctcagctggtgaatgaataaaccagtggtgatgccttggaactgtggaatactattcagcaataaaaaggaactactgactcggcaacatgtgtaaatctcaaaaatattatgctaagtgaaagaagccagggtcaagagatgacatactatatgatttcttaaaacttccagagaagacaaaattcaggacagaaagcagatcagtggatgccaggagtgagagttaggggaggaaatttattgcaaaggagcagtaggggattgattgtggtgatgtttgaaatgttctatgtcatgatcgtggttgtagttacatgactattctgaaagttcatatttaataagtgatataaaagaaaaaagtattaatggcttaaacattaattttccaaatgagagcactaattaaaattctcaagtgttgagaacaaagatagtatctcattgtaatttttattctttttaaggttagtgaggtttgaaaacagttcatatgtttctttgccatttgcatgttttcttttgcaggtgcctgttgacttcctttacctattattctgttatgttgcttccagttccttatgaattcgcggaactttttgtatattcagagcagtaatcctacatttttagtctgtaaatgtttttccagtcacctgtttcttttgactatagtatctttttttaaaaagaaatatttgaaatgtacaaagaatgtaacagtttcccatactgctattaacatttttatattttgctcatcttttgagaaatttatatatgtgtccacgaaaagagtcaaactctataaaatattttaagagatttattctgaaccaaatacgagtgaccatggcccgtgacacagccatcaggagttcctgagaacatgtgcccaaagtggttggggtacagcttggtttgatatattttaggaaggcatgaaacatcaatcagatacatttaagaaatacattggtttggtttagaaaggcgcgacaactcaaagtgggggcttccaggccataagtaaatttagacgttgtctggttgacggttgagtttgtctgaagacttgggattaatggaaaggaatgtccaggttaagataaaggattgtggagaccagattttgttgtgcagaggaatctctcagcagacttcagagagagagaaggttgtaaaatgtttcttattagacctaaaagagtgcctggctcttagtcgattaatctcctggatctggaaaggaaagaaggaaaacaaagggaaaaggggattctctatagaatgtggatgttttttccccacaggagactttgcacggcaaatttcaaggtatggcaaggaaatatattttggggctaaatattttttccttgtctcataatgttatgccagagtcagattgaaaagtaagtcacgatatatagcgtcaaataaaacccatctgatgagaatttatggtttgtagggcatgacttcctagaccccttaggtaggagtttgggcaagttaaaaaatcagagctaagtcctcacatggcttttaaaaattgtgaataagtaatacttccataaattctgatttaattacgaatcccactaatttcttttttttctttcccagggacagccactgcaaagggttaaatgtatattcttccagtctagcttttatatttttatgaggatggggagatagacagataggtatatagttcagtgtttctcaaagtgtggtctttagaccagcagcatcagcgtcacctggaaatttgtgagaaatgccagttcttagtttctaactaaatacttagtttctcactaaaaacagccatttttattaagtccttcaggtgattgtgatgcacattgaagtttgagaaccattgttcatctaggtcattgtctttaactgctgtatggtgttccctaaattgaatataccattttttaaaaaagagactaagtcttgctattatgttgcccaggctggtctcaaacttctgggcttatgcgatcttcttccacctcagccttcagatagctgcaactataagcatgcaccaccgcacccagcttgaatgtaccatattttaaattccatattgtcaagcatttaagttacttttctttaaaaaattaacgttattgcaaaggaaacaattggcagagtgaaaagacaacctacaggatgggagaaaatatttgcaaagtatgtatccagcagaggattaatatccagaatatacaaggaactctgatatctcaacagcaaaaaacaaaacaaaacaaaacaaaacaacaacaaaaaatttaaaaatgggcaaaggacctgaatagacatttcttaaaagaagacagacacatgaccaacagatatattttttaaaaaagctcaacatcactagtcatcagggaaatgcaaatcaaaaccacagtgagatatcatctcaccccggttagaatggctactatcaaaaagacaaaaaatagcaaatgctggcaaaggtgtggagataagtgaactcttaaatgtggctagtgggaatgtaaactagtacagccactatggagaacagtgtgaaggttcctcaaaaaactgcaaatagaactaccatgtgatccaacaattcattactggacgtttatccaaaggaagggaaatcagtatattgaagagacatctgtactcccatgtttattgcagcactattcacaatagccaagatatggaatcatcctaagtatctaacaacagatgaatgcgtaaagaaaatatggtatatatacacaatggaatagtattcagccataaaaaagaatgaaattctgtattttgaggcacgtggattgaattggaggacattatattaagtgaaataagccagggacagaacattaaacactgagtgttctcattcatatgtggaagctaaaaaaaagttgatctcagaagtaaaaagtagaacagaatactacaggctgggaaggatagggtgcggggagggtagggaacgatttgttaaaggattcaaaattacaactagataggaagagtaagttctagtgttgtataccactgtaagatggctgtaattaacaatatgttacaaagtttcaaagagctaggaggaggatgttgaatgttcccagcacaaagaaatgataagagatgatgggtatgctaattaccttgatttgatctctgtatagctatgaaaatgttactatgttcttcataaatattaatacatcaaaaaatttaaaattaataattaacaaaagataaagggccctgaactctagttttagagctgaattgtatccagtcagatagtttctatgttatttaaatgttcactttaaatttggagctgaaatatatttggaaatctttacttttagtatgttcatttgtgtgtgtgaggtaaacttggttggctattggcaaatgtattgggtagctgcttaataaaacatttccttccagtgcttcagctttctgatgcttagaaaatatgtataattaacataatatgcattatcacttttgaaagtaactaattattcgaacagttatttgtgccaaattagtaatgtgaatttgggaactatcagtcttttctatggcccggaataatttaaataatagaaattatctgattagatagaaatcattgtaaaatcatcaaggttaggatttcctttgacttttgcttatcattagttttaaagaaaaaaaataaattgacataatggaaattttcactgtacatcaggaagggaattcagtggaaaagtaagcttcctattcactcttgaccttcagtttatactttttttcctaagtcaagtactgctactggtttcttatgctctttctagaactagcctgtttattgtctatttaaaataactcattaatcaccttttatttgagctcccttatggatctgtgtagtttttctgtctctttaaaattttgtatgcggtaaaatgcacgtaacatcaaatttaccatcttagccatttttaagcatacagtttagtagcactatctttcacatcgttgtgcaatcaatctccaaaacctgttcatcttccaaaacaaattctgtatctattaaacagctctccgttcttccctaccctcaactcctggcaaccgtccttttactttctgtctctctgaatttgactacctcatataagtggactcatacagtatttgtctttttgacatgggcttattttacttagcataatgtcctccagttccattcatgttgccttgaaagacaggatttcattcttttttttttatggctgaaatagtattcatccatgttgtagcatgtcaggatttccttcctctttaaggctgagtgatatattccattgtatatatataccaacattttatttatctaaattcatctgccaatggatttttcagttgtttccaccttttggctattataaataatgctactgtgaacatgggtgtacaaataacttcaagaccctgcttttaattcttctgaatatatatccagaagtgtaatttctggatcatatggttattttatttttgattttttgaagaatttctgttgtttttaaagtcacttttgatggtttgttctttgctagaaaatatatatttcagttttatcagtgcagagttgtatataatacttacatattttgtacaattatataaaggttatattatatttccatattctcatataattatctttagtatccatgtttgtaactgtttactcatttctctttcctcattcacgtttactattttattggtctttaaaacctaggctttgattttgtttcctagcatttaaatttttctgtttcattaattttagctttcattttatttatactgttatttcttgaggcaatggcttggttcatctattttcagtttttaaaaaaactgtaaagtatttgtaaggctctaaattttattttattttttagttataggaatttttaatatattctggttattcaccccttatgagatacattatttgcaagtattttctcccactctgtggattgttgtttcatcttcttgatagtgtcgtttgatacacaaaagtttttattttgatgaaatccagtttatctgttttttcttttgttgcctgtgcttttttggtatcatatacaagaaatctttgccaaatccaatgttgaaaatatttttttttcctatattttcttataggagttttatagctttactgttaagttttggtctttgatctattttgagttaatttttgtatatgatgtaagaaaagggtccatcttcattcttttgcatgtggataatcagttttcctagcatcatttgttgaaaagaccatcctttctctattgaatggtcttagcatctttgtcaaaaattggtcatatgtgtgagggtttctttctaggctctctattccattggtctgtatgactgtgcttatgctagtaccacattgttttgattactgtagctttgtagtaagttttcaaataagaaagtgtgagttctccaactttattctttttcaagatagttttgactattatgcggctctttgagattccatatgaattttaggatgggtttttcctttttttttttgagatggagtctcgctctgttgcccaggctggagtacagtggcgcgatctcggctcactacaagctccgcctcccagggtcacgccattctactgcctcagcctcccaagtatctgggactacagggacccgccaccatgcccagctaattttttttgtatttttagtagaaacggggtttcaccatgttagccaggatggtctccatctcctgacctcgtgatctgcccgcctcgacctcccaaagtgctgggattacaggcgtgagccaccgcgcctggctttttttttttttttttttgcaaaaaataccattgggattttgatagggattgcattgaatctgtatattgctttgggtaatattgttaccttaacaatctaggaacgtgagatatctttccatttatttatgtttaatttctttcagcaatgttttgtagttttttattaagtttttcacctccctgattaattcctatgtattttattttggatgctatcgtaagtggaattgttttcttaatttcctttttgtatttttcattgctaatgtatagaaatccagctgatttttgtgtgctgattttgtattctgtgactttgaatttattagctctaacagcttgtttttggtgtgtatgtgtcatctttagggatttctacatatatatcatctgtgaatagacatagttttgcttctttctgtccaaattcaatgaattttccatctttttcttgcctacttgctctgtccggaatttctagtattatgccaaatagaagaagaaaaagtgggcatcctcatcctgttcctgatcttaggggaaaaacgttcaatctttcactattgagtatgttgttagctattggtttttaatacatggcttttacgatgttgaggaaatttccttctattcctagcttgagtgtttttttatcataacaggtgttgaactttgtcaagtggtttctctgtattgattcagatgatcatgtggagtttcttcttcattctattaatgtggtatattacattgattttttcattgttgaatcatcttgtgctcctggagtaagtttcacttggtcatggtgtgtcatccttttaataggctgctgattttgttgagtttttcatcagtattcctagggtgtattagtctgtagttttcctgtagtatttttgtctggctttggtatcggtaatgttggaccatagaactaatgaagagaagtgttcccttctctttaatattctggaagtgtttgagaagcattctttaaatgttgggtggaatcaaccagtgaaagctatctggtcctagccttttctttgggagctttgtgattactgattaatccctttactagttatagttctatttagattttctatttcctcatgagttagtttcggtagactgtgtgtttgtagaaatttgtccattttgtccaggttatccaaattgttggcatacagttttacatagtatcgtctcataattctttttatttttgcaaaatcagtagtgtcaccactttttttgttgttgttgagggggtgggggggatagagtcttgctctttcgcacaggctggagtgcagtgacaagatcttggctcactgcaacctctgcctcctgggttcaagtgattctcctgcttcagcttccctagtagctgggactacaggcatgcaccaccatgcctgtgtaatttttgtcttctttacagtagagatgggggttttaccatgttgatcaggctggtcttaaactcctgacctcaagtgattcgcctgctttggcttcccaaagtgctgggattacaggcatgagccactgcatctggccgtgtcaccactttcatatctgactttagtaatttggtgttctttctctctgtctctcttttatttatttatttttttgttaacctatctagctagagttttgttgactttttcaaagaatcagcttctggttttgtaatttttctccattgtttttctgttctctcttttcactctaatttttattattttctttcttctgctagctttggtgtagtttactctttttctagttccttgaggtatatggttaggttattgaatgagaactttcttattttttgatgtcagtgtttacaggtttacatttttcttttagctctgcattcactgcatcctataagttttagtatgttgtgttttcgttttcatttatctcacgttggtttctaatttcctttgtgattttttcctttgatctattagttaacattcacaaattttcacatatttgtgaattttttagtttttttatctgctgttggtttttcatttccattatgatcacaaaacatactttgtatgatttcagtttctttaaatgtattaagacttattttgtagcctaacataggtctgttttggagaatgttccatgtacacttgagaagaatatattgtgctggtgttgggtgagtttagtttttgacatgttacatttgagcattcatttaggagaaaagccaaaggaagacatttgttaatgaactgtaaagaggggttgacatcacaagaataggtaattttttttgagaaacaaatttagagcaacagaacagccttgaatatattcttatttagaaggctgaaggttgaatataacctggagtgttagaaaagggtggaacagtttatcatagaccagagccaagaaagtataatatttagactttaaatatcaaaaagaagatatggtcagctgaattcaaagttgaaggctaggtgtggtggctcatgcctgtaattctagcactttgggaggctgaggcagaaggatcacttgagcccaggggttcaagaccagcttggccaacatggtgaaatcctgtctctactaaaaatacaaaaattagccaggcatggtggcaggcgcctgtaaacccagctactctggaggctgaggcgggagaatcgcttgaccctgggaggcagaggttgcaatgagccaagatcgtgcctttgtactccagcctgggcaacagaggaagacaccatcttgggaaaaaaaaaaaaaagaagttcagaaaacagcttgtttgggaaggactgttttttgtattcctttaataattcaataaagaaaatagaaaaaggattttttttaaatttgagaaacatttaaatgatgaccactacttaaattatgaaattgaaaaccacaaatataaattatgcattctttatagtatgagttttagaggctgttaatttgctataatattagctacatctggaatagaagaaacttcatatattatcttatcgctatatttgaattctgtagaagttatttctggacagtctacgaaaagctcttgctggccatggaggaagtaggcagctgacagaaagtgctgcaattgcctgtgtcaaactgtgtaaagcaagtacttacatcaattgggaagataactctgtcattttcctacttgttcagtccatggtggttgatcttaaggtaacatgcttattctttctctactacaaactttaagaaaattaaatgaattttctagcataagtattatgtcaaagataattgctaacattaaagttctgactcttcgttgataagttcataggacttgcttttgttgttactgtgttcatcagcctaaatggactgagaatatgaagaaaacaccattttcttaaataagcataaatatacagacttgggtttaaaataatgtggcaattagggcctgaaatgaacctatatatggtataggaagaattgtatcagactgatgaaccacagtatgggtgctttgtgcttcttctggcagctggattttactgccatttgtgtgggtaatgtgttgatgttattacatgttagtaaagaaatactgcatgggtatttaaaggcttttgttttctgttggggtttttatagaacctgctttttaatccaagtaagccattctcaagaggcagtcagcctgcagatgtggatctaatgattgactgccttgtttcttgctttcgtataagccctcacaacaaccaacactttaaggtgagagcattggtttttatctaactatatttactgatgctgttatcctttataaacaaaaagactatagagattaataggttcacttttatcggtatttctcactattatgtattgatgttcgtttcaagaccttaaaaacttagtgttttttttttaaactttctatttgctgttctttttggcttcatttgtattactgagtatttttctcatagaaataatctgcttttttttttctttttctatagatctgcctggctcagaattcaccttctacatttcactatgtgctggtaaattcactccatcgaatcatcaccaatgtaagtccaaaaggtattgctaaattactaaaaaaatttttttctttcttttctttgcgtatttctttttaagaaatgcactcttggttttcaaaaaggttctgaatttagatgtatgaaataggaaaatttctccatggtgattctatttgataattgataaatatttgtatttttcatattaagtcttgaccgaagggaccatattaaggaagatggagttaataagatgctttggaaagattaaatctaaaacgttttattcagatcagaagcccttgagaaaaatgtcactgaaaatacagtttaaaattttcatcccgaagcttttcaaacatattatttcagcatttgatacattgacttgccaccttaccatttaagttaaaagtaatagtatttatgttgtagtctagtatagcacattgacaaaatgatgggactatatttgatggtacttttaaatcttttgatcctaaattcattcatagtgtaaaatttcatttttcttaaacaaaatgaaatattaacatactttaaagtaggtattaacaagatacaaaagcatatcagacaaagtaagtgaaatcattaaaaggtacttgcgaaaccttcaactctgtctgatgtggagacattaaatagacagcaaaactatcagatttggactgtggatttttaaaattctgttcttgtaataatgaacaaccctattttgaaagttttcaagtgttattttccattgttccacttttatcaaatgatactcacatttatgggtaaattggttgatgctttccttccttaaaggaggctgtaatcattgataacttagtatatttgacctgtttataatcaaattccattttaagactgtgcctctggtgagttgaaaataacccttcacctcatttgccctggatgttgtatttatttaaaataaatactgcccatattctatccattcctgcagtggaaaattaactattgataaagctatttggtgatacatttaatttttctcagcaggtgtttagtgagcattttgggaggacagtcctttgttgtgcaggatgccttgggcattgcaggacctttaagatcgtctggcctcatttcattaaatgccagttgtgctgcatctccccatccctagtcattatgaacaaataaacatgcctgagggaatgatacctcctcccttagttgagtatcactgagttaaattgtaggtaaaagtaacattgaatatgctttgttccaaaagggaaagtttaatgaagattgtaaataaggtatgtttgtattaaaaacttaaaaaaaatcactgtacttttgtcagcgtaatgagccagggcattgtaccttcaaggtttactttcaaggccattaaaacaaaaagatgatttctcccctcaagtttatgtgtaactcagaaataagtcattattgcttttttccgctgtggctcagaacactaaaaatattcaaagagtggatagctttgcataaatgcttaaaatttgtatacaataaacccaaatatatacttttttgatactttgtggctagttactttaattgtgaaatatttttgtctacaactgactacatagagcactttcaagcatggacttggcactgctgtaagtggctgagctgctcctttctgggttccaagcatgcctggagtggtgcttcatgcatgcctcagtgtacttggtgaaagtggctgtgcatcctcttctactctaatgagcactgcatgtgtggagggtggagtgtgtctgtatcagagatcaagttatatgaaaatctgtttttataaagaaaaaaactacattgaataatttttaaacattaagtatcagtaacttttcaatgaaatagcttgaaaaggaacataaatattagttcaaagtatctttttaaattatgctttgggtagtgatactttattattatagatagtgtgggaaattgtttctcgttaggatattttcccccttggtttgaggctaatcgctattgaatctgaagtactcttttggttgaaaaggactatttataaagtgaatatagaaatttatgagattgactattttagagtttcatttgaagacatttattatggcaatatttttgtcttgaaaaatcacatgaaattattcttagatatttggacttctgatcttaaattcattcgtagtgtaaattttttttctaatgattcttggttcaatgtacctcataagttctcttctcccatggttctttagccagtccacacattttttttaaagcatcacattctcaaataagataaaagttttagtgatgtgtattgagggtttgtgtagaagtagtaaggtgtttggagttctacttttgtgaaacatactcatactcagttcataagtactgagtttagatctaaaatattctagtgtttcttcttagaaaatctaaaatatatccactatttgattcttattataatgcaggttcctagcagttactaaaatagtagttgtactgtcatcttttttattatgatgtgccataagagatgaattaatagttgtaagatctatgttatatgcataatcttcatagacttcctttaggttaaattagatatgtaattgggaaatttaaaaagtaatatacacacttatgaaccaattatcttagccatcactggtacatgctatagctggtatattacttatttctgttttttccttacgacaatttatcgtaatttacatatggatagttcacatactgaaaatgagatgattgctttctactgagaggttgtagttgaaaggaattgtttccaaggcatttgaaaattatttaaatctcttaaggaattgccacataatttgttcatattatgtaagtgttgccatttggctataaacatggtattttcaaggaaaaaaagagtaagtctactttaattgactggtgttcaggaagggcacatttagtaactgctcaaaatactaaacttttttgccaaccacatgatgtctagtttttcatacttattttatttgaaaatgtgtattttactttaaaatgaatatattatgaaaaatgaaaactatgaaaattactaaatcttaagcctaaagttattttatgtggtgcacctggtaccacaatacggtttcaaaagctattaaaaaaagacacagtaatttgaataggatgttatatgggatgcctttcttagtttatcagtttctgacaagatcttacgagatgtgttgggtaaggaagacccttcactcaatgtactttgttattattcagctttttgttactttaggctgattaacacaagctgtataatttagtaagtataaggaaatcaagttgcattggttgctttgggcaagtcaaaattgctgagagttggaggaatccattatactatcagactaaaaattgatcatttgtagaaactagattaaataaagtaggagttgagggaaaaatgtaaacaaccatactgtcccaaaaaagcatttcttccctcccagttttgggattcctccctgaatggagttcagtattcaaaatgtgtatcataagttggttttatattttactatccggcgaacaggatttgtaatccacagtttgggttaaggtaatataactcgatgctattcaaaatattctgagaattccaagtgaagaaattaaaatgtcgagacttcaattagcttagttttgaataagaaaaaatctgggactgaaatgtgagagatgtgaggctattcaatccctcttatctacaatttgaatgtattattcttccagattttttaaataaacatctggagtattataaattagaagcctacattttaggtcatttaatgcatagtctacatatgtagtgaaaattcatccagtcagttttttattaaatgatagactttaaagatatagtgattttcacaattgtcattttttaataatatatcaagtaattcattttaaagttaaagatacacttccaaataaaataggcactaaaaactagacatcagagttaaacagggtaaattgaaatagaaaatacataaaataattgtttaaaaaatatttcactaggatcagtttgtctttgtttatggtaattgttagtctcccatatatcatgtcatcattgcatatcaatttataggtttacttaatagttttatttcatttactaatttcatgttgtaattatcattgttgtctgtaaacatataagtaatggttttccacatacacttttaatactgtgttgaaccactaatcacttttaaagctttgataatagcattcttacctgggaaaatatatgccatgtatgcacgtgtgccagaaattgtaaaacattaaacttaaaaaaaaaaaaagaagattggctacagattagctctctgaagactttatttttcaaattcactggctaatcatcgagaaaagatgtctcacatgcacatgctcataaagtgggcaatttgtctcatgctcactattatgttttataatataatatgtatgagttagtgtttgaattaaagacgttgtttgaagactttggaaatcatggtgtgtgtttgcatggtcttagaaagttcccgacaaaaggataaaacttaaaactacagtgataaacagagcatacaactcacgtaattttgtactttttcttcctattggtctttgtttttctctagtccgcattggattggtggcctaagattgatgctgtgtattgtcactcggttgaacttcgaaatatgtttggtgaaacacttcataaagcagtgcaaggttgtggagcacacccagcaatacgaatggcaccggtaagataaatcacgaattttgaatctcacctcctttctattgcattttttttagtgtctttatcctattcctgctgctttggttattttagagaattgaatgggtccttcatttcctctaaatgttgtggtatgttgtatctagaatattgttgaatactagattatgtttgttttccactgtttccatgagttgaacttaacttttcttagataaattttctcacaaaacactgaaagtcttaatgaatgtcaccttttttttctgtttttaaagttttttttctccttaaaacttttgaacaaaaatattttgattagcctctcacgttttggggatgagtaagggaagctgactcctgggttagagtgaatgttgctgccaatgcacattttagctaattgaatggtgactattaaacataggaaatgaataaaatttagagtttttgtatttaaaataaaaatattttgtatttcaacaaatatgccttgaggttttacaactgataggaactttgatactgacatttgactctaaacttaataaaaagcagacttaaaattgggtattctcacagattattactcttaatatggaattttaaaactcctatggaatcaatttaaaaagataattataagattgtggaagtcatttttttggtgtttatgtatagcaagagtattatacaagagcaactcttgacattgattggtggtgctttgtcttctgcttcttattttctattattggctgctgtcgctcacatgatcagatgccaaccagtcactgttttgcatggcagtgggcttctgtggctgtaagtatgacccattgtaactacatcagaaaagtccttggtttctttgacttttctgtgtatagttaccattatagtcacatcttgtcatttcaactgaaaatatagcatgtcttcacctgttggttttatctagtaagttagtcatttcacagttaggagataatttaaacagctttctccctggcatgcttctctttttccaagtccccttagtcagtgaaatattttggttttatacagttgtggttcactcttatccagttgtcagtaattatttctgaggattgtttatcttagatgttcaaatagagaagttttttatgtcatatattttgggattattgagcctaaaaaatatagccaaaagatcatggcaatgatgtttccttaagtaaactttaaaatgcaaggttaccttttagttgactttttgtaatgccaagtacttcacttttttttaagttgaagaaattttcagtacaggtataagttaattggaggtaagcataaataatagctgtttaaatgtcatttaataagatatttttaaaaaatcttttaaaactacttgaaataagttgtttaaaagttatttattgacctgtttattccagagatctgggaaatcagaagtttatttgacttttttgctttaagtttactaccttttctggtagaaagttaatgacctccaataataggacttgttggggggttaatattcacttcctatttaacttcaatatccactttaccagctgcccataattttctgtgaataaggactaaaaatgaaactaaatgattattttgaacagaggtaaaatttgattggtagtctaaatatgttctctacacttagaagttattttacttcttagccctagttataagctgattctcagagctacatattattttaccgaaaagccataactagagaggatttcctcttttggctcaaggacacctgtaataagaatttagtttttatttctaattattttctgaaaatatcaatatacatttaattttcaaaatcattcctaagctgtttatgtttttgaaatgttatatgtatgtatatttgtacataatgactaaaggacagcttttgggctgatattaccaggagagaaaataaatagcaaatgtaatatgaaacaatttttagaataagaaaattttaggttttgaatggctgttagggtaaaatctcacccttcataaacttggtgagttaacagtcagataaccagtatggaagtattgaccttctactctttgccaggcaaaggtgctaatgccagggaagcatggtgaactaaacatacacagcacttcccctcaccgagattccaagcaaaaggtttatagcttttgcttgaaaatgtctaatgaagaactcaacaccggacacggtggctaacgtctgtaatcccagcactttgggaggccaaggtgtgcggatcacctgaggtcaggaggtcgagaccagcctggccaacatggtgataccctatatctactaaaaatacaaaaattagccaggcgtggtggtgcatccctgtaattccagctactcaggaggctgaggcagaagaatcgcttgaacctgggaggcagaggttgcagtgaactgagatggcgccattgcaccccagtgtggacaacaagagcgagaatcggtctcaaaaaaaaaatcaaacaaaaaaactcactacaggtggcatggagtctggcaacacaggcaaatatatataataaatggtttacagataatacctaacatcagagtttcctactgttggcactattaacattttggactggataactctgttatagggggctgtactgcgcattgtgggatattcagcagcatctctggcctctacccactagatgccaatattccctttaccccccagccctccaagtcatgaaaaccaaacatgtctccaaacatttccagatgccccttgggggacaaaatcacccccagttgagaactactgtattacagagtatgttcagtgggttgtccctcatttgtattgcctcaaatgatttgggactgataaacctgagccattagcttgcttcagaagtagcaatctaggagttctgttgcaaaacagtaaaagtaaaataatatctgcttcaaggctttactaacactttgtattttggagagacaagttacttgttggaaggagctaattatttgaaaattttctcttcgaccaagatagaatcatgtctctgtcacttacagccatcactgatcctctttctgttggagctctatagaatacttctgattcttccacaaggtggccctgcagatatttgaataaggttattctgtactcctagaattcgttttatttttatatcgttttggcattggaagggattttattcttttagctctctctctttttttttcttcttgagacagagtcccactccgagtcccactctgtcacccaggctggagtgagtgcagtgatgcaatcttggctcactccaacctctaccttccaggttcaagtgatctcctgctttagcctcccgactagctggggttacaggtgcccaccatcatgccagctaattttgtgtttttagtagaccatttagcaccattttgggcaggctactcttgaactgtgacctcaggtgatccacctgcctcagtctcccaaaatgcagggcttataggcatgagccactgtgcctggcctcttttagctctctttaaaactgtatgtgtgtttgttgggtctgtttttatagctaaagaaactgaagcttaaataaagttatattaataacaaatgcatggttaatgaacagtcaaccagagttagttctgaggtttcttgacattcagttcagtgtctttatcaggttctttagttgtccttcttcactagcaagttagcttgatgaaagcagtagctttgtctggcttaatcaacactgaatccctaacgtttgaacaacatctgatacatattgggcatttagtacatgtttgcagaatgaatgaaggaatgaatttcttacttgatgtggtttcaaaatcctcgtacaggccgggcacagtggctcatgcctataataccagcacttagggaggccggggcgggcaggtcacttgagaccaggagtttgagaccaactgggccaacatggtgaaaccttgtctctactaaaaatgcaaaaaaattaggcaggcgtggtggcaggcacttgtagttatagctactcaggaggctgaggcaggagaattgcttgaacccgggaggcggaggttgcagtgagccaagattgtgtcactgcactgtcagcctgggcaacggagcgagactctgtctcaaagaaacaaaaacaaaaaacaaaaaaccctcctgtttctgatttgcttctcttctggaaagaccaacctgacaaaaatttttaaaattaaaatgccatattaagatctgatgttagtgatacagatataatactatgatgtaataattgataaaagctattaaactgctgtgtttgtataccctgtttctattaatacaatctaagatagtattattattttatgttgactttttagttatttaaactctttggccctttttatatgaatgttgagccataacttctcctttgtacctttgtagtatttttttaatatttgaaatgtttgtcttagcactgattttactatttgcaaactaacatctcctgctttcataaaattcaaaactgccaataacagatatatgaattttcacaagtatttgttatttctcaacattttttatcttaagtggcatgctggctcaccagatctttcttacatgcctgttattcagtcacatggtctaaattaacaagtggtttgggcctttaatagatatctgaagactctggttcatgaatttcttcccagacatgattgcctctcatctttggccagatcacatgtaccagcttctattcctactaatacctgcaatatagaagatcaactaatgaatgaatgaatttttttcttacatttctaattaagaaacacattgcttctttagcatgtttttcctcactttctgtaacccactaaaattaaaaggtatttgagatgaattaaatttattggaatttctgaagtcatacatttcatattaggcaaccatgttggaacagaatttacatgttgatatttgggattaagaggtgacataattaaactaatatagtcatacatcacttaatgacagggacatgtcttgagaaatgagtgcatccttagtgattcagtcattgtgcaaacatcatagagtctgcttacatgaacctagatggttatatagcctgctacatacctaggatatatggtctagcctactgctcctaggctgcaaacctagactaaacagcatgttactgtactgaataccttaggcagttgtagcacaatggtaagtatttgtttattcaaacagaaaaggtgcagtaacaatacagtataaaagaaaaaaatgtataggacacttaacacaaatggagtttgcaggactggaagttgctgtgggtgagtcattgagtgagtgttgagtgcatgtgaagcctaggacattacactactgtagacttaaaatttttttaaatttattttacttttaatacttttgcatttttctcatactcaggatctatactgtagactttataaacactacacttaagctatatcaaatttataaaaaatatttttatatgataactttacagtagcttttaaaatataaacttttaaattttttaattttttgacttgtaataacacttagcttaaaacactttgtatagctagctgtataaaatatttttctttatatcctgtaagttttttctatttgaaaatgttctattttaatttttattttgaaaactgttttaagatctgggacacaaacatacacgttagcctaggcctacatggggtcaagatcatcaatcagtgttactgtcttccacctccacatctgctcccattggaaggtttttaggggaaataacgtgtggagctgtcatctcttgtggtaacaatgccttcttctggaatacctactgaaggaccttctgaggctgtgtttcatagttaactttttatctttaagtaggagtataacaatacaaagtatactatagtaggctgggcctggtggctcacgcctgtagtcccagcactttgggaggccaaggcaagtggatcacctgagatcaggagtcgagaccagcctggccaacatggcaaaacctcttctctactaaaaatagaaaaaaattagctgggcgtggtggtgcatgcctgtagtcccagctacttgggaggctgaggcaggagaattgcctgaacccgggaggcagaggttgcagttagccgagatcgcgccactgcactccagcctgggcaacaaagtgagacttggtctcaaaatatatatattataataaatacataaaccagtaacagttatttattctcatcaagtattgtatactgtacataattgtatgtgctatactttttttttatatgactagaagtgaagatttgtttacaccagcatcactacaaacaataacgcattgtgcttggacatcacgatggctatgatactaagtgataggaatttttcagctatgttacatattgtctatcattgactgaaatgttgttttgtggcatatgactctatttacgttttttggaaatgattcttaaggaaaaattctgatacctgctcattgttctctgatcttgtgttcctgtgcaatggctgcatcagggaagagccatttgatagttacacttagttacatcaaagtaaataaattcgtttaatcaaagtttcagcttgatctgaggtgaaacacctcaacttagagtgaggaaaaaaatacagttgaaagagagcaaacagtaaaaccagaatttattaaatcatttagtaaaacatttgctttggggtcagggggcagttataaaaagcaaactatttggaagttttgctatttctcttctgtagtgacattcttgagtataaatgtgtgcattaaatagctattcttccccgcaaggactaaaacccttcggtgttcttgggtataataacaaatgcatatttcacttaaacattgaggatagttcatttgtgttgtagatatgcatgtctgcttcttaactttgaaagacagcctgtttacctggacatttgtattatgggtccacagttggtacacagtcttgttatttctgtattatatatatgtttacataaagacattcattcagaatcagatagttttgtgttcttttcaaggaaaaaaggaaggagatgttttataataataggtgatgttagctctggaatataattgttggatttttggttgaaaaacatttataattattttaattcatcatatgtctctataattgaaacatattttctgtaagtttacctttctgagttctttctgttttacaaatgttcttcaggcaaaatgcatgcattctgtaacttaaaagaggtggagtgccgtcgaaggaaaaagcaaattttacaattaaactagtaaatacaaagattgcctacatgtttcattaattctaagaagcacttatttttactcttctctaaaattgggaatgtatcttattttaaatggtgtcttacaattgacagcagtttttcattccttttgggacatcaaataatgatgcatcttacaattgataatgttgtagagtctatgaaatacttgtatgtatgtctggggaatgtttgttaaataaattacccagtgtgtatatttgtgagaactataggccaaatcttttttcccttatgtttttacattttagaaaatagttttttacatagatgttttacaacctgatactaagcttttagtattgtaatagattttcattgttttattagattgataaaaaaaaatataaatggtgcaaaaacgattttcattgttttgttaagcttaataatactgaccttatgcttactattgagtgtttctactaataccacacatttggtagtataaaaaatagcttttttcaaaggtttttaataataaatttcttttaaaaggttggatagctattatcctgagtcttatgtctgataccatgtttttgttttgtttttagagtcttacatttaaagaaaaagtaacaagccttaaatttaaagaaaaacctacagacctggagacaagaagctataagtatcttctcttgtccatggtgaaactaattcatgcagatccaaagctcttgctttgtgtaagtatttttttatgaaatgtctcaaaattatcacactaagttaattgggtttagctgaaacgccaagaccttgaggataatttttagctcaagagcacttactgatcctttctgatcatacctgaaaactaagacgtctctaagaaaactaatgtataatgaatactaatataattagatcagattcttaattgcccttatcatttcctaacatttctctttcttcttaatttccctatcattaaactaacatactttgatgagatctctgttctcatcctattactaagttatatattattcaggtataatcctggtatgggggatagaagtgaccatcgatcacagtgtctacatctatactgttggtttaaaaaatctccagattgcttttgccagtttagcttttctatccccctttctttgtgttatcagctttctgttatcattggctctgcctacaaatactgtattggaaaaagaatgaggtgaaaatgggtgtggttagtacttgagttagtgtgattatcattattattattattttgagacagggtcttgctctgcttcccaagctagagagcagtggagcagtgatggctcactgccttcgaactcctgacctcaagccatcctccagcctcggcctccccaagtgctgtgattacaggcatgagcccccatgcctggctagtagtcagttattgtcataactactcttactgcctcagatgatattaaatttctgagaacatcactctggtacacagagtaattaggaacaacgcaaataataaaaatgagtcataatgaagtgattaacagcatggacgctggagactacctactagctatgtgatttggatgactatttaatctttctatgccttagttttctcatctgatatattgggatcataatagttcctatctcagagatactgttaggaaaattgaaatagtacatacaatgctttaggaacaatgcctggtgcataataagcactaaataaatgttagctattattgctattaataagatacaatttaacactaattaatgcaccaaatgtaatagttctatattgtgtctttcataggatgacatgtttaacctttgttgagcttcttcagtccctggagagcagcatcaagcaaggtttcttatcgttttgctcagtaactggctttttaaaaagtgttaaggtgctttcgattttggtggcatattttttaaattactgtaatacagggagtttgtaactacatgcctatgattccaagagttctatgaaacttcgtgaattttttaaaaatgtgtatttatgagtaatttttcttggagagtggagaggagagaagaaggaacattcccaaaggatcagtgaccccaaaagaaggcctgtgatactttaagcctgaaaaacccattcaagtttgaaagtctaattagaataaacagatctttggcatgaaaaaattccataaaacctgtcagtgaaactctataaaaaaatgaagttccctttctcttcattcctttgttatgtgttacaagctatttgtggcattatttcatcatgaaggtcacataatactagcagtactctgtttacgtggtgataattcacattcaaagcaggcaccaaactcaccaatgccgtttctactaaatgttgcttcaagaagaatttaagcaaaacttgccattttccaaggatcatttaaaatggaaattatttgctttgctgccatctagtggttaataagttttctcaaggtaaccataagtacattaaaatagaagattcgttgtaaatatttgaccattttgtcttttacataaaaaatctgagtcttagtaatttaggaggaatgtaggaataattattaaatggtctcaatcatggtatttttaaagtaatatgattttgtcttccattttagtactctcaatttctcaagcctcctaattactcagcttgcatcgtttcttagatccccctgatcatttctccacactgaagttatggcagtctctttaaaaagcaaatcttattatgccccctctcagcttgaacccttttagttgaaattgctcttgcttatgaagaccaaactccaaatagatctacagggtcgtgcaaaatctttctcccatctaccatttcttccacatgtagcattacattttttgtcttcctttactctattcatgatggtcttcctttcagtctttctaaccacatgccttcatacctcccttgcagttgcttttccctctgcctagaatctgcttactcttaacatagtaattcctactcattctaagctattgtcactgcactaaggaagcctccctgagtcggacacttttccatgttataggctgtcatagcagcatgtaccttaataatagctcttatgtgatttgcatttttatacttgttgatctgattatttcattgatgatatcttcccccatgagactacatgctcatggaggatgggaaacacatcttctctttttcattgttgtgtctttggcattcaataaaaatgatttggttttggatgaatttatatgaatgtcagaaaataagctaacggttttgaattacagatatattgcagtgagggcttaccttagtcattataatggggaaaaatctatagttagcaaaataaaatatgggacacaagttgcattggcttcatatattcttcttttttttttttctgagacagagtctcactatattgcccaggctagagtgcagtggtgtgatctcagctctctgcaacctccgcctcctgggttgaagtgattctcctgcctcagcctcccaggtagctgagattacaagcacccgccaccaaaccggcttgtacttttaggagagatggggtttcttcatgttggccaggctagtctcgaactcctgacctcaagcactccgcctgccttggcctcccaaagtgctgggattacaggcatgagccaccatgcctggccaaaccatatattcttgaagtgcaaatatatgcttccaagttaagagaaacattttagtctctaaataggtaggcattcggcagggcgtggtcgctcacatctgtaatcccagcatgttgggaagccgaggcaggtggatcacctgaggtcaggagttcgagaccagcctggccaacatggtgaaaccccatctctaataataatgcaaaaattagctagacgtggtggcgcatgcctgtaatcccagctactcgggaggctgaggcaggagaatcggttgaacccaggaggcagaggttgcagtgagccgagatcacgccattgcactccgtttcaaaaaaaaaaaaaaaaaaggtaggcattcacatttttacataacgttaattttctttgcttagtacactatatttttccacgatgaaaaggaccgaagtatgggtatctgccgatgcaaattctagcctttgctttgttaccagctgtgtggatttgggcaggacctttgtatgggtcaagagggctgtacaggataatcatgcaatccttatccaacatgtatgtcctttacctttgatcacaatcatgtataagctcaaaaccagtaagttccaaaccagagatacgttctttagccagtttactattgttggaaaaaaaattattcctcatattgttgatgtaatttttaatgggaattcgtggtttttgttttcattaggattttccctggacattattcacattaatgaacaagtatagatgtggattaaaagaatccctaacaaaagaagttttgatttaataaaatttttattttattgagataaaaatactatacccacataccataaaattcaccatcttaaagtttacaattcagttgttttcagtatatttacaaggttctgcaaccattaccactatgtaattctagaacttttttttctttctttcttttttttcttttttctttttttcttttttccagatggagtctcgctctgccacccaggctggagtgcagcggtgcaatcttggctcactgcaaccaccgcctcccagcttcaagcgattctcctgcctcagcctcccaagtggctgggaccacaggcgcatgccaccacgcctggctaatttttatatttttagtagagatagaatttcaccatattggtcaggctggtctcaaactcctgacttcaggtgatccacccgccactacctcccaaagtcctgggcttacaggcgtgaaccaccgcgtccagcctagttctagaacattgttatcacccctaaaagaaacttggtaccctttagcagtcactgtctatttcttcctccttctaatctctctcgatttatttatttttttaattgaagtttcctttttttccttgcagaatccaagaaaacaggggcccgaaacccaaggcagtacagcagaattaattacagggctcgtccaactggtccctcagtcacacatgccagagattgctcaggaagcaatggaggtaaggggaaaatgaattccatgttcttgaaggaaagattgtaactatgtacattcatgatgttcctttggtgtgtggtttctgtgagtaacaggtagatgtcatttctggaaatggtatgtttatgtctatacattgttttataaaactccatggagaaagaaggggtttacttgctttgtatcacatagcaataacattgtacaaattctgatgcttaataaaatagttcgagattttctaattgcagttgactttaaaatttttaaaaatattattattaaatattaaaaatactaatttttaaattgagacataattcacataccctcaatttggccattttaagtagttcttttttttaaattttattattattgtacttttaagttttaggttacatgcgcacaatgtgcaggtttgttacatatgtatacatgtgccatgttggtgtgctgcacccattaacttgtcatttagcattaggtatatctcctaatggtatccctcccccctcccccctaagtagttcttattcacacagttgtgcaactatagctactctctaatccataacatttttatcaccccagaaagaaacttgactccccattccctcatccctaccaactactaatctattttctgtctctatggatttgcttgttttagatatttcatataaatagaatcatagaatatgtggccttttatgtctggctaccttgacttaatgctttcaaggttcatttatgttgtggtatgaatcactattttcttcctttttattgccaaatatttcattgtatggatctgttttgttcatctagttatcagttggtggacgtttggtgttgtttctactttttagctattacaaataatgctgctatgaacatttgtgtaaaagtctatatgtggacatatctcttaagtatataggagtggaactgctaagtcgtgtggtaactctgtcgaacttttgaggaactgtcaaactctttttctgaagcagctgtatcattttatattcccagtaacaacatatgaaggttttaatagttctgtatgcttgctaacacttcttataatgtgtctttttgattgtagccatcctaatgtacatactgtacaaatgtttatacatacccagtaaaaatgtttataaaaatattttagcacttactacgtaatcattgcttccatttgtgtacattgctattggtcccgtaaattgatacatttcttgtagtctttttggaaggctatttggcaggagctatacaaacatttcatttttttatgcaaataattcaatttctatcactttaaaaatcttatgaatataactcaaaaggaaaaagctgcacacataggtacttattgctcttaattataatagaatattaagagagctttatttactgggaggagaatgggttaatattcaatagtgagaatgctattttaacttggtgagctgttaaacatttattaaaacttatatagatcacacagcaatatggaaaaatatgaaatgtcaagtgagtatactgcatttatggctttgttaaaacatggaaaatacaaaaaaaagaaggcaatatgaaaagaaaattaaagcctggaaaaggctaacacattttctttcaatatgtatttttaaagttttatcaaacaaaaatatagagaatttgtcacttaaaaaaactagtgccagtaaattgtaccacgtttttgtacaatagtagcaaaattgaattttaatttgtgttgtttttccttgatatgagagctataaattatatagctttttaagattctcaacaattaattgcaattttcattaaatatctcaaagtaattacaataaaaatgtttgaaataagataatatgggtctggcctttaaatgttgatatgttgaccaaggactgaaagaaatgtccagagcttcacagtttctgctgggttgggggtggagggatggtgggaggaatgtgaattgggattgtagaattggagttgagataagatcagttcgaaggaagagtttgtgttttttttatatctttgatggttttaatttatataataatctatttatatgttatatattgtaaatgaattatttaattcccgttagtgttctctgagccagattccaacttcagttctgtggtcaattgaaatactttagaatggataatctgctatgaaatactgaatccattttgcttcctctctcttgattttgaaaaataattgctcttttctgttacaagagactttgtggcaagtgagacagtttaagtaaaaacttaaaagataagtaaatcttttgctgtgtgtattaattttggcaagccttcttacttggggattagctttttgtttcatagagttctttaatatctattgaaattattttgtttgtttcttaaagcagtttttacagttatatattgttccgaattcatcatttagctttatatgtacatgccagttagagtcagaatgatgggaataaaatgatttcattctgtctgtattattccctagaggtttgtgttcaccagagtttctctctttttaccttttactatatattgaaactacaaatgaaagagctcaatttcttagcatttataaaataagtactccagtgttatgtttaccaaaaatgtttgagtgagtcttctctttgtctttctcttttttaaaaaattcaggctctgctggttcttcatcagttagatagcattgatttgtggaatcctgatgctcctgtagaaacattttgggagattaggtatatgtacttttattttttaaattcaacttttaaattttattttgtatttttgtcttgaaatattaactctgtagtacttagtacattgtaaaacttacacttccaaaggttttatggttttgtattttatttgacttcaaattattagaatttcttgttttaactgtaagaaaagtatcacagcaatttagaaaataaattttaagaatagtgctaaattttgtcaccctaacataagtactgttgtttggtatattacttttttcagatttcaatgtggttactactgtatttttaatagattttcatagttataagcctagaatgataaaattttgtaacaatactgttttttcagttttttgaactatgatctttcataaactttctgtaataccaatgctttcgatgaatgaattaataatggacacctgcttagaagaaaaaaatgtatgcagaattttgtggtctgcttcctagattatacaaatcattacattttaatgagcatgaagtcaccacacggaggaaaatgtaaatgtgtaaacctcaagtttgccattatcttataagaatgggtgtgctaagttacttggcagctgaattaaaccttactctagagtagtgctgtccactagtaatataatgagaaccccatatgttaaaaacttttttacttactacattaaagagtaaaaagaagcaggtaaaattaattgtaattatgttttgtttaacccggtgtatattatctataatttcaacatgtaatcaatataaaagttattaatgacatttcattctcttttttttaataaagtcttcaaactttggtgtgtcttttatacttacagcacatctcaatttgaacaagccacacttaaagtgctcaatagccacgtgtggctggctagtggctaccatgttagacagtgcagctctggagtagggatcaggaaacttttctctaaaaggccagatagtaaatattttagggcttgtgggtcatatagtttctgtcataaccattcagttctgcctttggagcatgaaagtggccacagacatgtgaatgaacgggcatggctgtgtttaactaaaactgtatatttacaatagcaagtgataggctaggtttggcctgtggatggtagcttgcagacccccactgtggagcactgggtttataggcagtctctgctgtgcatgtggtttattgtttcttcttatgtctactacaaggatgagatacatggatagaaacactgggagtttaatgaaacatagggggcttatagataaatacttgctttttttctataacctgtagacttatttcctttgattataatgctattgacactttgataactgtttctctaaaaccttacaagaaaaactaagcttctctaaacttgtattcattatgggagaatgccattcttatgtctggttatatctgcattaggttattgatgatgctagtaacaatgaactttatgttactgcagctcacaaatgcttttttacatctgcaagaaattaactagtcatcaaatgcttagtagcacagaaattctcaagtggttgcgggaaatattgatctgcaggaataaatttcttcttaaaaataaggtaagcaaaatgacatatttaaaaaatggaagaatatttggaatggtaatggtgagagattactaaagtgttttatagccaaattaggttctatttcagcttctccttcctcccaatgttctcaaaaggaaatatgtatgcagaggacaatgactggcaaatcagcattttaaaaattattctgaggctttggccttagaaccacactgttgatgaattctagttctagttgagttaaataggtctctatggggcaggcctaggaaaagtgggggctgctataaccagagtagcttgaggagcatattgtatctttactcttaagttcatacataagacataattcatacataaaatttattttaacatatagcttctgtaatttaagaattctattatggcgtagatttgggagtacttgatttaatgggtttttgtccagttctagaatcatagctctgagaaatcgtaaagacctagatctcatggctagactagtccagagaattatctatcaagaagcaaaagggaaacagttgagggtcctcaatctagatttatttcgattcctccaataagggtttcacctcttgaaaatatcaggagactttttcattggggtggagtgaaatgttttgattctgaactattgaaacatggtgaggttgtggaagatagagaagagccttaaatttcttttaacatatagtttctgtaattaatcaatttaggaattctgttatggcctagttttcggagtacttgatttaatgagtttttatctggtactagaagcatagctgtgaaagaccttaaatgtatgaaactcatatccttttcagtatttacagcttgttattaataaattgtctctttagaaatagactaatggtgaagtgggtttattcacatgtgacttatttgatatgttaatgtagtggaatttggcattattccaaagatacagaaagagattagacttcagactttcatggcctcgcctatggtataatctccagaatgtgagtatgaggaatccagtaatgaattcatagtgccctggtaggcatagtcactcttgtgacatacttggtgtatatacataccagagttaattactggtccagaagaacttaatctcaagagccaatttctggttatcccaacatggcacagtataaaatcttatggaaaaaaaatctttgtcattgagatcaaattatagttttcatacagtagatttatattgttgatgttttactcatgtttatgtcagacttaatttatatttgtagaatctactgtttctgatgatttagagaatgggaaactgaaagaaattttaaagaattaagtaaaccttgtttgttctaatgggtttctagtgaatctccttcaagttggggcatagagattgagaggagaggttttttaggagagtctcaaacaggaagacaactcaaataagtgtttattcctcttggttgtcagtgcttcagtaaagcttatttatttatttttttctagcaggcagatagaagttcctgtcactttctccttttttacggggtaggatgtgatattccttctagtggaaataccagtcaaatgtccatggatcatgaagaattactacgtactcctggagcctctctccggaagggaaaagggaactcctctatggtcagcttcttctgtactttttctgtatcattttatgtgctctgtttgttttctgaatgaaatttggtaaatttcatctaggtaatatagtgtaatagtgaaaaactgcttagaatctagttctattactgctctttgtggaactttgggcaagttcttaacatccttgttcctcagttcctcaactttaaaatggggacagtaatagttcctgccccagagttgttaaagagggttaaataaaaggatgtgtaaatagcacttgacacttacaagctatatctgataattataattattataaacctccactccataaaaaacccattcataccacagaagtatagaattcgtaccggctaacaaaggtacagatttacagggataaaaacaaagtattttgcttcatgttaaagataagtgtttctgtgatttgtgtttgtgtgtataatttcttttaaatataaatcatatttcaagtgaaaatatcacatcattacagaagagtttattttccaaaccaaaacttttttcattcctaatttttaatgcaaccttgttaaggaagaaacacctaagcagtatgatatttactaatgtctgttttacttgtagaatttgcatttattttatcaattattttctccatttcgtgtttggagaataagtaattcagaatcaaatgtatcttctacagcaatatttagttcttgtttatgcccttgtttcaatgagtgctgcagtgtacttattttattacttccctatagcaagtagatagaatttcctgttacttcctctttttttgtcatttctaattgactgggaggtacattatattgttactgcagtagatttacgttatggtgtttacctgtccatgttagaatcagtttacatttctggaatctggaataggataatatctatttgatttgaaattgaacagatggtagcattatgttggtccagataatctcatttctcatttggacaagatattttggggtttgaaaaattcctataatgattaaaggaaaaagctcttgtgagttattgtatgcggagacacacacacacacacacacacacacacacacacacacacagtttattgcattgttagattttatacataaaattacccaagttgcaaatatatgtcttccacccttgactctcaggatagtgcagcaggatgcagcggaacccccccgatttgccgacaagcccagaccaaactagaagtggccctgtacatgtttctgtggaaccctgacactgaagctgttctggttgccatgtcctgtttccgccacctctgtgaggaagcagatatccggtgtggggtggatgaagtgtcagtgcataacctcttgcccaactataacacattcatggagtttgcctctgtcagcaatatgatgtcaacaggtaaatgtgaatagtggttttttttactcagtctgcctcaaagcacatggcatctgattttgagaatgtatttaaggtcactactttgtaagtttacaggggaaattcaagtagcttacttgaaatccttttctgaacaaagtaagatgaaaataaaaagcatttgaaataaattgttagtcttccactgagttgttaatatgctatacattttaaaaataactggcagtagatgttactatcagttatgattatgtaatttactctgcctaagttgtagatagtgaagttttacaaacattggcgtatgttttgagtaaattgtaggtgggaatagctattttattctgtggacattgtagagtccaagataagtacctttcctgtgaggttagtgaaaggaagtttttggctttatcatttgaagcatttgctctgctcttcctactccttttgggtggagcttatcaggttctccattggcaggcagggctctaagtgcagtaacttgatttgctgttgtatttgcttaggaagagcagcacttcagaaaagagtgatggcactgctgaggcgcattgagcatcccactgcaggaaacactgaggtatgcccttagcaacagaaacacccctcccaggcgcccaccctcaatttggaagcctcttgttacatatgtgtgatcaggaatagcttttgaagtaaatccaagatacgtgcatattacaagtataatatctgagtatttaatatacatcaagtttgaaacttggctgtagctgattgatgtttagctctagactaagttgctttcaagtgataattgccttcattttaggcttgggaagatacacatgcaaaatgggaacaagcaacaaagctaatccttaactatccaaaagccaaaatggaagatggccaggtaagtctgtaaagttgacttttgtctgttaactgatctgctaaatatatgtacttcactttgataatctttcaagagtcgctcagtaaagtaaacatatagctgtgtgaagactgatatttagttgtggtttatctagacctgtactttgtaatgtggtagctactagctatgtgtgactatttaacttaaattttaacataattaaaattaaataaaatttagttcctcaatcatatagtaaccacatcgcaagtaccagtagccacatatgacaattacttactctattggacagcagagagagaaaatgttcctgtcatcacagaaatactgggcagcactgctagagactgtttgttgcagagaccatttctttaccttttcttgctctttctcccttcatcagggtgtttcacagaattttcagaaaaggagcaacagaggtagagataaattaacatggaaacaattcattttgctattttgttaggtattctaattaaggaatgtcttaggcagtagattgatcccatagagtaaatgaaattttaaaatgtggacagttcattcaactattactattgactatattatctgttactttggaaattaatgatcagttagtgtttgtgtgtatttgatttgtaatgttcatattgctctcattattaggtgatttataaaaactggttgttcctccatggtgtttttgtcatgcttaattacaataggaaaaagttatatttttacgaagcaaatgtgtgtacctaatacctttatttggaggggacatgtagctttagaatgaaagcttttggggggataactgttttatataattacataccatacagttcacccatttaaagtgtccaattcagtgactgtttttaatgtattcacagagttgtgcaaccatcaccacaatcaagttttagaacaatttcatcaattgagaaaaaaaccccgtaccctttagctatctctgcctctaaccaccccccacccactttcttgcctctcttcccccaacgtctctagccctaggcaaccatgaatctactttctgtctttgtagatttgcctattccggatatattctgtaaatggaattatagaatatgtgggcttttgtgattagcttctttcacttagcatgatgtttccaaggttcatccatgtgaaatcaaaactttttaaaagaaatttgacactcggctgattatattagtgtatgataaaaatagatcagtggctctttaaaaatgtatatggtaattttatgggttgattttaatgtatattttacattttttgtacttttgtcatggaagaaatgttggataaagcataatttgtcaagtctcaactaattaaggtttaattcatgctttgcacaaaaattttgtgtttaggctgctgaaagccttcacaagaccattgttaagaggcgaatgtcccatgtgagtggaggaggatccatagatttgtctgacacagactccctacaggaatggatcaacatgactggcttcctttgtgcccttgggggagtgtgcctccagcagagaagcaattctggcctggcaacctatagcccacccatgggtccagtcagtgaacgtaagggttctatgatttcagtgatgtcttcagagggaaacgcagatacacctgtcagcaaatttatggatcggctgttgtccttaatggtgtgtaaccatgagaaagtgggacttcaaatacggaccaatgttaaggatctggtgggtctagaattgagtcctgctctgtatccaatgctatttaacaaattgaagaataccatcagcaagttttttgactcccaaggacaggtaaagtgttctcttatttttcacctttctctatgaatagagtgacttgtttgaaataagcctttttctttcagattatttaaattaggtactcacagtttttaaaaatttccaaaaaattgcagaaagaagagtcatctcaatgtaggggtcagcttgcctcttaggaactctggtgtgtatgtgtgcctaagggtatacgtgccctgtgtatgggtacgagtgtctgcgtatatctgtatgcttatttggctctatgcctgtgggtgcacttactctgtgtgtttagatcagtcagtttcatctctctagggggtctgtcttctgggcattgatggcaaatcattaatgtatttgttctttctttaggttttattgactgataccaatactcaatttgtagaacaaaccatagctataatgaagaacttgctagataatcatactgaaggcagctctgaacatctagggcaagctagcattgaaacaatgatgttaaatctggtcaggtaagcattctactgaaatgtagcagaaacattttaagagataagaaaaacctcttacacactgatactggtagtaattgataaaataactggccattctttactgcacacaaactagggtgtgacagtaaggtagccagaagttgtgtacgttcttttctaaataaatatcttattgttttcaaacttacatttaattcgttttacttgatgactaaagtatttagaatgccttctcttttgtctatatctgataatttttttattgtttctatgtctatataggtatgttcgtgtgcttgggaatatggtccatgcaattcaaataaaaacgaaactgtgtcaattagttgaagtaatgatggcaaggagagatgacctctcattttgccaagagatgaaatttaggtgagttctcaaaagagcaatgtagggtcttgtaaatcttaatatgtccaatgaagtacagaaaaagagtagatatgcggttattggtagaaaggaggacatgaaaagagagcaatttacatgtttgtttttctctacatctcttctcaaatttccctaagctttgtgcctgtgacaatgctccctttttctaaaactgtgctatacttgagctaagaatttgattctatttccaatctgataccataactaagggccatgatggaggataaatatccatgttgcttgttcccttctggcttttatgtctgtgatagcagtatctcttttataaagtcgtcatgtcacttaggttatctggcaaattatttgcactataagaaatcttacgtgactaaaggtgtgtgtgtggcttcaaaaacattgtttgctgtttctcttttctccaccattctataggaataagatggtagaatacctgacagactgggttatgggaacatcaaaccaagcagcagatgatgatgtaaaatgtcttacaaggtaaaaaaagaatgaccttcaagtattagtgggttttactgtgagagttataactacttaattacagctttatacttgtattttgtgtgtatttaaacttttgagatgtcaaacttttgtgtttgaaatatgtaaagatgctaatctttattactgcttttttttgactgatagactttcagtaaaattaaatgtgaaagagtgatatgtttgggaagttagtgttgtcagtttatgaagaatagtctacagttattgggaaataagatacataaagcctcagattgcatttgtgttatgattagatagataaaggtattatttgaggaactcattgtgttgaatctttttaagaaataattgatttcctgattcaagcaccagagacagaaaaaaaaggaagtaatcaagtctgctttaatgatacttattgacacatatcagaaaatgattaaacactatggactgtataataagcattcacatatgtttctttgaccaagcctagctttataatacagtcttctctgtcagggattggttccaagaaccactccccaaacccctgcccacatcttactcccatgaacactaaaatccacagatgctcaagtccctgacttaagatgtcatagtatttgcatataaactatacacatcctcccatatatttttaattatcttcagattacttataatatctaatacaatataaatgttgtataaatatttgttataccatattgtttagggaataacaacaacaaaaaatctgtacatgttgagtacagatgaaaccctccttttttttcccccaaatattttcaatccatgggtggttgaatccatggatatagaactcactgatacagagggcccattgtacatgcttctgatttaaggtagccattttgccaagattactttgtagaaagtaagtattaccttctccccatttgagatgattttgtattctgggatctgcatattaactcaaattatttgggttgtgctaataatttgtttaatgaaataggtagttcctaaggtttatatctgttagtaagaggtttatttgaggggaagtgaaagaacttgaaagattcatggtctctaaattttttttttttttttttttttttttcagagatttggaccaggcaagcatggaagcagtagtttcacttctagctggtctccctctgcagcctgaagaaggagatggtgtggaattgatggaagccaaatcacagttatttcttaagtaaatttcagtcaccaaaaaacataaagcaaaaagcaaataaagccccccaccacacaaaaaaagcaaagaaataatacccatgacaggactaggataggaaaataactgtgttttgtgatttttttaaagaaagtaatatgatcagtgaaattttgcttataataaaacccagattgcttcattaagtcatttacaaaagtgacattgtctaagctgtttggaccactaattttatatactaacattaaaagtgacacatttaccaggtaatattgcatctatttgatgctaatgttatgaaaggtatactaggctatatcaggtaaaatcatgtccaacatagcacacttcataataagccaccctggctgattatcgcgagagaggagagaaacagttaacccagggccattcacaccatgcacatatgattgttttggaatgtctggttagctttctagttgatacggccttcactatgtaaaggtcagtctttttatttctcagatacttcacattatttatgaaccttttgaatgactgcagtgaagttgaagatgaaagtgcgcaaacaggtggcaggaaacgtggcatgtctcggaggctggcatcactgaggcactgtacggtccttgcaatgtcaaacttactcaatgccaacgtagacagtggtctcatgcactccataggtgagatcaaatgaaagtttcatatagaaatacaaaacctagagaactggcatgtaagagaagcaaaaattacttcagcaaggccatgttagtaaatttgcatctgtttgtccacattaggcttaggttaccacaaggatctccagacaagagctacatttatggaagttctgacaaaaatccttcaacaaggcacagaatttgacacacttgcagaaacagtattggctgatcggtttgagagattggtggaactggtcacaatgatgggtgatcaaggagaactccctatagcgatggctctggccaatgtggttccttgttctcagtgggtaagtgattagagtaagcggggaagaaaagtgcctggcacatagcaaatccttcagaatatatttgttcaataaatgtttgttgaatgaattgataaaatttcagagccagaagaaagatgtttagttaggtgatttttcagctgtagggaagtggttggcaccactagacctgactagtgttctgtatcatttcatcctactaaaaaattccatttaaacgcattaaaaatcactgatctactctggtgtcttcatatatttgataaggtaattaggttaaacctaattttagttagttgttgcaatgctggaattggaatccacgatttgtgcctgtttactacctccagtttgctattcttttccccataatgtctcatacagttttttaaaaatttaagcactatatttgcatttgatattatgatattgtttattttaaaaactgaaagcgtcatatggctatgtctctctcttaatttaatgaaaaattttcctaaaatcacatcattcttaatacatgctaaaacgttgagacgggttgttgttcctttccagtgttaaaaggctatttgctttttagtgtaccaaaactgatttcagttatagtaaattatgactaataaggtaatctgtccttgttaacaagcctgtatttgttatacctgtacttaaagtaaaattcaaactccttaccctgtcctacaaggctctacctgatctgggccctacctcatctctaacatcatcttatgctattttctttcttgttcaccagagccacaccagctacctttctgtccctccttgttagacttatttctgctttagagcacccttgctgctgccaccacctgaaatgcttctcttctggtattttattttggtgagaacacctggcatgagatctaccctctaacagatttttaagtgtataatacagtattgctgtctgtaggcacaatgctgcacagcagatctctagaacttaccttgtataactgaaattttatactcattgattagcaacagccccaaattattgaaacctccttgaagcctaaatttcagaaatgttcaaatgttttgaaaatggatattctgaattatcttattagcatctacctataattagcactgaaaatagtaattttttaaataaagaatcagttaagggccgggtgtggtcgctcacgcctgtaatcccagcactttgggaggctgaggcgggaggatcacaaggtcgggagatcgagaccatcctggctaacaccgtgaaaccctgtctctactaaaaaaatacaaaaaaatcagctgggcgtggtggcaggtgccaatagtcccagctacttgggaggctgaggcaggagaatggtgtgaacccaggagggttgcagtgagccaagatctcgccactgcactccagcctgggcgacagagcgagactctgtctcaaaaaaaaaaaaaaaaaaaaaaaaaagaatcatttagttcaagtagctttaattcgttgagttttatattaaatgactttgagaaggaattttctgttaggccagatctcacctaccacattattgtaatccttggatcaggcaagaattagagagctatgagccatgatcctggcctttgttgttactgcttgaggattgaggcatctttttatggctacccctattatctataaatttcttcttatcatgtgattaaacagtgatttaccattagatcattttttcttgagtgtaccccaaactgttttactacagagagttataaaggatgtcatttaggtaatagatagaaatttcagccctcatccttgtgaccctagctttgtatgtaaatctggctcatctctgggttctgaatgcccaattccttttcttcctggtttctcaaaaatcctatagtctttctgtttttgttgtgtctctgcctagtatatattcagtattcgctgagttccccgactgtatgagaagagagtagaactcttctgatcatcaatcttatttctgctctgtgcaaatgcttgtacaaatcaaactaaattctttgctgtcatcttctgtttctgctctctttcattttgtgatgtaatttgagctgaatcttggagattttgtctcctagtaaagcgtaggcctctcttaatagcttttaccggttaatccttggaattaacagctatcatagacattgtatatagtcatctatcataaacaatgtacactgttaaatctcaggataaatattaatcagtcatcatttgccttaatttagcaagtggttgtcaactttgggtttacatttttgctactctttagcttcctacctaagaataaaaatgggattgtttgcactaacctgattttgttttgttctcaggatgaactagctcgagttctggttactctgtttgattctcggcatttactctaccaactgctctggaacatgttttctaaagaagtagaattggcagactccatgcagactctcttccgaggcaacagcttggccagtaaaataatgacattctgtttcaaggtttgtatcattcattttgtgtgtatgtgtgtgctgaggtatgtcaagtaatgattatgtacagaatgtgcagggctgattgtcttcttttaaggtaaaatatatggagcaggtataataaactcctattcgtgcatttctgtaggtatatggtgctacctatctacaaaaactcctggatcctttattacgaattgtgatcacatcctctgattggcaacatgttagctttgaagtggatcctaccaggtttgtcatcttttcacatagaaccgctgttttttgtttttttttttttgtttgtttgttttactaacactgcatgaagcaaggcaccttctccccttgatcattaaaattagtttttaattataaaagttatatacaaatacacgtttctttaatgatatctgtaatttttttttaaggtatccttttatttgccttagatccagggacaaactagagaaaggtgtctttgacttccacctccagagactgttactagttaagtctgttcccctgtcctttttccatgcatttacatattcatatgcagtcacttgcatgcatactctttttctaactcacttcttctatgatgaggagtgacttaggagaagggaaagaggctaataggtaatgcaggctgcagtttatttatttgtcatttttttaaaaatttgagacagagtctcactctgccattcaggctggggtgcactggcgcagtctcggctcactgcaacctctgcctcccaggttcgtgtgattctcctgcctcagcctcctgagtagctgggattacaggtgtgcgccaccacgcccaggtaattttttttttttttttgtatttttaatagagatggtgtttcaccatcttggccaggctggtctcaaactcctgacctcaggtgatccgcctgccctggcctccaaaaatactgggattacaggtgtgagccaccatgcccagcccagagtgcagtttaaaccaccatttctgtgaagctttctctgcttgttaccaggtactacccacgaacaaagaaatatgctttgttctgtgctgtgcaccaccattgtaacaattgtgacgatttatgagtttctctctcctctagactgtttgctcttttacatttttacatctttatatccttccatgaatatttagcatggtgtctgccttatagtgaacattttataaatatttgttaagtgaatgaattttaacggaatatcttatgcttgctttttctaagccacatgttaagatgttcttgtctgtctttcagttaggactttattttttacttttaagttcagagcttcttgatgattgttcttcctaaataatcattatttagcaactgtgtatcagttgatatttttggctctgcatttgctgaagtatcaactgtaatatctattcagaactccagcactaagccaatttttgttaaaatagttaaaaacttaaaagcaatttttatatttttatttacttcttattttttgaaatggggtctcactctgtcacccaggctggagtgcggtggcaccatctcggctcactgcaaccttcctgtgcaggactcaagcgattctcccatctcagcctcccaagtagctgggattacaggcatgcaccaccatgcaaaatacaaaatttttgtattttggtagagacgaggttttgccttgttgcccaggctggtctcaaactcctagactaaagagatccacatgctgtggcctcccaaagtgctgggattacagatgtgagccaccacgcctggccaaagcaatgttttgtaaagccttgtattttcttgccattaagcactttcagtttttttcttgacaacttctcatgtctactttttttttttttttttgcaattttcaagtgtacataatacattattacggattttatgttaattttgtgccctacaattttactgaatcttattattaagcaattttactttctaaaggttaaagaattacttagagagtgaaccagctgcttcaaataagtttactatacaaagtgctgtggtccagataagagaactagatggcaaacaatatactcaggttgcttaaaatcaaactgaggcccactctgacatgtcaagagcttgaaagtcaacactcctgtgttcacaacatgaaaaaagctaaaaaactgaaaatcagcagctcttagatccatcagagaatttaagtccactccaaaaactggagagacaggtaaatgtatacagagaatcacagtttaccaggagaagaagctgctggagccagtaactggtaggaaagcttagatcataattgacgagttgctggaggctgagcatggagtgcctagagagttaaaactcctaggggcctagtcttgcagggacccctgcacctttgtaagttttacctccagaagcctcatcaggctctcatggtgaagataggagaaaaatccctttatgctttgggcaggggaaggggaaaagtagccatttttaaatatgaccacagtgttctgttatccctagcaaaggtttgccctcaggagaaattactttaccagagctttatttgacttagaagttagccacctccagccccctctagcgtttctgtaagaagagagaaaaggctaagaaactctttgagtctggcctggtggctcacatctgtaatcccagcactttgggaggctgaggtgggcagatcacgaagtcaggagatcgagaccatactgtctaacatggtgaaaccctgtctttactaaaaatacaaaaaattagctgggtgtggtggcacgtgcctgtagtcccagctaccaggaggctgaggcaggagaatcgcttgaacccaggaggtggaggttgcagtgagctgagatttgcaccactgcactccagcctgggcgacagagcgagactctgtctaaaaaaaaaaaaaaaagaaactctttgaaggtcacactttaaggaatttggcccaataaaacaatggagatataatcagattgtagagtacttcccttccccagtatcccagttaacggggaaacccagggacaacaaaagagacagaaataagagcactagaggaaatgggcgcctacagttacagcgaacattaaacataacctaacttctaggcagattaacagaatgcctcacactaaagtccaatttacctcagttcctatgacccaatacatcttgtctggctttcaacaaaacattacaatgcatgctaacaaaaaatgaaaaattagtctgaggagacaaagcaagcatcagaatcagactcagatgtggcaagatgtattggaactttgaaattgtcaaactgagagtttaaaataactaatatgctaagggctttcatggaaaatggacagtgtgtaagaacagatgggtaatgtaagcagagacatggaaattaagaaagaatcaaaagagaaggctagagaaaaaagctgtaacagggagaattcctttagtgggcttatcagtagtctgggcaccactgaagaaagaattggtgaatttgtagttatatcaagagaaacttcccaaactgaaatgcaaagacaaacagaagaataaatgaaaatgaaaatacatcaaaatttgtggggtttaataaaagcagttgcttagcagtgttaaatgtatgttagaaaagaaaatctaaaatgaattatctgagctctcaccttagaaaactagacaaagagcaatacctaaagcaagatggggggaggaatcagaaatcaatgaaattaaaaataggaaaaaaataatgaaacgcaaagctagatctttttattttttaatttttatttttttgtgggtacatagtaggtgtttatatttatggggtacatgaaatattttgatacagacatggaatgtgtagtaatcacttcagggtaaatggggtgtccatcacctcaagcattgatcctttcttttttcttttttgagacagagtttcactcttgtcgcccaggctggaatgcagtggtgctatcttggctcactgcaacctccgcctcccatgttcaagcaattctccttgcctcagcctcccgagtagctgggattacaggtgcccaccaccatgcctggctaatttttgtatttttagtagagacagggtttcacaatattggccaggctagtcttgacctcctgacttcaggcgagccgcctgtcttggcctcccaaagtgctgtgattacaggcgtcagccaccgtgcccggcctatcgtttctttatgttacatacaatccaattatactcttttagtgatttttaaatgtacaataagttcttgttgactgtagtcaccttgtgctatcagataaccagatctcatttatattcttttgtacacattaaccatccccggtctccccttccccaccccccactacacttcccagcctctgggtaactatcattctactctctatctccatgagttcaattgttttaatttttttagcttccacaaataagagagcgcacgatgttgtatttctttgcctggcttatttcacttaacatcataaccttcagttccatccgtgttgttgcaaatgacaggaatctcatgttttgtgtctgaatagtactccgttgtgtatatgtaccacagtttctttatccattcttctgtggacagacacttaggttgcttccaaatgtaggctattgtgaatagtgctgcaacaaacatgggagtgccgatatgtcttcaatatactgatttccttttgtttcagtatatacctagtagtgagatttctggatcatatagtagttttatttttagttttttgaggaacctccaaatggtcctccatagtattatactaatttacattcctgccaatagtgtatgagggttcccttttctcacttttctccttgtcaccatttgttattgcccgtcttttggataaaagcaactttagggtgatgtgatatctcattgtagttttgatttgcatttctctgataatcagtgatgttgagcaccttttcatgtacctgtttgccatgtgtattttgtttgtgtgtttgtttgttttgagacacagtcttgctctgtcacacaggttggagtgtagtggcgtgatcttggctcactgcaacctctgcctcctgggttcaagtgattctcctgccacagcctcctgagtagctgggattacaggtgcctgccacgatgcccagctgatttttgtatttttagtagagacagggtttcaccacgttggtcaggctggtcccaaactcctgacctcaagcaatccacccgcctcggtctcccaaagtgctgagattacaggcatgagctaccatgcccagccatggaatatcttttttctttgctttattttcagtctgtgtttttccttatagatgatgtctgtttcttgtaggcaacagattgttgggtcatgggttatttttgtttgtttttaatccattcaatcactcttacgtcttttgattggagaatttagtccatttacattcagtgttattattgacgaggacttactcctgctattttgttatttgttttctggtggttttgtggtcttctcttcctccttttcttccttcctgccttccctttagtaaaagtgattttcacagatgatatgtgttaatttcttgctttttattttttgtgcatctgttgtatgtttttgatttgaggttaccatgaggcttgccaataatattttatgagccattcttttaagctgatgacaagttaacactgatggcataaagcagcaaacaaagaagcaaaaagaaaactaataaaaactctacactttaactttatccccctactttttaactttttgttgtttttatgtataccttattatactgtctgtatcttgaaaagctgtagttatttgtaaaaggttcatcttttagtcttctcaagatagtagttcataccacaattacagtgttataatattttgtgtatttactgttaccagtgaattttgtaccttcagatttcttattgcttgttaatgtccttttccttttgattgaagaactccctttagcatttcttctaggacaggtctggcattgataaaatccctcagcttttgtttgtctaggaaagtctttatttctccatatatgaaggatattttcactggatactgttctaaggtaaaagttttttttttttctttatcacttgaaatatgtcatgccactctctcctggcctctaaggtttccactgagaagtctggggccagacatattggagctccattgtatgttatttgtttctttcctcttgctgcttttaggatcctttctttatccttgacctttgggagtctgattattaaataccttgagttaatcttctttggtttaaatctgtttggtgttctgtaaccttcctggacttgaatattgataaatatctttccctaggtttcataagttctctttttttttttttttttttttttttttgagatggaggttcactcttgtcgcccaggctgcagtgcaatggtgcaacctctgctcactgcaccctccgcctctacctcctctttaaggccagtaactcttaaatttgctcttttgaggctgttttctagatcttgtaagcatgcttcattctttattcttgtctcctctgtgtattttcatataggctgccttcaagcttgctaattcttctgcttcatcaattttgcttttaagagactcttgatgcatatttcagtatgtcagctgcatttttcgtctccagaatttctctctggttctttgtaattgtttcaatctcttcgttaaatttatctgataggattccgaattccttctccacattatcatggatttccttgagcttcctcaaaacagctattttgactcctcggtctgagaggtcacatatcgctgtctctccaggattgatcactggtgccttctttaattccttcggtgggtcatgtttttctggatggtcttgatgcttatggatgttcattagtgcctgggcattgaagagttaggtatttttgtagtctttgtagtctgggcttgtttgtacccacccttctggggaaggctttccaagtatttgaaggcacttgggtgttgttatcttaagtctttggtcactgcagctatatctgctttaggggacactccaagcccaataacgctgtggctcttgtacactcatagcggtaccaccttggtggtcttgcataagatcctggagaattccctgggttatcaaacagactcttgttctcttcttctcttcccttactttcctctaaacaaacagagtcagtctctctctctgtctgtgtgtgtgtgtgtgtgtgtgtgtgtgttgagctgcctggagctgggggaggggcgacacaagcagccctgtggacaccagcactgggagtgcactgggtcttgcccaaggcctgcagtactgctgcctgactaccacctatgttcactcaaggcccaaaggctctacagtcagcaggtagcaaacccagccaggcttgcgtcctttcgttcaggcagtgagttctccgtgggtccagagatgccattcaggagccagagcctagagttgggtacatcagagatctacctagtgctctattctgctgcggctaagcattaagctggcacccaagctgtaagacaaagtccttcccgctcttccgtcctcttttctcaagcagaggagtcttttcccatggccgccatcgccccaggcccatggtgagtgctgcctggctaccactgatgttcactcaaggcccaagggctcttcattcagctcatggtgaatgctgccagttctgagtctctcccttaaggccttggggctcccctctaacccagggcaggtccaggaaagttttccaggagccaaggcctggaatctgggaccccaggagcctacttagtgccctaccccactgtgtcaagctggtacccaagttgcaacacagagtcccctttattcttacctcttctttcctcaagcagaaggggtctctctccatagccaccacagttggtaatgtgctgggtcacccctgaagccagcatgtctccaagtctcacccaaggcccacagcaagtactgcctggctatccctcctggttgttcaggggccaagggctctttagtcagcaggtgatgagttctgccaagactgggtccttccttttaagacagcagatttccttctggcccagggtttgtttaggagtgttgtctgtgaggtagggcctgaaatgggggcctcaggactctgcctggtgccctctcctactgtggctaagctggtagttacaagacaaggtcctctttactctctccactcttgtatttgaacagagggaaggcatctctgttggagctacaagctgagctgagctgcctgggtttgggagaggggtgatgtaagcattcccttggttgccctggctgtctcactaggtccaccccaagtccactggctctgagcccagcacagcaccaggacttacccagaaactgcagtccttgtgggcctagactgcctttcaagtttatttaggacctcagggcactttagctcttggtggtggggcttgctggaactcaggtttcaacagctgggatgggtgatttacctctggctaggtctgttctaagttctccatccttgagcaccagctgagctctgccctgtgttgctttctgctatgacagggcagcatttagtcctaatgcaaagtcccataatcactgtgctgtccgtcccccaaatgcagattttctttgcacaccacggggccactgccaggaggtgaaggaagggtggtataggtaagtcaagacagtttttcctacccgcttcagtgcctcttccttaatatgatgttaagaccaggtattgtgatcacttacctgattttcagttcttatgaaggtgcttttttgtatggatggttgttcaagttggtgttccaataagggggacgatccctggaggcctccattcagccatcttgctccacctccagttctcaagctagttctttgaaaatcaacttgggaaaagttttatacacaggaacacttgaataattgaacacaaatgttcattgtagttcagaattagtagaatattcaacaggttaccattggcatgtgggaagcaagagagcactgtggctagaaggtattgttttagagggaaacctgaaatggactgcagtgtacctgctgctatgctgactcaaaaaaaaaatttcacaaagtaggcaattgtcagggtttctagcagtctctttgagccttgttaaagaaattgttaatctcattcatacctaccaactcctagacctccatatcttaagatttggattactgttgtagcttaactgttctccctgcatataatccccatatttaggctgtctcttcaattagccacatattgcaagttcattttcctcctctggcttcctaacaaccatcagccattctccaatagataccaaccaggtgtccttgtgattcagttcaaccgtgacactgtttacctggagagagcatcagatttcccataggataagggctgagtaagattgctaccacttcagatgccaattacaagccccaggttgttacctgtgcttctcacaacttcaccttgagttggattaatttgctagaaggactcacagaactcaggggcatactttacttttgtttgcctacttactataaaggatatcagaaaggatacagatgaacagccagatggaaaagatgcacatagggcaaggcatgtgggaaggggcttgcagcttccatgctgtctccaggtgcactaccctccaggcacctctatgtgttcggcaacctggaagctcttcaaactctgttcgttgggtttttatggtgacctcattatataggcatgattgattaaatcatgggtcattggtgataaactcaccttcagcctctctcctctccttggaggttggggagtggggctgaaagtctcaaccctctaatcgaaacttggtctttctggtgactagccccgtcttgaagctccctaggacctcccagccaccagtcatctcattatcatataaaagacactcagcacttccagagattccaagggttttaagagcaatgtatcaggaatcaggagcagagaccaaatatatatttatcacaatacccttgaattattgtattgagtacttagtgtggaatacctggtctatatgtctttctcctttttgaaaaggtcaaaaggcaattgttgaatcctcagcacctgatactaagatggcagatagtagatgtgcactaaatatttattggattgattacctgccgcacctactttctctttctgaaatacccttacttcttttgtctatgcaaattctgtgcctcctttagaactcacctgttcaatgaagtatttcttgctttgcagtccatgctaatttctgaactcttactgtattcatatgctgtgccacacagcaaactctaaggaatctacagcaatgacgtaagtgtccaaagcatttctgtaatacgttaattaatatagaaacaaaattactaattaacctgttaaaaacaaatatttactcagtacttgctgtggtaaggcactgtgctagtctttaaggggacataggtaaatacttccttcaaggagcttacagtttagtaagagggataaaacacacaacagataagtggtgagtttcataaggggtgtattttgagagttcagattaggctagttagagagtaaaggtttgtggatttgattactattgggtaaaatttaaactacataaagtaggcattattagtcctgtattattgatgagaaaaaatgacacccagagaatttaaggattgtgaccaactcataatgattgataactgatagagctgaaatttaaacctagtaagtctgcctgcggaatctcttcctttaatcacaacatcagagtttagaggtggtactgataagagttagcaacactgggccgggcacggtggctcatgaccgtaatcccagcactttgggaggctgaggtgggcagatcataaggtcaagagatctagaccatgccggccaacatggtgaaaccttgtctctactaaaaatacaaaaattacctgggcgtggtggtggtgcgcctgtagtcccatctacttgggaggctgaggcaggagaattgcttgaacctggaggcggaggttgcagtgagccgagattgtgccactgcactccagcccggcaacagagcaagactccatctcaaaaaaaaaaaaaaaaaagcaatactgattggatatggggaataatgaagtagagcaggaaaaagtgacatcagagatggcctgaatgatgtgattaagaaagtgatagtgctattgataacatagagcacatgataagacataagagtacgaggaaaaatcagttaatttggggcatactgatttttagataccagtggggaggggacatctagcagttagaaatgtcagactggatgtgaaatgcagttcaagataggggaaacctgaatggccacaaaatatctaaaagcatgtctaaccttagtaggaactgtggaaatagaagttaaaaacatgagctacctcatgttttactcaactgctagattggaggggaataagaattcttatacagtactagttttagagctatttggcaatatctagtaaagttatatctgcatatactcaataactcagaaatttcatttttaggtagctgccttagagaatctcttatgtgcaagaatgttcattgcaatggtgtttgtaaaggtgaaaaatgtttaatgttcattataattagagaatagataaatcatggtatacaatagactattatgcagtaaagtgaactatatcttcatctatcaacatggataaatctcagaaacataatgtagagtgaaagatgaaagttgccttttgttactattgatgaaaaaagtaaagacctacatcattcagccgggcgtggtggcttatgcctgtaatcccagcactttaggaggccgaggcaggtgggtcacttgaagtcgggagtttgagaccagcctgaccaacatggtgaaaccctgtctctactaaaaatataaaattagccgggcgtggtggcccatgcctgtaatcctaactacttgggaggctgaggcaggagaatcacttgaacccgggaggcggaggttgcagtgaactgagattgcgccatcacactccagcctgggcaacgagagtgaaactccatcccccgcccccaccccccaccaaaaaaaaaaaacacctgcatcattcatatgtgtgtgttaattttttcatatgggcatatacacatagaggattgtgaattggaaaaatacatgatattcttgttttatctgtcccctctctcccccttttgttgcttgggtattttaaagcatatctcagagatcatgtttctaacatatacagacttaaacacacatacacgtgcatgtgcagcctgagtatttccacacaaattaaagttaataatcctgaataatatatctaagactagttttctgttaaatttttttcagttatctcaaagttgtctttttttttatttttatttttgagattcagtcttgccctttcatccaagctggagtgcagtggtgcagtcttggctcactgcagcctccacctcccaggttcaagtgattctcctgcctcagcctcctgagtagctgggattacaggcacctgactaatttttgtatttttagtagagatggggtttcaccatgttggccaggctggtcttgaactcctgacctcaaatgatctgtcagccttggcctcccaaagtactgggattgcaggcgtaagccatccagccctgtcaaagttgtcttttttttttttatagttggttgtttaaagattccaatgaagtctacacgttgcacttggcttaatgtctgtataagagtctcttttaaggagtgatttttgttatttgttttaaacaaaagtgttaggattttatttttatttttttgtaggttagaaccatcagagagccttgaggaaaaccagcggaacctccttcagatgactgaaaagttcttccatgccatcatcagttcctcctcagaattcccccctcaacttcgaagtgtgtgccactgtttataccaggtatgcttacagttagagattaccattattaatctaaagttaaattatgaagaatgctttatcaaagaaggatctagctgctgatggtgtgtggttaactataatactgagtcagtttggatgaataatacattgagaattgttggaattgtctttgaaaaaaacttaaatattacttaggcaacagtttgaagtaagagaatactttaaaatactaaattttacttgcattgggagcaagtttaaaatgcagtgaatccattgggtatgatggatgtggctgaaatgaacatattatggatttttgttgttgtcatctattaacctaaattatttacagggtgtttcacagttgaggcgggtctcctccttgctttttgcattgtgaattgcttgatcatctgtgattttggtttcttcattaatgtataattagtttgtgtcaggttttcccaggatagactgattgttctgtttactttatgtagcatatttcttaaaagagatactgcatcatcattcagaccaaattattagaccttctaacactagcactgcaagtaatgcgtctgaactcagaaaatagccatagtcatggccttcttttttagggaattcggtctatgttcttttatgtcttctactgtgtttttgaattgcacattgcagttttaggaattatttattccaagggaggtcctgcaaatgcatattagccttttggaaactgtgattctggaagaaacattagtgggtctggaatttgggataggggtggatataagggaaatacacagttatcaaaacccatgtctttgtgtctctctctttgcagagtcatcgcagccatttgcttttttagcacacggcttcagttgcttagagacgttaacagcatcattgaaatcaccattttaaaagctgtttgaggctgctctatgtgaattttttcaccattgctatttttaaagatgtatctgttctatctgtaaaaaagcttttcacggtatacatagatgataaaacatacttaaccttgtctctcttaatttatcatgacttttctgcctttacaaaaaggctcaaggaaacttaggaaaatcctgtatagttttttcaactagttaagtctgagtctaaagggtagtttagttataatatgaaacttaatacagtgaatatcttctcaagtttgggctgtattcaggtttctctttaaattttatttagtaattgttctattgatgaaactaggcagacaggaaatagcacatattaaaaatagtctgggtcagcttcttggttggcctagtagtaactggtttcagagagcaagtgggtttctaaaatgacagaggctttgactttagctggttaaaagtgaatggggactgactacatgattacatggtctaggagattgtagtagaatttcttcatgtggttgtcatcctaaaagaaaaatctttttgtatcatgagcaaagttggagaccgttttgagaccatgattctaataatgtaaaaggaacaggtcttagcacttatttagtacttaggaaatatttaatgaagaaataaatttcccatccctcccacctaagtaaacaagattcttgccagctttcacagctaagaaaggaggaaaatagtgaaaatagatttttaaacactatatgtggtgattattaaacagtatgttatgctttttagagcacttcacagtaaaatatcctatattattttaataacaaacctggtttattatgttaaaatttcacataaaattattatctttaaaaacatgaattaaaggtggtatcagtgcattgtttaagtattgggtaaaagcattgttgaagagcagagacagcatgctgtgttgttattaaataaggctttattttttaattagtaactggtaacagggaatgttacatttactgattagaaagaaagataggaaaaaagctttggtctcaagatagtattttattgagtctgcttcccaaacctagtttatttcttttggtttgctcttttgtttttattcatcttccctcttctggctttttcttgcccctttgcctttggcagtaacagaaaggtaccttcctgctcttctgtgttctgcctggagggatagtagtccctttgggacctactggggaaatgttgaaagggaagtgagtatattgctagctaataaacttccctggactttagctccttttttgagttcatatcttggcctttaagccttttcaaatcatgtgttaaccagctctattactttatataccttccttccttagttgactggattaaggttatttaagaatagccaactgtgaacatgtgtcagatttataattaaatcattttctcatgtgttgttttcacttctcctgatggttttaggataaagataaaatgattcccaaagtggatattctcgtatggtgagagaattctaagaactaatttatgattctaaataaatctcaccctttttcagtaaatctgcttctccaaactgaagtagtttacacacagttttaaggctataaatgatagttatataccactgttactaatacatttgtatatagtctaaagtttgaaacaaagctctgtgagctaaggggctgtgtcttgttgttttactgctatttcccaatgcctagaatggtatttgacctgtaggtacacagtaactctttggatggatgaatgggtgggtggatgaatggatgtctaactaacttaaagcccaagttatgggttatggtgttggatgtccagaattcccagaataagatgccatctatttgtggattaaataattctaacatggttttaaaaatatttttaaaataattattctgcctaggctagtccaatcaagagtcttttaattttgaaagaaatctttggtctagaaagagctctgagagatgaaaccaatatgtgcctggagttttgggggttttttaggtggctttttttttttttttttttaagatattttgataaatggtcaactgtaatatgtgaaaagttttaagcaggcctacagttttgttctgtaattttctctgcagtttcttcactttaataatattaatgcttcttactagttgagctgataaccttcttctcccaaatgttgcagagcttttaacctcctctgattagaaccatttcaggaagtagcctgcaaacattgaaaaatatgtgaaatgttaagagtaatcttttttagagagagaggtctttaattcagaatttctaaagtgaatttttatatttatccatataatttttatttctttattcagtaggatcataattaaatgccaggtgttggaaaaagaacttaaagtcaattgaaggatacacagagaagaattttacataccaagaaaaaattatgtagacacaaatgtttttagtgtgtgatctacttgtaatgaatattttatattacatttctcaaaagctaggaattaaccaaaatgtaaatatttaatatcctcaaattcacttggagagagtttttctgtgattcatagccagaaatagtagacatgattgggtctcaacatttcttgctgttttagtgcttggcttaaaaatgtaataaaaattaaaacccagaattaaaattcattcctcaaaattcagttgatttctaattttttgttgattccatttgtgttacattttatggtgtaattttatgtacaagccaacattgtttttgttgctgtatgtagtcggtgctgtgacttgtttgtgctcatctctgttctgtaggcaacttgccactccctactgaataaagctacagtaaaagaaaaaaaggaaaacaaaaaatcagtaagtttggagaactttttattagctgtttctttcaaagcaaaacaaaaatcttttgctgtttgttaagaatatcttcacttcagcctatttgaccttcactgtaaaatcattctactaattctggcacaaaatagctttcatttcaattaaccctggaattaagttacattgaaacattctctgtgttcctttggtttgatttatcccaaaggcaatttgtgggcatttgttgcattggatatccttggtctaattttattattgttactttttaaattataaatgaatgcaaagaaacttaatttcaaggccttaggaaacgctgactgtcttcattcttgcttcttgtttgaaggtaatgtgagtggtttcttttcccagagatgacagtgtttcttaattgttagaagtatatggtgggaaagagtcactttctaaatcttacctaaaagttgctaaattttatttttttactcttcatatttttatctaggcagtctcaggcataatttagatatttgtgcatagattatagaaattttaatggtaaaactacttttacctcaaaaaaataagaggtaaatgataagatagtacttttgagataaaagaaaactgagttcatatttgtagaaaaacacatcattctgcaaacataatgtgaatatactatctgcttctatgaacttgccttgatttatttaaaaggaagaaaattatgagagtcgtaattattttcttccagtgaatggaatttgtccaaaatataatatgcattcattttacatttgccattatctgtcacagtgacttatcaggctgagccctgtctttgttcatataatccaaatgattgtagagtaagatgtaaagaaaactaagtaggtagttttcttaaaagggtgtaatttagaatacagtgttcatctggtttcatctttcatgccttatctaaactttacatataataaaagctttatggctgggcacagtggctcatacctgtaatccgggcactttgggagaccaaggtgggagtatctcttgagcccaagagttaaagaccagcttgggcaacatagcgagtcgtctctacaaataatttttttttttttttaattagccaggcgtggtggtgtactcctgtagtcccagctactcgggaggctgaggcaggaggattgcttgagcccaggtggttgaggctgcagtgagctgtgattgtatcactgtactccaccatgagtgacagagtaagaccctgtctcacaaaaaaaaaaaaaaaaaaagaaaacgaaaaagctttacatataagtttctaagctgtacatataaattatctaagctttaaatatagatttttaaaattcaaatcaaaatttaaatttatagacatatacttttgttgtgtccattgaagattttatttttgattatattaagtaaatttgcctagctatgatcaaattgattggattataaagacgtttctaatgcttcagccttctaattctcagcatatgtgagtttaacataatgtacaccatcattgttgaaattaatttgctgcttctaacactcttgttcagtgttatactaatgccattttgtagtgtatcacataattaaaattcaggctttctgtgtttctctagagcatgttttctagcctttctaacactgctttatttattaagattatgtctaaaattgtttcttgaaatgtttttttttctactagagttattttcaaaaaatttttttttaatttctgggtaacaccaagttttggaatgtatttctcagcacaggtaatacgagctcctcatggaaacaaggggaatctaattggtaattcgagatattttagagtacattccaaagtatgaagacagtatactcataaatttaaaatgttgttttatggagttgtgtgctttaacaaaacctaatgatatttaagagcaagctgactttctttttgggtgtatatgtcatggattggaatatgtaaaatatagagagaagatctggcttctagtatatagctgtgtagtcacattacaaataactgtttattattctcaaatatatagtgtataatgaggtttactttgaaagttaactgtctgcctaactcagggagaatgcagtaactaagcatatatgggtagtaatgctcttgctgaagtgtagtttatgactacatgcattcgcgttatgtagtcagcttttaccaagggaagaaagggtacatttggctgataactggtctcaacacacagactggcccaagtttgaccttttatgcagaatgtcttttggatccaaattagatttttatggattaaaaaaaacactagagcatgtatgtattatgaggtaaaattacattgatgtcaattagtggtgaatgaaaaaaaaacagtccttttataagttgacttacgaaacttgttatgtagcatttttattggtttttaaaatcagtttttagttccaaaattatattgattctgccatcagtgatacatatatttatatgatacatgagacagtatgtgttcctgaggtgtcgatattttgggttttgacatgaattatttttaaagatgtggaagatggtaaaagtgtagtacttttcataaagtttacaatatgcttttgggaaatcactcagtttttcattaaattctgaggctgagtaccattaaatcaggtgtaaatatgagtcacattttaaaacttctttgtcctagagaaaaccggtaaatagctactttcaaagaagtattttgtctaattgatgataaccattacaaatttccttgttccttctccactcccagtgcttcattttactagcataaaaaataaaacagtattttgaaagctctccatgtgtttcacagcaggttaacattttataaactaactggttctttgaaaattaaactatgggttttagttttgtaaaaacttttagaattttaatgagttaaacgtatgagatgctaattcttttaaaataatctattttaaaataattataaagcagtttttaatccttttccctcctgctaactcactccttaaaggctttaaaatgttataggtttcttttgtctgcctttatttatttatttatttatttattttgagacagtctctctgtcacccagattggagtgcagtggcacgatggctcactgcaacctccacctcctgggtttaagcgattctcctgccttagccttccaagtagctgggattacaggtgtggctccaccatgtccagctaatttttgtatttttagtagagatggggttttgccatgttggccaggctggtttcgaactcctagcctcaagtgatctgcccgcctcggcctcccagagtgctgggattacaggcatgagccaccacgcccagccagagaattgtctaagattaaaatttgggagttttagaaaaccactcagtagcaatgatggtctatgaatattctaaaattatgtgaagaattttgtgtgtgtgaatgcatacattcatttttctaacctttatcagatttcaaagaggttcctcgtccccagaaggttcaacaccgtactggaatagtcaaagcactggaattttttcttaattttacatctttctatagttttagctaaaacttctgtatctaattctaaatgtatatatttgagctaaaaataaatggtatttaggttttaaagccattctaataaagcagctatatttagtcaccttcaccagtttccccttatttaagggttaaggttgttcttcatgcaataaacactgtaacataaagaaagcttcctgaactatgtgtagtgtaactgaagatggaactatattagttacaactgacctctttttatcacctcttacaaatattttctctaaaatctagtttttactaacttcctgttagagattatagaaagctattttgaggttataagcagtgataacacatttaaaatgtggactgcatgaagcactacattgaacaagatgaagtgaaataatccccattttttccagagttaatctggagtcagcctgtcataatttgtgtcataatttcctgtcataaattatgacaggaaatatttattgaagcattgtgaaaaaaatagctacgtgatattccgcatgtaaatctgggtcccctcccaccaatatcctttgaaatgaaggtttatccttgacatcacagaatattgagtggaatgctacagttttgtagtcactgctactttaaacagcagtttagccgcactaagcaagaatagctgtagagattaaaatgttacattaagtgttctttaaaaatgaacatatatagtatatataaaaatgtaaactgcaaaatataattttcatctatgacatgatttaaagcaggggactctggaaagggatgggagctgaaccagttttatagcactcttcccgagctaaggtacctttttatcttaatgtagaatgttttataaagggaaaatcatccattttaaatattgggttcacattgcttttcaggctggacaaccatttcttgagttcttaaattatttttatttgacagaattataaattgaggtagacataggggttctctcttctggtgagatccttttttcttttaggtccccaagaattcccatccctccatggtttaaataataggtaggttcttgtattataaaggaagctgtgaagaaaaggcactggcagtaacattacttgtaagtaagtttttttttttctcagtaagaatctaatattttattttgtatatggcaagcatttttttcttaaattcaattgtaactggtacacaacaaaatgtaaatatgtactatcaggtataggatgttttgggggtgtgctgttgaaaatttagtttcacgttataaagttgaccacactttcatgtctgttaatcttagtaaattatgatcatctttgtgtgaaaaatttggtctgctttcattactcatcaaacatgcagtataagtgatgatacagtgaagatcttttttcaggtttcttctacccatctcatccatgaggtttttctttcctctgagataccttaattgtactttaatatgatataagactagaattgagaggaaactttattttctcatgttttgggagaagaaaaaaatagaaatatgtcattcatgaggactgattgattcagagtttttatgcaaagtttgacctttgaactctttgttttcatgtctttatattaattcaaaccttatactcaattctcaactccttgtttttaggtggttagccagcgtttccctcagaacagcatcggtgcagtaggaagtgccatgttcctcagatttatcaatcctgccattgtctcaccgtatgaagcagggattttagataaaaagccaccacctagaatcgaaaggggcttgaagttaatgtcaaaggtgaattattttgataatctagctatcttaaattccccttccaactaaattttcagcttttcttacagtacttcctcttacatttatatttgaaataccctatggttttcagttatgtgcttttgttttatttgtttatattacaaaggaattcattagttaggtacctgatggaccttattttcatgataaaacattttattatagcagatgtcttgtgttatgaagatcattttttgcgtaatcattctagacattctgaaacagactagaatgtagactataggattttttattttaaaagtcattaaacatttttaatatgtatttttacatgtaaatataataattatatttgggaaggttagaaacactacctaaaataatttatagaatgaggaatgtttgatttttaagtactagcagaaattatatcaatgagaaaattcatgtttttaaagaatgtcttaatgtatagacttcatacaataaataatctgattatttataaccctgttttattgtgtagatacttcagagtattgccaatcatgttctcttcacaaaagaagaacatatgcggcctttcaatgattttgtgaaaagcaactttgatgcagcacgcaggtaattttcttgccacttactcagttgctctgtttgaatcaaatattttcggtttcacataaatccatgtacctgttttacatgaagttcctgtgtaagtttttttcttttcctgctctaggtcaagacatagcttgtcttattttattttactataaaagacagtcatgaaataaattaatattttttataatttggtagtgattttcatatttgaaaaccaagagggatttttgacatgtctaattaaataaaggatttgaggatggtacaatatgtggacaaggaagaagtaggattctttttatttaaaactaaaaccaaattggtatcaataatacataacaatgtttaataaggtttttttgatgttagagtatttgtgatacttaaatttggaagtgtatctaaactaaaatgttattctttaaaccaagtcaaacaaacacataagattttgtttatgaggaactgaactttatgattttagaaaacttttctgctagatttctataactagttatttcactttatttctctgagttattggtctatctgtaaagtagggataaactctttgcctgagttgtttttagagaaaaaaatgagataattcataagaaagcgctttgtaaatttatgtctggaattctgcttttcatgcagtgtgaatctaattgatcctcatcatctaagctagccttgtacaactctctcttccagtttatcatcattgtagttgttactgactttttttctgttagagaaattggagttgaaaaggtatattgctgaatgacaagccatgttggaaagagagtgaatgtcagcataggattcatattctggcactctgtgtacccatacaaagttaaaaggatcaaagttttaatcctggctctgacctagcaggctatatatctttggggaggtctttcgtctggaccttcatttccttatctgtaaaatactagcctctttccaaagtttcatccatcttaattttgttgttgtttaacttcagagcctactttgaagctgaagccgggtatcagaaatggaaagccaactttctccttgtcctttttgctttgtctaatgtcaagtcacattgtgtgaacaagccctccatatttgtaatcttagttacttcacaaagttacttcttataaatttaattcaaacataagtctgggtgtatctggtgttgaaaattctaatgactttgcatttttgaaggtttttccttgatatagcatctgattgtcctacaagtgatgcagtaaatcatagtctttccttcataagtgacggcaatgtgcttgctttacatcgtctactctggaacaatcaggagaaaattgggcagtatctttccagcaacaggtaagatttcccagtcatggggatagtgaacactctccgtttaaatttagattaatacaattattggtcatgaatagtgctttttactttgcatcttcttggactaagaattatggtttagaaagagaaagattctttttttcaaaaaaatacaaacaaaaggttaagtcatattaaataatcaacaaacctacctaggttccagtggtcattattattatttttttgtcaggttaagaaatcacagatttgctctttgggtttttatggcttgcagattgttatagatccaaagaagttcagattagcgttggcatttgactctgaagaacagccaattcgtaggaattcagtaattaaaatattgtcagtgttttaattctatgataaactcattcgtgatactcttaagtatatgcaaataaagctttatatagaaaataccggcctggcacagtggattacacctataatctcagcactttgggtggctgaggcaggcagatcacctgaggtcaggagttcgagatcaggctggccaacatggtgaaaccctgtctctacgaaaaatacaaaaattagctgggcatggtggcaggggcctgtaatcccagctactcgggaggctgagccaggaaaatcgcttgaacccaggaggcagaggttgcagtgatccaagatcgcacaattgtactccagcctgggccacaagagctaaactccatctcagaaattaaaaaaaaaaaaaaaatacttaaaaatcaaaattattaatttgggcattgtttcattagctcttattagtctcttgtgtaacataaattacttgctgtcccatctagttatataaacttgtaaagggaccaaattcctatgtatgaagagttccttacaaaggaagaatgagtccaaattatttttaaatgccaataaaaatgattagcacattcacgggaaaagtagtggactgtgaagctaagggtaagcaattgggagatgggagtttaaatgacagggcattttaatcttttatgaattattaatggattgaagtagacatggtcctgaggtctttttggtgctgtttacaaatcagctgacagtaaaaggaaaagcaaccagttacaagttaaagaaatgtgtagtgctaaatgtgaactgctaattttttttctaagtagtttgctgtatctagggatcataaagctgttggaagacgaccttttgataagatggcaacacttcttgcatacctgggtcctccagagcacaaacctgtggcagatacacactggtccagccttaaccttaccagttcaaagtttgaggaatttatgactaggtaaagtacaaccttgaaatagttgattgctttctttttggttgagaaggagagtttgccaccaggccacttgttagatatgatagaagactatgaggaaagatgtatttaataatcacattgccatgtttggggaatccaactatatattatttatatatatagggtgtgttttattttatatattgattgtcataacaatagtaacaaatcatattttatcatcttgctttcataagttttcacatttaatacttaccagggagtgaagacaacattattttcaaattatagttaaggaaaatgcaactcaatgtgaataattgacttgcctaagattccacacctgattcataggtcttttggttttaagtgcaggacttctctactacactataacatttttcagaaccctcataaaggttaatggttttaaattatttcagattaaggttcagaaaatatagtatacttcagtattgctataaaatttctgtggacatttgtttgaatcccatttagtgggatttagtttgtgaatgaaaagatcctcattgttagacacttactctgtgatgatacagtgagagtagtttgctgaatcttttaaagtacctttcacaggactttatgcttagtaagtgctccttcgtgtctgtgatttgagtgctatgttcatagtatgttccaaaacagaataaaacagaatctgatgatgagaagttaaagatttgtatataatatgccttgaattgtaagtgcctgttgttagttgtattacttacaggtcatggttttgtacatataactccaaaccattgatactgttaaaagaatatatgaatatatgaaagaatgtataaacataagaatgtatgggtatatagtgtcctttccaaattaatttttatttttagctctactagattttttttagtgtaacaaatgtttattcctatgtaattaagggcatattttccatacagactattcacattacctaattgaaaattatatactacaaaaatataatactatttttaggccagacatggtggctaatacctataaccccaacattttgagaggccaaggtgagagaattgctggaggccaggagttcaagaccagcctgggcaacatagtgagaccttgtctttattagatagatagatagataggtaggtaggtaggtaggtaggtaggtaggtagatagataggtaggtaggtaggtaggtaggtaggtaggtagatagatagatagataagataagataagataagatagataagatagatagattgggcacagtggctcatgcctgtaatcccagcattttgggaggccaaggcaggaggattgcttgagcccaggagtttgagaccaccctgggcaacatagcaggactccatctctacaaataataaaatattaaccaggtgtgatggtacgcacctgtggtcccagctacctgggaggctgaggtgggaggattgcttgaggatgcagtgaactgtgattgcaccagtgcatttccagcctaggtgacagaatgagaccttgtctataaataaagaaataagtaaaaatataaataagtaaaaagaaatataagtaaatataaatataaataaatataaatataaaaatgaatgaatcaaaacagtttttaaatttgacatcactgaggacatcctagccatttttctagaaaaatatttttattattccttttttctgagatcctaccttcccttacaaagcaatcttttgtgcttttgaagattaagtaatccaatatatataatatacttagcatagtatctggtacttgtaaagtaattaataaatgttggatcttatttttgttctaaattcccactgatgctcttggagacccattttcttttttttaaaaaaaatgaaggtagctttataatattctcagttatttaaaaaattattaaattacttgatatagaaatctaaagaaagttaaaaaaattaaaaattgtttatcctccctctcagaatacttcacttaacgtttggtgaatagtctcccagtcatttatctatgcacatgtacatttgtttctcctatcaaatgatatctaggttgtttccattaatatttttaaaattctgacctggtaccagcagcatgatgggctgagctaatgcaatctcttcccaagacataaggctcatagaaatactaggtgtaaaagaaaatatgtgtacttaaaaaaatttaggccgagtgcggtgactcacgcctgtaatcccagcattttgggaggccgaggtgggtagatcacctgaggtcaggagttcgaggcaagcctggccagcatggcgaaaccccatctctactaaataaataaatatatatatatgaattagccaggtgtggtggtgggcacttgtaatcccagctacttgggaggccaaggcaggagaatcatttgaacccgggaggcagaggttgcagtgagccgagatcgtgccactgcactccagcctggtcaacaagagcaaaactccatctcaaaaaaaaaaaaaaattaaatttatagctgaagctagtttctaagcaaattacctagcatacagtcagtatagacagataaatggaaaatatgaaagaggttaggagatgcagaagataaaatgaggaggttcaaaatatgtctagtaggtgttccctagaaactgagctcagtgagaatgggaagaagtaatatttgaaaggctaatggatgtatgttttctagagttgatgaatgacatgaatcttgaggttgaagaagcacactgagtcttgagcaaactatataaaaattaaaccaggctttaatacatatgggaacataatatatgctaaagctggtattcagaatcgagattaggatggactttcaataaatggttttgataaaactgagtaatgatttggaaaaatattttcataccatttatgataaacttccataaatcaaaaaaaatgagcaaagcaaggcctttttcatccattcaaaatccataaactagaaaagattgataaaatgaattatttaaaaaatcataaacttctgtctgggacaaaaatgtcatgagtaaaaccaatcctatggttaatattcttgcccagtagttctcttagaatagtcctaaaagtgcttttgtggttcaaagagtaataccttgaaatttttggtgcatgttgccaaattaccctttagaatgcctgttgcttttaaaatattttttcattttagtattttattgtttatccaattatagacttttttacatactcagtagacaacataaagcctcataattactctgttatttttcttttaggcatcaggtacatgaaaaagaagaattcaaggctttgaaaacgttaagtattttctaccaagctgggacttccaaagctgggaatcctattttttattatgttgcacggaggtaagaaatactatgttttgggtctcttaacagaattttttaaattatagcaaatatagagagatggcaagtttggtttttcccagttgacttaacaggaattgaagacaagtttacttgggagcatatagcagggtaaatagcctgcgtttcctaaaatgatggtcggtatctagtagctgcttttcatactacccatttcatattgcttactctgtcctacatcattttttaaaatactgcctgcaatggattaattaccaagagttaaaaacccacaaagaatcttttgttttcaagtatattctgattaaatagtactcacaacatgataactgggaactttttttaaaggaagaaataaaactataagagcctatttctgagaacttttaaaaatatgctgtgtaagacagcatcaggatgatttaaaaaataattcaaaggagtggtgaaaaatctctatgaagatggtgcaaggggtggcctggaaaacggtgcttgttcatgctgccctcagttgaggctagttcctagaaagcctttctggaaatgttgtgagctcttccttaataataggtatgatgcttgccttgctttccctaccattgtcttttcttttttgcttcattttaccttccttttgaaaactcaatctgtgacgttatttggtcagttttactttttcccatttaccatgacatacattcatggtaattgagccttagagacaacatgatacatagagaaaccactgactttggaatctcaaggaccatgtttagacctagttctgctactcattagttatagacttaatctttaccagtttcctgaatttaacagtatttaacatccatgaccattaagttagtagacttacattgttagtcagcttgctggccacaggtggcagtgtgtaggaaacaaatcaaggttgagaaatagtagagagacggtgaaggaagatcagtggaagatgggaaacttgtctaatagggtcattcagatagccttaagaccaagaagtccaaaggactggagtattagggaatcaagaaagtaagaaaattgcattgaacctcccgccacccccctgccctttaacaactctaagtaacccctgctcaccttcccatgaaaggcctctctccagctctcatctcagttgccatttctaaattgcctaagatcattttaattttcgtttgcgtttgagatgaaccatatttgtattctaaccccaacctttaatacaaccaggatatttttacttttccgttgttgtctaagtaaaaagcaaacattggtaagggaggtagaagatgtgtttccccctcttctttaaaatcttattagtttacaaatagcaaagatttctggaaaacaaagctgcgtttttttttttcggaatcagaaactgttatatttgtattccctctctgtggtgatctagaaaaagctaaaggaaagattggacctgctgcagatcccttagtgagattcaatcagtttggtttccatgaaacctattgagtcttgtggcctgagaatgctaagaattctcagctctgctgcttattagctgcataatcttttttttttttttgaaatggagtttcactcttgtcacccaggctggagtgcaatggagcgatctcggctcactgcaacctccacctcctggcttcaagtgattctcctgtcttagcctcccgagtagctgggattgcagacatgtagaaccatgcgtggctgattttgtatttttagtagagatggggtttcaccatattggccaggctggtcttgaactcctgacctcaggtgatctgcctgcctcggcctcccaaagtgctgggaattacaggtgtgagccactgcacctggccttagctgcataatcttagataagtttatttttccaaatctgttgcttcatatgttaaagctggggtatgtgcttataaaaactgtctacctctcctataaagtgttttgtgacctataaagttgtgtaaggagtaaatttgagattttctttttttctttcattctttttttgggggatatggcactgtcagtttcagattttcaatccttttagtttcttacttagacctactggagctcctcctgaccttcattttcacctggtgtgaagcctagctccaagacagatgagtacacagtatatcagagcagagcatccatttactccattatgaaggtcttgtctgtctgtatgccgtcagttttgtcaaagagcacttgggtttgacttctcttttgatattcctgtgtttctgtggcttagactactatgtattaagtaatgctttttgaattgtggattttctaatttccttatcgatggtccacagacgtttcagacttgaaatgtccaaaacttaattcagtatatcttcaaatcaacctcctcttcacaccgtatttctgtttctcagtaccatcatcatcccttctagttccccatctagagaccctaatcattttaaattctttcctcttattgtctttctcattgttagtcaccaaatcttggttttacctgtgagatcctgggcaatcagttaagttgttttagttaggcttttattgcaaagcagtcatttgtattttctcaaggatagtttttaggaaaagcatgaattagcgcagagcctacccagatatagagaactagatggctgtggtgctggaactggctatgctctttgactgtctctcggttttgtgttcaactcttcctcatgattttcatctttctgtatcctttcagcttttgccccagatagtaacccgttcattatctcagtactgcacatctgaaattccagaaagaaaatatgattcagctaaaaagcatctctgcttggcagaaactttaatgttaggttctggccagccagttgattactggctgcccctatgtccagtatgtgctcctggcccagcagtcatgtgattcaaaatgtgaccacttggctgggcgcggtggctcatgcctgtaatcccagcactttgggaggctgaggcgggcagatcatgaggtcaggagatcaagaccgtcctggccaacatgatgaaaccccatctctactaaaacacaaaaaattaggcaggcgtggtggcacgtggctgtagtcccagctactcgggaggctgaggcaggggaattgcttgaacccgggaggtggaggttgcagtgaaccaagattgcaccactgcactccagcctggtgacagagcaagactctgtctaaaaaaaaaaaaaaaaaagtgaccacttggtgctgtttcttcatcaggggctgttcttaggtatgtgttttaattttttttgttttgtttttgagacagggtctcactctgttgtctaggctggagtgcagtggcactaccatggctcactgcagcctctagctcccaggctcaaacaatcttcctgcctcatactcccaagtagctgggacaacaggtgtgtgccaccacagctggctaatttattattattattttttttgtagagatgaggttttgctatgttgcgcaggctgggcttgaactcctgggctcaagcaatcctcctgccttggcctcctaaagtgctggaattacagatgtgagccaccacacctggcctaatttttttttttagttggaccttaatggtctaatattactattacgtaccttggcaatgtctttcgaaaccattttcccccactgctttgctggaactctgtgtcttacctatactaatgtagcattattctcctcctccttcatcaccagttgactacttctaggtaatcttaacatttcttctggagccagtttccagtagaaagcttgtctgtcccattgactccctgtataaagtccaagttctgtagtcaaacatgcaaggtaattttggcctaatgtacttttctaatcttttccttctattccatccaatatacttatgctcttgccctgtggtaaggtagcataatacaaggacattgttgcaacattgtttatatagtggcaacaaaaaggaaaacaatagagttgtgtttcaaaaggggaattgttgaataaatgatgatacatttacattagggaataaggcaatgtgttaattttgcttgttacaagtgacagaaatgcaattcaaatttatgtgtgccaaaaaggaatttattgactcatgtacctaagaaaatcaagagatgtattagtttcttgcatgactagctgcagagctttaaacagtatcatctgcagaacatctgtcttctctggctcttaactctactttctttgtgtcggttttattcccaagcagctgctccctagctgtggctggtaatggtttgtgttctcccagcttaacaatcccagaggaaaaacacctctttcccagttttgtggtttcagcaaaagtggttggtcttactggcctggtgtgagtcacatgccattcctaaggcagtcactatggcaagggggatggaatttcttggttatctaggcctggatcatgtgccccttcctggaatgcagtggtaaagccagccctatccaaattgcatgaactaaaaggagggcatgggggcagggttttcacaaaggaaaattgaattgctgttactagaatgaggcaaaatggatactgggcaggcagaagtagcagaagtcctctacatccagctttaaaaaggcccagaaagatgactctgacacttaccttacaaggtacacgacagtgtgtgtgtgcacctgcacatgtgtatgtgtagactgagaaatgtatgaaagtatacatattaactgttcacattgcttatctcagaagtgtgattggaggagatagaggaccaatttaatatttctgttatctatctctatgttgtttggcttgccaggagcatatattgtttttgtaagaataattaaaaatataaaaccccaaagtggccgggcaaggtggctcacacctgtaatcccagcactttgggaggccaaggcggggaaatcacttgggctcaggagtttgagatcagcttgggcagcatggtgaaaccctgtcaccacggaagaatacaaaaatcagccgtacattgtggcatacacctgtagccccagctactcaggaggctgaggtgggaggatcacttgatcctgggaggtcaagactgcattgagccgagatcacaccactgtactccagcctgggcaacagagtgaggccttctctgaaagaatacattaaaacaaaacaaaacaaaaaccccaagttacaaagaagagttttcctcttaggaatattgtgatacctggcaattgctttttgggtggtagtagtaaataatgataatagctaacatttcctaagtgctttctctgcatcaggaaactgtgcatattacataatttctcatttaatctacataataaccttctgagatattattaacaattaattgacgtacgtataaactgaaacccaaacatggctatcagaatgatctggaacattaaaacaaacatatccccagcccccatttccaaaccaaaatctcaggggcagggccttatttatatatttaacaggcactccaagtgtttcatttattactaaagtttgggaatctcactgggtcatgtacttaattcatggtagcacaactagtaagaatcagaattcggtttcaaacctaagccaaagctcttaacaaatgcactattaattacatgcttattactattataattgtatgcttgggtaaatctttgtagatgagcatgaaaacctaaccaacagttatgagatatattactctggggaaaataagttctcgattccaggcatctgatttacaaatggttttttgaaacataagacaagagtgtactcaatataagataatcttgtcattggcgcaatatcattatacattacaaaggttagcagaattggcaccttttcttagcgaaatgacatattactattaacacattcatgaaatatgttaatacagatgaatgtgttattttgtagagcgctttagtttatcagattagcattttttgtctgtttaataaaaaataaaatatagaccgggcatggtggctcacacctgtaatctcagcactttgggaagccaaggcgggtagatcccctgaagtcaggagtttgagaccagcgtggccaacatggtgaaacccctctactaaaaatacaaaaaattaatcgagcgtggtggtgggcatctgtaatcccagctactctgggggctgaggcaggagaattgcttgaacccaggaggtggaggttgcagtgagctgaggtcatgccattgcactccagcctgggcaacaggagtgaaactctgtctcaaaaaaataaaaataaaatacaaaaacaacttcccccataccactccttatcccacacccccatcctctatcccctatcccctatccttcatctctctgtcactgttgctcactcgctctctcactctcatgtgtgtgctctctctcacatacaccacacacacacacacaccccacctacataatttcttctcttacacctttaatataaatatctgagttttggttcagttttgcaaacatttaaaaggcaaacatggtattttgcttgtttcagcatttaataaggtagtgcatacttctttcatatggaaggaaaacatcatattaagttaatatttaaacgtacacaattataatttgcaaaaaaaaatcaagatgataatttcttaaatagtaaattgaaataaatgatattttcctagcatgcttgtcattcagcaataataagaaactgagataagaatgcaggcagttgaagttcacttcagcctgagtgcaagtatacacaaaacagcaaaaatattacatagaaaataaatgttgtccattggattgagtatggtgctaccatttgtcacagtgttcatattcatagttgtggctatctttggggtcactgctgtattcagacttgtcttggaatttggagtcatctagggatttgaggtcattttgagatttgggcttgtcccaggattggtgctaccatttgtcacagtattcatattcatagttgtggctctttggggtcactgctctattcagacttgtcttggaatttggagtcatcttgggactcgaggtcattttgagatctgggcttatcccaggattggggttcattctgggattggtgctcttcctgggattaggtctggtcccgggattcaggcttgacgcaggattggatactgccatagaatttgaggttgttgatgttgaagtttgtccccggaatgttaacaaacatgaagagcaggccaatcggtgatagcttgaacatcatcctcctctgtttcacaataattatataattttaattgaacacttggatcacaaataggcaagcatatatccttaattgtgtttatcagtacatttgtgttatgtaaatgtttgctttttcactattagtgaacaaattaaaagcttccctttctttgttgtcaacatctgctgacacaagacctattttctattgagggctaccaactgaaggcaaaaacaatcccaagactgaaaaagagcttaattggcatttttctatttaaaaaaggaaaaaaataaaactctagacattcaatgcaataaatatgggggcttgagatcagtatagagtagggtaggggcaaagactgagaggcaatttgggacagtagagcaacaaaagaaataatgaaataaatattggtattttcttgatttctcatgacctttattccaacaatttaaggttttagtttaggtcacaaattaggatattacttctaaatatttacccaaagactaaagaggttaaaccaaagcatttccccagtgctgggatgaggttttcttcattaacaacaacaacaacaacaataacaaactagagaagttcatagttttaagatttagaaatgaacaaaaccaactccttcattttgcaaatgggctcagacaaggggcataacttacctgagggtgcatatctaaaaatgacccaagctagaacttaagtctgtgacttaaagcccaaattttaactgtagaactctaacatatatattaaaagttacatttggctctaatatgtaattgagaacatttcaaattaatgttaccttttgatatttttctttgaagagtaagaattcagtctttctccagcgtctatggggaatctgatttctcactcactgcatgctatttaaatataattagtgaggaagtcatgtgttctaaacttgacctgccatttgctctttggaagtatccaactgagtgtttccagacaactacatataaacagatagactttggcagagattaaagaattcaaataaagttctaaaatctgcttgctaatttaaagaatccagtgaatagcatttgttattcctcttaccatgtatacattaatgaattgcttcactggattgactctaactagatgaatttactattttgcctgctgtgattattatgattttaaaccaagtaagtgtattaaaggtgtctgcgttttccttagaacatctgtacatatgtttatagggcagtttctacccatggttattttgaagtttaaaaaataattcagtaatacaacatttcaggtatttaatttttggtaaataaagtaaccttagaaaagaagttaaacttcattaatatgaaacttaagaaaaggattacatatgaaagtgatactttttcatactgagtttacaaacttttgtgtgtttgtgtatggttttttaatgtattaaaccagtcaccttgaagtgcataaagtaaattttttgaaggaattttgtcttttggtcagccgttttccatgataactagcatatagggaaattgggttgtattctgctaatgttttcatcatattggccagcacactttaaaaattgcaggactgtgaacaatggtgttgacatacaaggaaattgcaacataaatggcagaagtacaagccagtacatgttcctcacttgttttactgtgctgtgaagatcatttttcccctgaatgaataaaccatgaatagaaccatgcttggtaaatcttatttatatggtacatataataacttcacttaactggaggttaatgtggtcagatctaagaagtaaacaaacaaaaaaaaactacttggcaaccagagtagatattatgaatcggagtactgcagtaatttacaggagtttgtcattgtcctctctctgctcacttgctcattctgtggatttctttggggggtatatagttggtaatagtaatagtaatagtaatagtaatagtaatgtttcgaacttgagcaaactgtgacttattctatttttctaatcttgaccttttgagtactacacttacacaactctttattgatgcttcaaacacctcagtctcaacttgtttaaaattcagaagttagtgttttctccttcctatttttgtatctagatatattcttctcataatctcttggttaattgtatcatcacctagccaaatgtttctccaacactggatttctcattatcttctctttcttatttatcttaagctctccaggcctcttcatgatgattaagtaaaatttaaattctatttagtactcaaatgttcccaaacaaacaatagtcaatttgccattattcaggtcttcaaatacccaccaactttgtatctttgtgcagcctccccaacttgcccaaagtgtaataatagccccctcttatcctaagtttcactttccatagtttcagttacccatggtccaccatggtctgaaaatactcaatggaaaattccagaaataaacataagttggatgtatcatgaggttaatagtagcctagcactgtgtcacagtgctgcattagtcaacccacttcatcttatcacataggcattgtgtcatatcacatcatcacaagaagggcgagtatagtacaataagatattttgagagagatgccatgtgcatgtgcttttattgtagtatattgctataacttctattttattattgtttttaatctcttactgtgcctaatttataattaaactttatcacaggtatttctgtataggagaaaaacacagcatatattgggttcaatactgtaattctgtggtttcaggtatccctgaggggtcttggaacatatcccccacagttaagggggtactactgtactttcctcattcaaaattgtgttgtttcttcaagctccactcatgtcagcaccttttatacgatccttccctaattcttcacgtcagaatcagtcattttagtactttatactttgatcagagtctcattttcactaaagaaactaaatcttccaccatattctggctttttttgtggtaagataccacctcttattccttctattccctctagcttctaatatagtgagtgtttataaagaataggacacagggccagttataaagaataggacacaggctcatgcctgtaatcccagcactttgggaggccgaggtgggcagatcacgaggtcaggagatggagaccatcctggctaacacggtgaaaccccatctctactaaaaatacaaaaaattagccaggcttggtggtatgcgcctgtagtcccagctacttgggaggctgaggcaggagcatcgcttgaatccaggaggtggaggttgcagtgagctgagatcgcaccactgcactccagcctgggggacagagcaagactccatctcaaaaaaaaaaaaaaaaaaaaaaaaggggcacaataagtattggaattcattgaaatacctcctgtttctccatgtcggagggctggtatcattaatgatgtctaaagtaagagttatttggttatttgcagttttcccttcacattagcataaatttggaaggcacaggcttgagtttaactttcatctctactttcctggctgctgttttgagaagatttcttcatttgtacaatgtggatcataatgcacattcataatcccttgtctgtaatctgaaaccccaaatcctccaaaaaccttaagttttatcaaaaaataaaaaagtttgacaccaaaatttatttggtgcaaatgccttatctgcatagatgggaggtttttagctatctttgtttcacttagtgtggatattaatgttgcgctgcagaaatattgatgagattgattttggggtgctgttccattttctactggagtgttacataatacatgataagaatagtacttagcatattcatgtttctcttcttccttctgggcacagcaccataccactcttagcattctgatagttaggtggtaccatctgactgagttctggccagtaaaatgtcagttccaatgatgtacaatcgacccttgaacaacactggggttaggggcactgaatctccacgcaatggaaaatctacgtataacttttgcctccccaaaaactaaactactaataagactgttgatcggaagccttttgataacataaacagattaacatgttttgtaagttaaatgttgtatatgctatattcttagagtgaaataagctccagaaaagaaattgttacccagaaaatcatgaggaagagaaaatatatttactgttctctgagtggaagtggattatcacgaaggtcttcatcctctttatcttcatgttgagtaggtggaggagaaagaagagggattggtcttactgtccccgggctggcagaggtggaagtaaacctctgtataagtggatcagcatggttcaaagccatgttgtttaagggtcaactgtatatgatttttaagcctgatgtctaacttctcaccaatcttccattcttgctttcttctatcaacgcctactagaaacagacggttcagtggagggggtctccaagacgccagaagatggtaaaaccattagaaagcatgatttaagagaaattaacttttgttgtcttagccagtgatattttgggattatttgtgacagaaattagttcgtgctgactaacataactacatgctggacatcttgcctttgcctcttcaaatccactctgttctttaccctgctgtgtaccctaagaggctgacctgtgtagagggtatcattgggctcccctcctttctggctttcagctggcccatagggaatacaagcggaagattagggagaagaaagagagtaaggttaggaggtatatatttttggctccgtttctgcagggtcccagtgggctggctacatccatccatgcagtatggtttttgttgggtgaccctctccacacaacctactctgtgtctgctttctgctaactgcttcctgcactcactacttcaggtgtagtatcacactgtctcttaagagtttccttaaaacctgccttctcctttatacataatctctaatatctcagtttgaatttgccacctgtttcctgctagaaccttaattgctacaagctgtatgtacactgtatcatcttcctaaaatcaccaggcatggtgggatgtgagctatagtcccagcaactcaggaggctgatgtaggaggattgcttgagcccagaaattcaaggctacagtgagctatggataccctaacctgagcaacagagcaagaccttgtctctaaaaaacaaaaattaagttaaaaaattgtgtctttctttatatacttacattactttccgttgatctgtttttgaaatgtttccagaactgtcttccctcacgtattgattcttccaaaattcttaagaaaatggaaaaaagtaatttctgaaaatgatgagaatgatcataaatttcatatagcactttcttgagaatttcaaattgcagttttaatattttactttagaaacaggtccagttttcccttctgtaatttttttctttggtctttttggattttttgggttttttttttttttttttttttgaaaagaacacagagatcttttcttgagtgatatttgcacagacattgccttggtaattgaagcttttttttttttttttttttttttttttttttttttttagaaaatcctattaagttttatgccatgtctatgctcattgcacctgtgcctcatgtctcattcattcattcgtttatttttttattattttttttttttgagacagagtttcgctcttgttgcctaggctggagtgcagtggcacgatctcagctcactgcaacctacacctcccagattcaagtgattctcctgcctcagcctcctgagtagctgggattacaggtgcctgccaccacgcctggctaattttcgtatttttagtagagatggggtttcaccacattggccaggctggtctggaactcctgacctcaggtgatctgcccacctcagcctcccaaagtgctggaattacaggcgtgagccgccgcgcctggccttcatgtctcttttaaataggacttctaaaattttgaaatgaggtcagcttcagtggctcatgcctataatcccagtgctttggaaggccaaggcaagaggatcacttgaagccaggggtttgagaccagcctgggcaacatcatgagaccctgtctctacaaagtacatttaaaaaaaaattagccaggtgtggtggcacacacctgtatagtcttagccacttgggaagctgaggcaagtagatcgcctgaccccaggagttcaaggttgcagtgagctatgttcccaccaccgcacttcagccagttaaggggacagagcgagaccctgtctcaaaaaaattttgttttgaaatgaatttatgtatgtttggttatttctgaaagcagttcaggcctacagccataccaccctgaatgcacctgatgttgtctgaaagcaattcaggttttcaggattaaaatttttatgctactaggtttgtaacctatatttaaaagtagaacatttaaaacattttagtagtatatagcactgaaaagtggctttttagcgtagacagttgtttttcaagaaactattttgtaatcctagctacttgggagcctgaggtgggaggatcgcttgagctcagaatccagtctgggcaacaaaggagaattccagcctctttaaaaaaaaaaaaaaaaggaagaaactatttgggagttttgtgaacaatggatatgcaaaaagacaggccattgttatgagaggcctaattgtgagtaccttctagaattgtatataagcatgattctcttcaatagtaaaatctcagcctcttcattttagaaatctaatataggaaaaagaacacatttctccatagttgtaaaacataggttctcagggtgaatgcccatctttgagcaagtttgtcttcctaatggtataatactgtaagtctgttatctaattttggcttgttgtcacttatttttcataatcaaagaaaaatgatttaattttaaaaagatgctctcctttctgttttcttctcttggatgatagtatccctatctgtctgagtttatagaatcttaatttttacctgctcttaccacatacatctgattagtcattaagtcttactgattctgcttcagaaattttgttttatgcttcactctcatgctaccaacttatttggtagcttcagcagttgtctaagctggggttggcaaattttttctgtaaaggaccaaatagtaaacattttaggctttatagcccatataaagtttttttttaattttttttttttttaaaaaagaaagaaatgtaagaacccacacctgtaattgcagcactttgggaagccgaggcagggtggatcacgaggtcaggagttcaagatcagcctggccaacatggtgaaaacccgtctctactaaagataaattagctgggcgtggtggtgtgtgggtatgtgcctgtaatcccagctactcaggaggctggggcaggagaatcgcttgaacccgggaggcagaggttgcagtgaaccgggatcgcgccactgcactccagcctgagcgacagagtgagactctgtctcaaaaaaaaaaaaaaaaaaaaaaaagtaagaatcatacttagcctggaggccatacaaaaataggtcacaagcaggctgtgggaaggatattgtaagtgggccatactttgctgacctctggtctaggctattacaacaatttcctaattggagtatttgtcaccggtattttaccccggtgtaagattgcctccatcttacacattactgccagaatcatctctctgaaatgtgaccatttcacttccaggtaaaatctttatgtgctccttttagctaagttttcttgcttaaggtattcatgtattacttcggggattttttttttttttgccatttcttcataaccatctatattatttattcagtatttttatagacttttttttcttaaaggaaagtttatactgtgaatggaaaatcaatattgattgccataactagaaaaccaacaaaaggcaacagtaaaaggaaatatagaactatgaaatgcctgtttcatgtagcacccaatcatatatgtactacatttcaaaaagtcactggcttataaaaatattttttagcatctcatacaagtctcttcataatctgttatacagctcaccttacttgcacgattgctgagccaaagcagatcgaaagtcattttggtaagaggctagatgctgaccttgtattctgaaaatctgatgattctactgttgttgatgtgattccaagtaagcctgtgtgaacttctgggctattctcagggaagtgtttatgacacattgttgaaggtatcatcagggcagttgatccaagaagactctaggagctggctaagccacaaagtctgcccaaaaagctcagaatgacaaatgaatgttttgtacattatctccactataatgctagaaaaaagtcttaaaagcatttgtctcaattgatcatttatatggaataatactggttaatcatcttaaatcatcatagtgttgggtaatgtctgtagaaggatgctttaaactctacttggtgcttcagctatgctgaccatctcaccattgccccctttgccatgccctgacatcctcacatgtctctctgcttttgcatactcttttccacctggtttgaatgcccttcctttatcatgggacattatcctttccatttaatacccatcttgataacctgactctgaccccctaggcaagtttaaaaaaaaaaaattcattgaaatgaaattcaccctttttgaagtgtacaattgcctgggcacagtggctcacacctataatccctgcactttgggagactgaggttgggagagtcacttgagtccaggagttcgagaccagcctgggcaacatagtgataccctgcctctacaaaaaaaattgcaaaaattagctggatgtggtggttgatgcctgtagtcccaactactcaggaggctgaggtgggagaatcacttgagcccgggaggttgatgctgcagcaagctgagatcaagccactgcactccagcctggacaatggagagagaccctgtctggaaaaaaaaaaaaaaatcttttttttaagtatacaattttgggccgggcgtggtggttcacgcctgtaatcccagcactttgggaggccgaggcaggtgaatcccgaggtcaggagatcaagaccatcctggctaacacggtgaaaccccgtctctactaaaaatacaaaaaatcagctgggcgcggtggcaggcacctgtagtcccagctacttgggaggctgaggcaggagaatggcttgaacctgggaggcggagcttgcagtgagctgagatagcgccacagcactcaagcccgggtgacagagcgagattccatctcaaaaaaaaaaaaaaaaaagtatacaattttgcatattcagagttgtgtactcattaccactgtctaattttaaacattttcatcactccaaaaagaaacctcatagccatcaacagtcactctcccctttcctcctgccccccctcagcccctggcaaccactgatctactttctgtctctatggatttgcacagtttagatgtttcatataagtggaatcatacaatatgtgctcttttgtgactgccttcttttactttaatattttcaagattcatccatgttgtagcatgtatcagaactttatccctttttatagctgaataatattctattgtattcatacaatatataagcgtttgtgtggacgtatgcattcagtttttttagatacatatctaggagtggaattgagtcatatggtacctcagtgtttaactttagaggaactgccaaatgattttccaaagtagctgcattattttacattgctaccagcagtgaatgagagtttgaatttctgtacatcttcacccaacacttgatattgtctgtctttctagacaaattttgataaatccctccttttctaaaccatagccaagtctattactgtttaacaatgaccatcttggagtataaattttctgttcacactttgaactttaacttccgggtcttagatgtctttatctggatatacagagaatctaggttttgtatgtaattattcaatgatagtattaaaactaagtccggacgcagtggatcacgcctgtaatcccagcactttgggaggccgaggcgggcggatcacgaggtcaggagatcgagaccatcctggctaacacagtgaaatcccgtctctactaaaaatacaaaaacttagctggtcgtggtggcgggcacctgtagtcccagctactcgggaggctgaggcaggagaatggcgtgaacctgggaggcggagcttgcagtgagctgagatggcgccactgcactccagcctgggcgacagagtgagactccatctcaaaaaaacaaacaaaaaaaaacactaattaccagtttttttgtttttgtttttttgggacagggtctcactctgtcgcccaggctgaagtgcagtgacgcagtcacagctcactacagcctcagcctccctgggctcaagtgatccttccagctcagcctcctgagtagctggaactacaggtgtgcaccaccatgccagactaatttttgtatttttttgtagaaacaccatgtctagctgatttttgtattttttgtagagacagggtttgtcatgttgcccaggctgatctcaagctcctggactcaaatgatccaccttggcgtcccaaagtgttaggattacaggcatgagccaccttattaggcctaattaccagttttaattatagacctacatgactacggtttgaaggaaaaagactttatttaatcctagtgattggaattggaattctcatttgagccagaagatttcttgagtggttttgttttctgtgataacttggtttatataagtaatccacattacttgggtgttagtggtaaagcaagtctttgccttgtacaacaaagataatttagtgattgatacattctgaataatctggtggttatgacttgacacatacaaaaaatgttagtggttgcagtccatctgttgctctgtaaaaagatttttgttattgtttgtttgttttgagaccaagtctcactcttattgcctaggctggaatgcagtggcatgatctctgctcactgcaaactctgcctcctggattcaagcaattctcctgcctcagcctcctgagtagctgggattacaggcatgcaccatcatacctggctaatttttgttttgttttgttttttctttttttttgagataaagtctcactatgtcacccagcctggagtgcaatggtgagatctcagctcactgcaacctccgccccccaggttcaagagcttctcttgcctcagtctcccgagtagctgagattaaacagtcatgtgctaccatgcccagctaagttttgtatttttagtagagatggggtttcaccattttggccaggctggtcttgagctcctgacctgaagtgatccgcctgcctcggcctcccaaaatgctgggattacaggcatgagccaccgtgcctggcctaatttttgtatattttatagagacggggtttcgctatgttggccaggctggtctcatagaactcctgacctcaggtgatccacccacctcggcatcccaaagtgctaggattacgggcataagccactgtgcccggccaaaagtttttttgaatcacctatggttcatttatttcagtttaagtgtataatcctcaaaggaaataatccattgggatgtatttatgaagtttaagtctgtaaaacaatgtggaggccgggcgtggtggctcacgcctgtaatcccatcacattaggaggccgaggtgggcagatcacttgaggtcaggagttcgtgaccagcctgccaacatggcaaaaccccatctcttctaaaaatacaaaaattagccgggcatgctttgcgcgcctgtaattccagctactcaggaggctgaggcaggagaatcgcttgagcccgggaggcagaggttgcagtgagccaagataatgccactgcactccagcctgggtgacagcatgagactccatcttaataaataaatagccaagtgtggtggcacatggctatagtcccagctacttgggagggtgagacaggagaattgcttgaacccggcaggcagaggttgcagtaaaccgaaatcgcaccactgcactccaacctgggcaagacagagtgagattctgtttaaaaaaaaaaaaaaaaaaaggaaaaattctgaaacaaccatgtaagaataaatgcatccaaatgaacgttgttcatctcagaagagtcacctttggaggtgatgcacttagttccaactttgctgcctttgagcacaacattttagggaaataattttttggaagtgttgtcaaagtctgaaatacattcttgtagaatgtggaaaatctcatacttgaaattttttgataagcaagacaaaatgtcacgtttagtaatactgttttttgtttaagatgaggtttttctgctggacatgggggctcacacttgtagtcccagcactttgggaggccaaggcaggtagattgcttgagcccaggagctcgagacaaacctaggcaacatgatgaaaccccatcacctgtacaaaaaattagtagagtgtggtgatgagagcctgtagtttcagctgcttgtgaggctgagatcggagaatcactttagcctaggaggtcaaggctgcactccagcctgggtgacagtgagaccctgtcttaaaaaaagttttcttatgtaacttacaaactagctcttagtggtatttgaaaggaacagccccagagttgttttcagtaacgatggtatcattggagtaaaagtatagcgatccaacctgactactttgaagaaataatacagaaaatgaggtgtatcatgtgtgacatttatgtttaaatttaaaatcagtttatagtcaactcatagttaatatacgaatattttttactaacttcaagtgattccttgatcctttaaataattttaatatgcttttttgttgttttttgttttgagatggagtcttgctctgttgcccaggctggagtgcattggggcaatcttggctccctgcaacctccacctactgggttcaagtgattctcctgcctcagcctcccgagtagctgggattacaggtgtgcaccaacacacccggctaatttttgtatttttagtagagacagggttttgctctgttggccaggctggtctccaagtcctgacctcaggtaatctgcctgtcttggctcccaaagtgcttacaggcgtgagccaccacacccagcctattttaatatgttttaaagagactttagcttttacaaggtgtctctaagctcatacttaatgacctgcagctttttttgtagaatttaaagtcaaggcaagagactcataatactttatccaagtatattttgttaaagcaaaaaaaatgtcatgtgatcttgtggaaaagccataccatgaggaaattttagctcctataaataggtgaaactatttttaaacaattgtttgctttcttagattatttgtcattggtataaggaatacagatgagtatttaatgtctaaataatataactcataaatggatgtggttgtatgccagttactcttacactacataatatctcaaatgtgataatggttgctgaggctttggatggcaaattagggctttcccagtggttattgtggtgtatggcatccttgtcttcccttacttatgttttgtttttcttctttctcaatggaaagccattaagtcttagttaattttctgttgaggcaagcatttgacattcattcgaattccctcagccttccagaagcattcagtatgtttcaactgtgactatgagcaacaaaataatacaaagtgaaaaactgcgtttcctggtgtgagtatttcattagatttattgatccttggccttatggtatccatgtgaaatgttcagacatctaattttttactgctaaataatttttttaggggataaataacaaaccttgtaaattatttgaagcataactgaagatgtcagatatatgagaaattatttactattactgtttcagtcattttcacttctaatcttgttaactacccaagaatctcttgtacaaaggatagtaatcattaaaatggttatatagcacccacaaagtgctttaatatacatgttttaatctattccttaaaacaccttctggagtatatgttcttaaccatattttttatcagaggacacatttaatcacttgcccaaggtaaaaacacacaccgtaggtgataaactttatgtcatgctctgctgttaaaccaccaatatagttagaattattttgatcagacaagagcgaagcagttttcctgtttttagtgagtgcgtatgtatgtttaatttctgtgctttgatctcattcataactgtgtgtgtgtgtgtgtgtgtgtgtgtgtgtgtgtgacacagggtgtggctttgtcacccaggctagagtgcagtggcatgatctcagctcactgcaacatccgcctcctgggctcaagccatcctcccacctcagcctcccaagtagctgggactacaggcacacgccaccacacttggctaatttttgtatttttttgtagagacagggtttgccgggctcagagctcaagcagtctgcccacctcggcttcccagtgtgctgggattacaggcatgagccactgctcctgggctcattaataacatattctcactcataggtgggaattgaacaatgagaacacatggacacaggaaggggaacatcacactctggggactgttgtggggtggggggaggggggagggatagcattgggagatatacctaatgctagatgacgagttagtgggtgcagcacaccagcatggcacatgtatacatatgtaactaacctacacattgtgcacatgtaccctaaaacttaaagtataataataataattaaaaaataataaaaataaaacatagttttaaaaatacaaaaaaaataaaaaataaaataactttccagaaatttagattcagaatctcaggtcaggctttctagataaggataagtgggtatgttgagcatgtgtctcacctggctcttaaatatgtttaacaaagttggggctgttgaaccaaactgacatttcttaacagttgatcttcttaaagacctcactttgcaccacagttttctaaatgtgaaacatactaatctgcttaacacattattaacaccttaacatgacatttgtttctacttctcttctaacttcccttgagcaattttctatattgaattgttcatgggtatcagaattaacctttctctagaattgttccaaaggtaactccacattgcccagaactagttttttttgctttgttttttttttttttttttttttttggagtgggagacagagtcttgctcttgtcacccaggctggagtgcagtggcatgatctcggcttactgcaacctccgcctcccgggttcaagcgatcctcctgcctcagtctcctgagtagctaggataataggtgcctgcccagctaatttttatatttttagtagcgatagggtttcaccattttggccaggctggtcttgaactcctgacctcaagtgatccacccaccttggcctcccaaattattgaggttacaggtgtgagccatggtgcctggcccagaactagtttcttatatgactagtagtagcctagccaaatcctccctcattcttaacttttctttgatctttcttttctcaggactttgaagctgtaactttgaaataaatgaaagaaacttagactctagaataagactcgcaggtttgacttggtctgtcctaagtaggtcattgttagccaactagtcacatctttgatctatgttaattcattcttttatttataaattcagataaaggtggtcaaaaaaacaaacttctaggggcaagtgaatgtctcagctgaaatcaaaaggatgagtagggtttgagagggcaagaagagggagagaggacatgcagcatctctgaaagcctggtggcacgaagcatggtgactaagggacagaggatattttgtttgtttgaactataaaatgttagagagctggaaaattttaagatgatactctaaagggaagcaaggccctgatcatgcagtaaaccatattaagagtttagattttattatgagatatgagaaattattgaaagggaagggttggtacacagttcatcttgtgtcttcttatttctcttgttttcttactcagtctagatgccctagacaaacatttcagtagttcttttcttagatctcttggctatttcaaggacaaggcaggtaataaaatatgcttggtctacagtgttagttagcattttggcatttttctttttgttactttttaatacatggttctatgtcctataattttttcttatttttctaatatttgcgttttccacatttcacactttaaaaaactcttcataaatatttttattggccagatattctggtcagtgggtcattgtttacttaatttcctaatggtggatatttattgttgtttcagtttttcttgttagaaagaatgctgtgatttacctataggcaaaagtttaaatgccttaactgtagacaaaagttaaaatatcttacttttttaaaaatttcattgccaaattgctttcccaaagaattgtgccaatatgtgaacatggccatttcattctaccttccccatcgttggttttttttttaattgcttgctattttaatagtgaaaaatgatgtcacatttttattgcatttctcaattacgtggttggccatattcccatatattaatcatagtattttgtatcttgtaaacattctttttatgtcctttgcccatttattcattgagaattttaagatttttttctcatccgttttatgagctcctgattaacaacctcctttatagcatcttatttgaatatttttatcaggctggttgtttcagcataatggggattttgtatagaccaatctattgataatttctttgtgattgtttttttttctaattaaatagccttccacctgaagacttacaaatatttttaaattcttctgctggttttatgacttccttgttcatgttttctttcactttgtcagtgtatcacatgaagtgagtgttaaactgaacttttttccaatttcctcatctcatttattgagtcttttcctttcccctttggtttctgatttttctttccacagctaacaatgtttgagaatttactgtgtgctaggcactgttctaaacactttatctgtattatctcattttcttctcacaacaaccctgtaaggaaatagaggcacagaaacctaatttgctgaagtgacacagctagtaagtaaagctttgtcacatattcagttcttctgtgtacctgtgctctcattgtgctgttgtttctatattgtggttatctttctgtttttatgccactatcattctgtaattattatggctgatacatgtttctctctcaagaaaagctaatatcggccgggcacggtggctcacgcctgtaatcccagcactttgggaggccgaggcaagcagatcacctgaggtcaggagttcaagaccagcctggccaacatggtgaaacctgatctctactaaaaatacaaaaattagctgggcatggtggcacatacctgtagtcttaactactcaggaggctgaagcagaagaatcgcttgaacccaggaggtggaggatgcagtgagccaagatcgcaccactgcattctagcctgagtgacagagcaagactctgtatgaaataaataaataaataaataaataaataaataaataagttaatgtaactgtagtatttacttctttttctattcttgcttgtttctaagtgaacttaaggttccaaaacatttctcattggaatatttttcagaattgccttaatctgtaaactatactggaaataattgcaacgtaatagtatcccaccaaagtcctctgtaccttagtgtttgatatgttccaggtgctgactaaatatttgttgagtgaaagaatgaatgaatgaatggagagaccttagtttgtcatctgcatcaagtcttaatttatacttctcattaatatttttcagattttccccatttgatgctgcatatttcatgttaatgttacttcttgacattgtatatttttcccataattttctaattatttgttgccaatatctgttatttctgtttttttgttttggaatttcccaaatattgttaaaaaagattggcaatagtgggcatccttgtttcgattgtgattttaatagaaatatgttattcttcaccagcaagatgttgggtggtagtgtgtaatacattcttttatctagttcttaaaatatattttataaggaaaaattttatgaaagattttaggttaactcttgactgacatttttggtattaaaggaatttgctgttgtttgatagcatcattatggaagatattgaatagcacatatttgtgatcttttaagttagctatagaagccatcttctcattctgctgtggtaagtgaatgtctttctgactttcttctgggtccctatttcactgatatctaaacctgatttctagcagggaagagactaaagcaagcacatcctttcattcccttgctctcagtgtgtagagctgaaatgtttccatatatgggaatttctcatagcattgggtttggacatacagatgtgataataatcctcacaacaacaacattactgcatctaggaatgtgggtgggccaagacactgtgaagggtttatgtgaattatgtcatttaatcttcagaaaaaaaccactgtaagttctgccagcccattttatagatgaggaaactgtgacttagagcagtgaaataacttgtctatggtcatacagctgagaagtggcagaggcaagttgcttgtaaagtagagccaagccttagagatggatgggtgaagatagatatagatgtatgtgtatataggtatgtgtatatctgtacacatatgcatacatatttgatgtgcttgagagatagatgctaaggactaatgcattttgaaatttttctggagccaggaatatagtaatacttagtggcaaataatgagcctttttccattaataataagaatataatttctttggaaggaaatactatctaattatagtttccctcagtatatctgggggattggttagcagacccctgtgtataccaaaatttgcgcatattcaaatcccaaaatcggccctgtggaacgtgcttccttgtggaacctatttatacagtatgtgggtttcacatcccacaaatactgtgctttcaatctatgtataagtgtgcccatgccattcaaacccatgttgttcaagggtcaactttactttaaggctagataattcttctgtctaagaacttagagtctgagtagttgacgtatattgtacttgtaagtttaccaagtttgactctgcattttgcagacatgtctgtaggattgacataatccataggtgctcctaatgcagtagtctataatttgactttcttattacttttccccttaaaaattctaagacagcattgagtttttggtatcctcagaggaaaagacagttacctctaagatacctactttcagggcaggcgtggtggctcatgcctgtaatcctagcactttgggaggccaaagcaggcgaatcacctgaggtcaggagtttgagaccagcctggccaacatgatgaagccccgtctctactgaaaatacaaaaattagtcgagcgtggtggcaggcgcctgtaatcccagctacttgggaggctgaggtgagagaattgcttgaacctgggagggggagattgcagtcagccgagatcacgccattgcactccagcctgggggataagagcgagacttcgtctcaaaaaaaaaaaaaaaaaaaaaaaaaaaaaaaaagaaacctactttctgtgaaagtcggtgtatatgtttttttaaataagacacaagtatgtggtagagtagggattatctaagcaattagtccctatcatggatggtgaaggtactaatcagtgtttgggagggagtggagatagcttccgtatatagagaggtaatgcattttaaaatcatttaggggactttttcaaataatcctgtttcttcatggtgagattccctgacacagtgagccaatcaggtttgctaaggcagaaaatgttcgagagccactgtactagacagcatgaaagatgactgttttgttgaagcttaatggtaatttttccataatcctggtccttaaaaagcaaaaaaaagaacacattagagtgttgttacttttctctctctcaatagaaatgttcctaaaccagcaaaggaggctatctgaatttttaaaagtttttacgaaggaacataaaaattcctttctctatcttttcccacctctagaaatgcttgaaatgagattctgccttacgtctcacaaattaaataccacatttgtgtctcacccatctcagttatgctgtcttgcattttaatcaatcctgtttcaggacttcttttgctgccttgtggctgtttcttatgtttgtcactaattcataagttggctaacttttatatttgtagagaatttctcagtgattttcttctagttggagttccagtgtggtttgatttggagtgtcaagatctctgtcccatgcctagccttagtcctcagtctgttttactgggttcaccacctggttgtagtaccaaatgcccttttccctttccctctctccttcctcacttcctcagtactgcccaagttcgtcagacccaatgattttattcttaagctaatcttatttttaatttaggtaattctgatttctgatttgtaaaagataaattttcttctccttcatgtagtaggattttaattttgtaaatatttaaattctccattaatggtgtgttaaatctgcactaaaactgcttctttacatgtttttaaattttttcattatgtttttaacacttttcttacatgcaaaaaacacaaccgttaaacttttcttattaaaatgcaaagcctagtgtcttctagctttttgaagagcttttgtccattatataatctgtcaagtagccaagagttcctcagaagcaggacatcatttagatttaaaacaattatggcttgtctgtaaaataatgttgtagcataaccattcatgggatggcagctacgattttacttcagtaaaatatccttggatactaccgccattttatttaccttaaagattttaccaaggtaccctagaacaaaaatggtgaggtcattttgattctgctaaagttggtatgactggaaagccaaatgacacagttatgagcatagaccttttattttccagatgtttgacagtgtaaacatacataaaatacatattaaagtttagatgctttatattttgtgcaataaattgaagccttaaaacatttcattttttttataaaagaaactcattagtttacttaattaagacagtaaaatagcagcaagtaccaagacattgtgcatttcttttatttaagacaagttacttcatttacatcagagttagaaatgttaagactggctttcttgaatacttaaatatagctcgaatcactggttagatatggacatattttcccaactgtacatcagggaggagtgctttcattagtttcagaaaatgcagaccctcagacagccagcatgaccacaacattgagcaataagagaaatgaagcatttactttccaagcatttgccacagaaggtaatggagtctttacatttgtggttgtctcttccctccataagttaagggttgtgctttgttgaggcatttcagagaaattatttggcatgccactagtgatacttagggtcatgggtgttggggatgattttgttgagctagtgaggcttgtgtttgtgaccattccatcttggagatgaatagttagagttgcagctgctgcttcatgtgaattgatagtctctgtggatgtatcttctggatagggcacaaaagccttatcagtgctagtaaaggtggtgtctttgcttagagtggcaccaaacgttgtttcctttgttcgatattgtttgggtattttggtcactttgggttgagttaccacactcagagagttaatggtgtccactgtctgcatcccacttacagtgaataagcttgaggtaaatccagaaggtgtgggatacatgttatgttcctttaaagatgatatttgggtagaacatggagtccctatcacatgggcttttgtttccatcatccacttcagtaagtaagtaatgttttgtttgtggtcacatgaccacctgttattgtaaagggttatctcttgcaactgaaagagttggtcaaaagattggtctggaatgaatgtgaacttattgttgtgcaggtaaagatgtgtgagatttgtcaggtttattaatgtacctggaagaatttgtgtcaaagaattattagacaggtccacgatatgtagtttggagggcatgttggttggaactgtccaaagtttgttactactgaggttgagaacctcgagacttcttagtgtatttttaatgaggacaaccttttccagcatgttcttagaaacatccagatatttaagattccactgataagcagtatcagatttgtcaagaagtttaatgttgttgttagcagcagacatgttccacagagaccgaggtaagtgagcaggcaggctttcaagcctgttgtttgaaatgtccagggtcctcagattggtatattgggttaactggttatgcagatcagtaaagtggttataagacaggtttaaatgtataatattctcttgcagtccagatggtaatgtagacaagtttctgcctgaacagtccacatgcctgtgcctctctgtgcatatacattggagaggacaaatgcataaaataccaggtgtgagaaacagaaggatgaacaggcagagagacattttcaatatctgatattccatcaaagcctagaaacaaacagatacacccttcttttaatatgcaaatacagtttaggcatctgcatgggtcagttagcattaggcaaaattttcaataaacctcgttgttgtcgagtccttttataattgttccagtgattaaactaacaaagctccccttcatttatagtccaaatgcttaatccttcaattgggctatgtggtagagagagactctctccctactctctcctgcattttctcctttattttctctctccctccccccttttctaaccatattctttcttatttatctttctagagccttaatatgataaaatagcattctttgcaaataaatagttgcagttgtaggctattactatttttgatgatatgctttcttactcagatgagaaaaaatggctgtcgtgtcttttttttttaatctctgcagtaatgtaattcaatgtgtgtatatagggtagattttatttagatattaaagcagttcttcgaaattttatctgtatgtttttaggataaatatatctttgtaaaaagcacttgaaaaatccagaccaacacagtacctataaacctcacattttataaagtgatttttttctgtatatttcagtgcccattttaaaggaaaacaatatgtatatttacagagtgactgaatgtataaaaaatatccctcaactgacactgcagcaaatttctggtgcatgcacttgctattgaatatatatttaatcctaacgttgactttttcttaaaagaaaaaggaaaaagattccaaagtcagccttttactgatttaaataacatcttaccgtggtgtcgtcttcaacatcagcatctcattttctctgggaaacttaaaggtcgtcttgttctgtagagtcggaactgtttctggctgtgggctgtgcttgcctgctcagctgcattgtgttgctgtgagctgaagctctgcaaccacctgatcagtaccacataggaggactgcagagctgtcgctggtgctgactcaaatttatggcaagaggtgcacacgcaacaaaatggacaattttttaaaaaatttgtggcatcaagcgtacctatatatctgatttgctataggatgggataccttatgcatgagagttggcccttactcctttctatgtatttgtctgagattgggttccatattttaacatttgcctcattaagaatctgtgaatttttaaaatacctctactctttatcctttttacatgttgaaaataaatttgaccttcctcatggatagttttctatgatattagtcccactattttttaactcctgcctttttatattcctttctaaaattgtataattttcatgtcacttttttaatattataaaaaatctgttttatgacttttatgtcttcccccaacatggtgattattatgtttaatcagcttttcaaatttatcaaccacttaagtgttccgtcttcccttttaggatgtatagaagtactgaaatacgattattttttctttatctttctgatacaatgatcatttgaccaaggctacacacaagccaggatacatttggaaattagcatcttatacttcagattatcagttcctatgtaaaataaacatgttttattttatatatttggagttaaagttttttttctttatgcaaccttgggtggtaagtggatatgagtattgttttttccaaagacatttttggtgctgtatgaatgaccatttatttgattttatgttttaagaatagcagtatcaatttaggtgatttcagagtgttgcacatttcatctttctgggaaagtagtttatagttttaaaattacatgaaatgatataaaaggaaaatttttcatcatgagttttataaagtgagatcagatttatgataaattttgctccactcttcagtggactgcttgtgtaaatctgttaaaacacaaatctgatttccagaatggcaagtttaaagaaagcaaataaagttacggtattttcgttaccaagtggcaccatttaaaaacgagtaatatttagcatgttatgtgtaaggaaagtctctttatgccttgttactaaatcgtttgtttttctctaaattatattagcattatttagattataccacaaatagaatttgttgtattaaaatttgaagtttattttcttacaagagaaactatactctaggagccaccttttgtataaaactaatgttcctcgaaaagtatctgcattttaagagtccgcaacatagaagtttattgttgattgggtgctttattgccactttactttgagggttcagttgaactctcaattggattcttactgtggatttaggaaaccagccatcaatcatagtgcttaaaataatgtgttaaaaatactacattcagcaatattgtggaaatagggaatgcattgacatttagagttctatttaagctcatatatacactgctgcacttctaaagatgtgactgagggtcaatttaccgaccacttaaatctcttaattttaggaaacctcattaagtcagtgtagaagtagagttatgcattttcattacacttaacagtacttttgtttgaaagaaaagacatgttacttcattaatggattcaaatgaatttgggtttaggctgtatcaagtttagtttctgttgtatataatagaaaattccagtgcaatagtagtggcaatgtttctcatttcaagtttgggacataccaaattgcttcatattattcaaagattattgtaaaattctcaaaaagaaaaagggagatcatttcaatatatttgaattctaacaatctcttacactgggtgcagcacaccagcatggcacatgtatacatatgtaactaacctgcacgttgtgcacatgtaccctaaaacttaaagtataataaaaataaataaataaataaaagaaattctcatgaaataaaataatactgtattactgttactcaaaaaaaatattttttagaggcataagtatgtgttacaacttattttaaatattattcagactcattacattttctattaggctgtctaggtcagtaatgatagttaggcaacttttacattctagattaagcagtaaattaatttacgtattcttttgtgtcctaggatatattaccccaacattgtgaaaggtatcacaaagcatctgccaaggaatagctatcccacgctaatcagtggtttcagttttccattattataggtaacatttgctatgcttgagagtcagatattgtttatttttggtaatatggttggctatttagactgattttcctgctgaatacaactgagagtactcaataaagtactttaaaagcatgaaagaaataacaacatagaaattaccaagtcaaaatccaaatgaatcagtttctttgcccacctccctactcctttttttctttatgccactggcttgttgccaaaactcagtcaattatttcctaaaatgtctctcatcttggagttttctctttgactctttgggaagatttaatttgttcttctgtcccccatattttctataagtgattcctcatatcattgacataattgctcatttgcatcatctcacaataatttcaaaataataccagtattgattgctacaattagattatagactaccgaataaagtttaaaatttgtttgtagctctgcttgctttattttactaaaagtgtatagtaaattctgtgttctaatgcaatgtgaaataattcttttctgtgtatttttatatcaccaacttgatataaactttgtttcagttttcagcttttcaggatcacaagtcaaaattatatatataacaatgtatattcagataaatcttgcttctctgtcttttccatcctatttccttccttctgctattagtaactgtttttattagtttttcgttgtatcattaacatttctttttgaaaacctaaaaaaaatgtaagcatatgtatggtatgttcttatccccccttctaatataaaaggtgacatatatacatactgttagataacttgttcttcttttcttactgtatcttgagtatcactccatatcagtatataggtatctgtatgattcactgtttgatccatagtactccatttgggaatgtaccatggcttattcaaccagtcccctattggtggacatctgggtttttcagacttttgctgttacgaataatgccacagtgaatacccttgtacctaaataattttatatgtttgccagtaaatctttgaaaaagattcctagaagtaggattgctgggtaaaagggtaaatgcatttggaatttttccagacattactaaattcctctccattgattataccattttgcagtcccaccaacagtgtatcatggtgtcgagttctatacagcctcactgtatactttgttgttgaactttgggatttattgtccatctgataggcaagtatctccatctaattttaaatgcatctctgtaattatgagggggagtatatgtctttacatatgtttaaagaccatttaaatgttttctcctgtaactgtctttttaatgttttgcactattaaaagttgtgttttgggtcttccccttcctgccccatattaggagcattttaaattttagaggtattagcactttgtcttgatttaagttttaatttttttttccagtttgccatttgtcttttggctttattatggtgaggtgtgtgtgtctgtgtgtaatgcgcacttgcatgtgtgtgatatttaaaagtttcatataatttgatttccctttttattgcctctggattttgagtctcagctaggaaggttttttcccgcttccagattataaaggaatttactcatattttcttctattacttgtataatttcatggtttatatttagaactctggtccttggtgttccaatatagtgtgaagtatggatcaaattttttcttttttccagatgtctatccaattgttccaatgcttgtttccactgatttgatatttatttctggactttttcttctgttccattgatctgtttgtttagtcatataccggtaccacagtgttttagttataggttcccaaaggtgctactttactttttgatcagaattcagtaagaacaacagttaaagatcaccctcatctaattcatttgtgtccctcaccactgacaccaaatagaagacttatgtgatatatgtatgtttcagtgcatgatgtaggtgctctttggtcctatattagtgaaaagagtgttgaaccaatagtcagggagcaaactcagcttttaataccacttctaagcacatcacttactttctctggtcctgttttctcagtagttaacaaacaaaaggagttgaaccaaatggtcttcagggttgtgtctgactctggttaatgctattttggttaagagcaccactagtatgtggtgtgaactttaatctaccttttattcccctgtgccttattcttttgcagtattcatgaaataaactttctcttctggatcttagttctttaatcttttctctaaaagatttttctttgttccagcattttcttctgtcctgcatttattagtttgtatctcttcctgctgattaagcaaggattgccactgtttggctgctcagcttccactgacctcactggggaaaattacatgcagttaaatgtgaattattcttcccccagcaaagaatttctttaaaaaaaataaaaggaaaaaagacaacataaaaacccggctgctgccagtagtctgtcctgttatacaaagaacagaaagagaaaacctccctttaaaagtacttaaagatatcagacaacactgtggtcagctaatcagctcccgtttaatctaagaaaattggtatttccctatttttccctgtatttctttcaggaaagaaggtggtaaaaaggggcaaaaatgtggaacgagcccattaagtaactgtcacaaatgtaaaatgagaacagttatgatgatttaaggcatgtcaaagacttggccaagtataaaaacatatcttatttaccataacaaaaattcgtaaaattaaaaagaataataggaaattctcaactccagattgctgctggggaaattagctttaaaagtactaagtttgggccgggcacggtggctcacggctgtaatcccagcactttgagaggccgaggcaggtggatcatgaggtcaggagttcaagaccagcctggccaatatggtgaaaccccatctctactaaaaaaaaaataccaaaattagccaggcgtggtggtgcacgcctgtagtcccagctactcagtaggctgaggcaggagaacccctttaacgtgggaggcggaggttgcagtgagccaagatcatgccactgcactccagcgtgggcgacagagtgagactctgtctcgaacaaaagtactaactttgaagaatacatgaaagaaaatttttaatgaggaagacaaaagatgtaatatgacaataagtatcatgcttattcaggaaaagtaagaagctcaaggaagtgtttctatagattaaaaaattaatggtcagtaaagatggcttgaaagattttaggaaaaacattgtatgtaaaattcctgtgtccaaaaccctactggttcttattaaatatggagctttgttaatgtcatgaatgccagtgctatgaataaatgctatgttctactctgaaaatcccagaactatgagtggttctccaagactgggctaccattttattctaagtgcttgtttccccctggagttagatgggactaatgaggaagaatatgtgcttgttgggcaaaggagcacttctgcagacaaaggctggcatccccaaaagtataggctgatgaccactcttgactttgacaaagattgggcccattcctactctaataactcagacttaccaattgtcagataatggataaagatgaaattctgtgtaagaaaggtgacttaagagtggatagcatcagaaagtataagtttagtaaaaagttgagaatcatctgtgttttgatagtctcttttcctgaaaaaaaaatcacccaaagtcacccgtatttagaatgaagccatagtcttcttttccttttttttgctttataaaacttgattttgtttgggtgtttataaagaagaaacttgtaaagatgccagttttaaaatttgtgcccccccaacatggtaggaaaatatttacattttatgatgcatcctcatatttttttcagggtaaatgttcctaacccaacccttcagttgatgttttaacatgtttgttttactctttgcaatgaaaccaagaagaaaatttctctattctcaaacatgcattttaatctcccattcccacaaacttggaatatttatttaatacttgaggtattaatttaaaacttgaagcatatacttagtctcttattcctctccaccctggtctttgaaatggaaacataaaagtttattcaccataattttatacacagcttttcaggggaaaaaaaactgtactgggtaataagtatatgtagattgtttcagagttcttaaattattgaaacataccatttacatatgtaaaatgtactatactttaaagataggtactataattagtaaatagattactgttaaataactttttttaaaaaaaagtttcatctatgcacataggctctgagcagatttcagatagttcctgaataaaaatcaaaattgactatcagttgccattttatatatgttaacatataaagaaaaaagagtcatttgaggatggaagatcagctaaaaagcaagttgtaatatttataacagttctgcaggtggaggtggcagggattcattaagatcttgatcagagttgggaggaatagagaactcctgacactggatctcaaggttggaatcttcttggtttttcataaaatctactggtggcaggggcaagttaagtgagtcaagcggtggaaatgattgtattatctcagatttatgatctccacagtcttgattgagacagtccagagatggagggagactagtagaatcatttggaagaggagatacaattgtcattgtgggtttgtcagattggttactttcctgtccttccaaatccagaaggggaggtggtggaggcagatctgcatcatctgaagaagaaacagcagttccaactgttgaaccatcagcactatcttctgatgtaccatttacttgatcttttattttctctgttttggggttgttggagtcttcaatgttttcacttgattcaaacaacttaatttctaagtcatctgctaaaagtgtgcttttgcttggtttccagggtgtaagtgaaatgattgatgtacgttttgtggatatttcattttctctgatgttatccatacaaatgtcaggggtttctccatcagcaaatggagatctacctgcccaattttgatcatttaaaactggtttccttaagcatttccaaagtacaatgatgattatagctaccaacatagaagtcagaagtacaccaattagtatggcagctattgaattataattgtttttttgtggggtttgtttgttactggtagtatctaagataaatcctggtgtactcctaggtgaatttttgacagttgatgttggttgtgtggatggattatgaacagttatttgttttctagaagggatctggacagatgatgattgttgagtaaaagtatagacaaatgactttggtggttgtgtggtagaagtacgggcagatggtagttgtctggcagaggtgaacacggcttgctgggaggaggtgttggctattggtgttggttgtttggtgttgtaggcaagtggttgtccagcagaagtatgtgcttctggtttttcagaagaggtatagacagctggtgttggttgtccagcagtgactttggcaggtgatattgattgtccagaaaaagtgtcgctgaattgtgttggttgacccaaaggattccctgttgtgttttgagaattagccaatacctgtgacattgatgatgtgaataaggtaggctgtgactgcttctctgttgtaattgtctctgtctttgaaaaaaatgtattgttcaggtgtccacaaaacaaaattaagatgaaatatttgggatccatttcagaatatttcctcgttatctatagcgggtttataatgaaagagaaagacagttaggcgtcattggtgtctagttaaaaatttgacttttcattatgattcctggcataaagtaggtagacattattcctaattagtagtagttgattagtagttattattcctaatttagacttgatacactgtaggtttggtgtaacaactcttggatatactctaacccatcatacagcatttggacctcataagcagtgatctctcttcttttattaatacaagttctgtacttggctctgctgcccctctagcttcattatatttcagtacttcacttagtcatacttctcaaaacgcataggctctatatgctggatccatgtgttctctaccttttttcaccattttctactagaaatatattgattctcctgccttgaagaacaccagtgatcatctgttacctaatctaattgttctttatttcttctctcccctcccctccttgaccacattagacactactgttccttcactaatattcaagtagctttttgtaatcagtcttcctttcatgttactctcactagctctttttcttctgcctcctaaatatggttaattgatattctgtcctcacccttacctacttttctttgttcctgattctgtaagattttagttctcagctttatgccacaattcctaaacctgtacctccagcctacatcttctttgtcctaattctatttgtgtgacttcttggtggatttttccatattttatatatatagatagatagacatagatatagatataaatatctcccactatcagcaaattcaacatatttaaaatggagttcatctttaccctcacaactgacaactgactcttctcccaacttctctgtatctgttaatggtaccactaagtttcttaggcacagagtctattagtaatctttgaagcatccttagtgtctctgtagcgtggtagccttatgttaatattgcatatttttaaagaatttcattcaactcagagtcttaggcttaaaatcctagagtgatctctgaatctggtggagtaaattcaatccagttggtcaagtagtcctgctgctgctttcattcatctattggtaaatgccacatttgtgtggagctctgttctaggtttaggagattaaaaaaaaaaaaaaaagatagtcactgcctttaagtgtttcagattctagtgatagaagcaaacagtaaaggccaggcgtagtggctcattcctgtaatcccagcactttgggaagccaagatgggaggatcgtttgaggccaggagttcaagaacagcatggaccacatagtaagatcccatctctaaataaaaagaagaaagaaaaaaagctaaaaaataattacaataattttttttttttcaagacagtcttactctgtcacccaggctggagtgtagtggcacaatctgggctcactgcaaattccgcttcccaggttcaactgattctcctctctcagcctccaagtagctgggattacaggtacacatcaccacgcctggcctatttttgtatttttagcacagacggggtttcaccgtgttggccaggctgctcgagaactgacctcaggtgatctgcctgccttggcctcccaaagtgctgggattacaggtgtgagccaccacgcctggcccaattacaataatttgataagctttctcataaaagtatgcaggagatgtacagagaagttaacctagcctggaaaggcttcagtgaagtaaagcttgaactgaattttaaaagtctataaaaactaattaagtttccagccagggagagcaacaatgtgggcacaggaaaataaggcacatatgaaagtttggcagatagggctttttctgggatgtggtagatgctaaaacttggagagttaagtttcagttctacttctcccatctaactacctgtctaaccatgagaactagttgcttaacctttcctgttctcaattgcctttcctctaaagtgaagagttctactgagacaatttgcaacttttggtataatatacttgttttgcacatcatcaaacacaatggcaactatttggttatctcttaacattagggaatagaaaatcttagggtgttagatattggtatacatgattagaaactatagttcttctgactcataagcctatatttagagagatttgatgttctgttggaaggtgcaataaaggttttacaaattaccttttcagcatatctaaacagcatatcattgcttactcctctaccacttggtacacagtgatgataaatggccctgttttagtagaagaaaagatatgtgatttttttccctatacgaataattcaagcctgaattttaaaacagttctcctttgaactctcctgcacactgctgaattaatcttaaaagtgtgcatgatcaggttactactgccttgcttgagggtttaatttctgttaagataaaacttcctttttctttttttttttggagacagagtcgttctgtcacccaggctggagtgcagtggcatgatcttgtctcgctgcaacctctacatcctgggttcaagcgattcttgtgcctcatcctcccgagtagctgggactacagtaggcatacactaccacacctggctaatttttgtatttttagtagagacagggtttcaccatgttgtccagaccggtctcgaactcctgacctcaagtgatctgtccgcctcagcctcccaaaatgctgggattacaggcatgagccaccacgcctggcctgttaagataaaacttctaaattgagttttcttccttctggcttgagttaaccagtccagattcacgtatcatgactgaaacttcttatccagccaaatgcatccctttcccaccttgcatactttctaaacacacgatttttccctgctaaacagacacttctatgctgttttttacccttctcaagggtgttcttttttttttatttttcttccagacctagcctcttcccctttctggctgcatatctgaatctgtcctcatctttcagacctcagtttaaattccccttcttaacccaagttctctgtgactgactacagcccaaacagatcagtcatttactgaattccccctagctctcatttattgtttttatggttccttacataattcatgtatgtatctcactcacacttctattctcttaagtaattgtgtttacttttcacattttcctatacctacttccttgaacaagattataaagaaccttgaagaaggcagaaaggagaaagaaaaatacttatctagagcatattatgtgttgtactatcccagttttgcatactttatttcacagaaccttcaaatgactttataaggaaggtaaagggatcccttatttacagataaagagacagtgtcaaatgagttaagcagtttgcctgatgttataccactcgaagtgacagattgggagtttgtacccagggccacctgattccaaagcatacattctttctgctaccctttattgcctcatgtttttatattttgatttctttgtagttaatgccttatatattaggagcacagtaaacatttaacctgtattgggcttcttgattcctttccattttagtttttgctttttactagtacttctaccagaaaataagcagaggcagtgaaatctgagttaataaattctgctttttatccattttgcaaaagatttaaaagggaaaatttgaacacttttggcatagatatagggatttgaataatctctggatggtcatcatccatgcagttcctacccattattcttatagattacaaaaaaaggcggggggacttctttagaaaatgttattctcttcagaacttcattttaaaaatctgttttaatgctatgcaaagcatcagaaaatataagccatgaattgtctttagccaaaaatgtttcctcttttgtgactttgcttaaaataaggaaaccatacggttcctcttttcagttagctgaaaaaggcattagagaaggacagggcccaaacaggaacataattttaaacccaggttagtttgtaagatcaattttgataggctcctatcctctactgtcagtagtaagctggtggaaccctccatgtatgagattttcacttgtcagttaacggttatggcaatattaaaaccaaattccattttttgcctatcctaacactttctaccactcttcagttagctttttatcctcctaggatctgccacatcagagtactagaaactgtattagaattctatgatggcaattcagtgtagtccagagaaggagaagaaagatttaaaagaggaataaatagggaatatggtagtggaaaaaactgacttttttcccagcggtaatgaggccagcgttactaccagtgtggaaggttatttagcatacacattttaaaatatgtaagtggtgtgtacctgaagtaccaacattgtttctgtaggtaaagaacaatattgggcaggggaataaaaaggagatttagaataatataaaaggcaatgcaaagaaatacaaaataacacaaaagagaaaaaacaaaaactctaggaagcagcgaacagaaaagaggaaggtcaattgactagagaagatacagaaaagaagaaaagttaataaacaggtgaaaaaaaaagcagtggttatataattagcaagaaggcagtgtagatgattgaagtaggcaaaatgaagttgggggtggggggagatgattgaagtagatgaaagaagcaacggcaaaatgctgctctgttgtggctggcctgtgtttgtgagtgcagggagacagtaaagaggagcttgctttctaaaatggaggaccagaaggaaccatcctttcaaattcatttacctttcatttcaggctctcctgtctgctgtgagtatccttaccatcctctccctttttttttccctgacactatccagaagcatacctagcaattattccaaagaacccatgtacccgtgtacgttttatatagagttttccagaaatcccttagtctgctgctcaagcaaatttgtcagccctcatatgccggtttttactcattattataggctggcactttgaggtttaaatctgtgattttggttctttttctttgctgaatatttagaatattttaaaaagaaaaacataaatttaaacattttaaagacagttacagtgaagcaggagtccccgtgtataagacatgttctttttttttttttttttccgtttggagacagggtctcactctgtcacccgggttgcagtgcagtggtgcaatctcagctcactgcagcctctgcctcctgggctcaagcgatcctcctcacacctcagcttccctaaagaagttagaaactgcaggtgcactacaccacgcccaactaatttttgtattttttgtagacatggggtttcaccatgtcacccagacttgccttgaactcctggactcaagtgacccacccaccttggcctcccaaagtgctggaattataggcatgagccaccgagcccggccatagacatgttcttataaatataatgcataagtacttaaagggtccagcatttaaaattgatgctgttaagttggatatgttaggaagtatgccattatcttttaaagagaatcaagatttggagagcatatcctagacaaaagacaagtatagatagctgtatcaattactttgatataataaaagttgtgatgcaaatataatagattaaaatttagcagtagtattatctctaactagtgaagttttgaaaccgtaaaagaaaaaaccagccattctgcatcttgaggaaaagtggaaagagaaattgaccttcaactacaataggaagtatttgatgaccatcttgtatcatgatagtgaccatttactgagcacccaccaaaggctaagcagtatcctattttaattagctaggtggtggttttttcatcctacagataaggaaactgagacaccacgatgttgggtaacttggcagtatcacagctctaagtagtggcactaatacaaaaatcatgctaatcttgtgccagaaccgtttctttctatcacatttcactgtatgtgctatactgcctttcatagaaaagttatgaaatagaaatgctttatgaaggaaggagatgtgagttggtgggaattacacgtaaataacacttgtaggtagtcttagataaagggtaggaaagaaatacctgaaaacccattttagtcctgattctacgaaaactattataagaatttggaatggtttctataaagtgtcatatttagtaagtttactgaaaattttgtggtgattttttttttaaagcttggacattgaaaggcatcagatttatgtttctcaattcaaacttaatcagaattaaagtttccttctaagtagaattatgtgggaattagctggaaaacacaggcactactagtaaactttagatttgggactaaccctttaaaaacatgtatgggaccaggcgcagtggttcctgcctgtaatcccagcactttgggaggccgaggtgggccaatcacttgaggtcaggagttgaagaccagcctgaccaacatggtgaaaccccgtttctactaaaaatacaaaaaattagccaggcgtggtggtgggtgcctgtaatcccagctactcaggaggctgaggcagaagaatctcttgaccctgggaggcggaggttgcagtgagcctgtgagccaagatggtgccgctgcacaccagcctgggtgacagagggagactccatctcaaaaaaaaaaaaaaaaagtatgggattctatgacaaaaacacaccataaggatcgatgggaaattttttaattttatgaaatatgacagtgaaaaaaatttaatataattttatgactttatgcataatgaaataaactaaatattagaagtagaaaaatatatagacaagcctaatctgaaaaagagataaatatctttattttctgacttccacagtaattacttagaagaaatccttctaagagaaagtcatgaatatttattaagtgttgaaatgggatatcacccactatgaacatattattccctgaaattacaagtctatgtaaaatactctttgcagtttttatttgcccattttacccacagcaagcatcttttatgcatattaacaattttctattgtttattctataggtttcttctatcttatactatgttctaaagtctcagataatgtgacataaacacgtagatgatattaatatacgcatgcatgtttgattattgactaacatttttggcttagtaagcttttaaaatgagccataatgttttcatgtcatcattattaaatataaaatctatatgtaaaaaataaagcatgtataataataatagtcaaataccacatctgatttctttttctttctaaattaagtgaaagtgaccattcttactatgcaaactaaaggggatacaaaaattttaatttatgcattatattatgtacaggaaaattctataaaaagtacattagaacttttaacaattaatattttggaggttataaattcagtcatagcctgtggaatctagttctatttctaacccttagctttatctgccatggctatagtttctttttaattctaaaactaaggttaacaaatatgattgtggctgggagcggtggctcactcctgtaatcccagcactttgggaggcggaggtaagcggatcacccaaggtcaggagtaggagaccagcctgggcaacatagtgaaaccccatctctactaaaaatacaaaaaaattagccaggcgtggtggtgggcgcctgtaatccgagctacttgagaggctgaagcaggagaattgcttgaacccaggaggtggaggttgcagtgagctgagatcgtgccactgcactccagcctgggagacagagcaagactctatctcaaaaaaaaaaaaaaatatgtgtgtgtgtgtgtgtgtgtgtgtgtgtgtgtgtgagattaaataaacttaaaaggtcttatacaaacctaggtgaaaatatttttctaaggcaagctgaactgagtattttttaattctatgcaacaaaaccacaaaaacctgttatagacatctttagactatcagagtttaagtttaaaacactaatgacagtttttaaaataaattttatataaagcaagatcaaaccaaattgtgtgaaaattttcttacctcagctgttaacttcttttgcagaatgctaaattcttgttctaactggacattttggtgatttggctaagaaaggaaaatgggtggttcaattcagatttaaaatgttcctctagcaaactgaaatagtttctgtagaaaaagaggaagtttatcaatagctggttccggaagtgcaataaaccacaaagtgactaagaaatatattactttaacagaacttattttgaaatacattttggagccctatgatttgagtgcttttaattatgtaaataaatatttgagatactctagtaatatgattatgtaaattaaatatttaggatggagtcccgaagagaaaattacatgttctaagaagaaaagctgccagttgggttatcacttacagtgagatttcttctcataagaagtgagtgatgtgttctgtttacttgtatgaccttaggcaagactctgcacttctgagtcaccgtttcctcctctaaaggaatattttattgggttattgtgaggattaaataagatagcataatataacatgtataaatgcctcaccaactgcaggtaaccaataaatgtaatgttatttcctcataatataaaaagtccagggtaaaagtataattacattattttgcaaatgacaggatctcattcttttttatggctgaataatactccattgtgtatatgtaccatattttctttatccattcatctgtttatagacacttaggttgcttccaaatcttggctgttgtgaatagtgttacaacaaaagtgggagtgcagatgtctctttgtacagttttcctttctgttgggtatatacctagcagtgggattgctggatcatatgatagctctatttttagttttttgaggaaccaccaaactgttctccatagtggttttactgatttacattcccactaacagcgtacgagagttccattttctccacacccttcccagcacttgttattgcctgtcttttgagtataagccattttaactggggtgagatgaggtatcattgtagttttgatttgcatttctctcatcagtggtgctgagtaccctttcgtatgcctgtttgccatttgtatatttgtaattaaattattttgaccaaatattttactagtgacttttgagttcaagttctcaactatttatttgattacccacaaagtagttacttctcagtggaaaataaaataaattggggatcattttttaaataagaagttaactaaagttaacttgttactaaagggtaatgaggggttggggagatggtgttaccagttaataggtacaaaaaacaatagaaagaatgaataagacctatttgatagcacaacagagtgactgtcattaataccataattatacattttaaaataactaaaagtgtaattggatcctttgtaacacaaaggataagtgcttgaagggatggataccccattctccatgatgtgattatttcacgttgcgtgactgtatcaaaacatctcattaccctttaaatatatacacctactatgtacccacaaaaatttaaaatacaaaaaatttttaagttaactaaacaaagtgtattgaaaggagtgagtccatctgaataaaaatttctttgagtaagtcacctttcctctcttgaaaaatggagatcataattcctaatttataagcttattgtggaattaaataaatgtaaagtgccttggatgatgcatattatagtaggtacggaatgtgttaacccatgcactgctttttcctggtcactgcgggaaacacaggttattatgaccttgttcttaacttcagggtacttatagcttggtgcaaaaagaatagtttttttttatgggctcctactataaagcataatataatcaaatgctataaagcttttgattcactggtttttggaagtattgttgtttttacggacagggtattgctgtgttgcgcaggctggtcttgaactcctgacctcaagcaatcctcctgcctcagcctctcgagtagctaggactacaggcacatgctactatgctcgctggctggcttatttatttattgtaaagatgaggctcttactttgttgtgcaggctggcctcaaactcctggcctcaggtgatcctcccaggattataggtgtaagccactgtgcctaacctgattcactatttttaaatccctgaattaagctggtgaactgtaatacccaggggtagggaatgtgtttttgttcaaaactaaatgacttttaaattttgaactcaaagatatcttacctaccattttaaaatacctgtcatttggaaaggaaacacttctgtttgttcagtaactatcattggatagtaccattctgagagtatatgtttaatagccaagatagtgagtggtgaattttaaatattcttttaaatatccttgtggtagaagctctctggtgagaaaatgtttgaccagtatgttgaatatgaaagtaatttcctatttttatgatgatattaatttcttttaattttctctgacacgtgtttatttatgacccttgattcaaggagtgctttgtgttactcctggatgtactggtgcacaatctcaaattttcaatttttgcacagaatgggaagtctgcccagtttcatttctaatctgggttatttttcccctcaaaagataacctgatttcagtcaccatgactggcatgaatattctcatgctttcctttttactttgttaacacttaactttatctggaataatattgttatgatttctcgtttagagaatagatttgttttttacaaattgctaataaattgataataaaaatgatgctttatttttttcctctcattttaataatagctagacgtttgaatttgatgaccaagagcagttatcaccttgagagttacgtaaaaattaccaatgcttagagttcaccccattccagttgcatcagaaggaagacatgggaattaggcattggtgttttttaaaaactcttcaggtgattctgacatgcagccagggtaagaatcactagcttagaagggagagtaagattgtagtcatacttgggaaaaaacatataaaaaatatttttaaaatggttactatattgcccgaaataaatgcccagtaagggatgagatttttgaaatgtggcctgatcttagccctgtgttaatttcagtagatatttggaaagtctctcaaaccaatttttgtaatatatttaattgaagatgggggggttctcaacttaaatgtaagtcattattttacttgaagccagtttctttaaaggttaaattataacctgaagtatgcagttttccagatttgaacacacacacacacacacacacacacacacacacacccctaataaatcattaggctacttggcatccttgaagtccaaaaattaatcaacctttggtacttgttgttaatgttccagtaagtagtatttatagaaaagatgaatattattaatcataaacagtgaaacatactttgcgtttacacttagcctattggtgtggctataaatcttatttattttagttgtgctctatttcttattgatctttacaatgtgttctctaaagtaataaagtgaatgcaaatatacgtggtcacaggtttattctgagttttaatttattatacaaaagtaaaggttttaatttaatattaatagtagaaaaacactttcttacgtgtgccatatggaaagataaaggatctattctaaaattagctgtgttggttgataagctggtgtggattctgccacatccagcaaggaagataccattaaattacacagtttagctctctctatctatgcattaggaatttgacttccatttgatgttaaagcatatacttggctttaaggacacactaaaactattcaaagtttaattacattcagacaaagatcatctaaccactgttgctacatagggaatatttatttaattatcccttgctatctctattaatcagtttcctcaatttatccttaaaattttcctcaaatgcttagttattttattatttgctttttaaaatattcagtgtcaaaacaaaagtacacagtttaaataattaagcaggcatacttctccctgtctcacctgcttgattctaaattgcaaggtctaccatgtcaaattttagataatcagaacaacactttgggattaaataccaactgacttcatttttactccataagccttctcattgctactttgcatttttcttcactaacctatctgtttgttagtaagtttttcagttccttcttcatcttttctttcccttgtagctgtgagcactccagtagattgcatcactaggttgggtcctgtgagctgttttgttcttttccaagtgtctgattcagcgggccatagaccgcttgccagaaaatcgccattgcttctaggctgacgcttgcctacttgttttgatcgtctgagagaagagactttgtttgccaaaaccacagttgatagaaatagaaaggtacagataagaaaaagcactgcaattataattaagcaaattagcatagccatgttgttgttgttttccgcacagacatcctttttgaaaatttcaccatgacttttgcttgtgttttcaatgctctgtactgttgaaggactgttgctgacgacagaaggtatataaagctcctgttcagatttagaagttaaagctacgatgtgagatgtttcaggcatgtttgtagaattacctttataatctacttcaggagttatagggtttgtgttaatgttttcattttggtttctgcctgtcttgttttgaataactgaatcccaggaagaagtactgttagcccacagacgggtatagtttgcttttgttccaggagacaaagaaaaaactgttgtcatcagaaaggcaagatgtaggtaatgtcctgtgtgttccatgtccgtgggcatgcttggcaatctgttgggatagcaatataatttgttagtttgtgaaagaataatggatcctagttttggtaattgtagttaaaagatagtgttgagatgttacaagtaaactacaagcttatgcctaatattcgctaccctgaattccttctcaactaaatttcttttctattcagctatgtatgaagaagcattttaatttctattaacacttttagatgctagaagttagcattacaaataaatattaatcattttaagtggactatcatggctttatatagttttcttcctttgaagcgtgctagacttctgctttgagtcagttagttctgcttttacttttctgattccttctttaaaaaaaaaaaaaaattaaggatcattcttacagaaactacccaccctctaacctgtcaccaatctttacagaagaaatgtggccttgagcttcttgcttcatgtatgaaataaatgcaaatttttttggtggaaagaggggaagtttggtagcaaccaaaagaaactgaacttcaaatagaaattcaaggtgttctttttttttcttgggtgttcatcttgaagcttagaataaagctggtacttagaaatacatttgtaagtgtatttgtgaacgcaattttactgtggtggttgtctcttttcatttatatttccctggactgactgtgtctttctgaaggcaaaggcataccagttttctcaacctaaaaatctgaagaaaaaaaaaaaaaaacagcaaatttcctctgagtagacttaaaagttcaacaaaagttgctgggttttcttttaaagcatcatttatacctagcattttttctgattttgacataattgtaaaaaaaaatgtgtaataaaatagaaatagagcatcaggatcttgatgatttgggatgaagtggcaggttataagcatctcaacagataattgaaaatgttgaatttccgctttggccctgagcttgctggaaactagtacaaaaaggagacaagttatattatacattttttaaatctaccaaatgattgatttaaatagaaatggcatatcttagaatttaacagttccatgtactgctaacccagcaggaaagatttataatcattattaaggtatcttataataatataccagtttgtcttgagctacttttgaaaggagtattttattgttagcatttatttgaatgaactaaaagcaaaactatattgttctcctgagatttactaaatgaaattgcctggttaagaaccctacgtatgctatagaaattcttctcaaatgtacttaggagtccttttatttaaaaaaaaaaaaaaaaggcagattcttacctagctagtataggtagggcctgaaagtctttgtttccaaaccaactcctaagcaacatggatgccactgctagtcaggcttttgaacatcaaggttttataagaaatggttgttatatgtcattggctgacatttgtatactattaaaatacagaaattgaaaataagaaatgtgatacgttgagttatgcaaacaaaagtagcatgtaataaacaatgctaactggagactatatttcatattaatagtagggaggaaaaactattaaatattccaggattaagattactttttagattatgacctttagtagacaattaaaggcccaagtcactggcttttgtataatagtgttcagctttaatttttaagtttagtgacataaatctttggatatttcatgattcttccacaaaaagaaatacttgaaattggattagcaagtaatttccatctttttatactagactggacttctgtattagatgctagaatgatttaaagtagattattcttttcacattagttcattaacagtgtagtatacatcatagtattggtacacattttaacagtgcttaccacggaacagataataggcctgctgttgattgtcttcagccagatgtactgcagtgcccaaataaacaaactgtatgacaaaatgagactttctcttgcccttacaaatgcctgagaattgaggactgtttttactccagtttatgccttggaggccaggttgtgttatcagaagttttcttatatctgatcattttcagtagaatttattttcagtagaatttgtaatgtccaagcattagtaatgagaaatttattttttaacttttgaaaaataacaaaacatttccagtttacttgaggaaaccaaacttagatccttcgtaatcctaatttaaaactccatggcgatggcaaattttttcatttctaacttaaaatttatgtaacaggacagaaaaaaaaagtatacattttcagtcacaattctagtttgttagtgagattcttacacactttgatagcatttcctcgaacactaatctgtcagacgttagaagtgaaaaggcataagaaaagccgtatatatatgacctaccttacaaaatgcttggtcaaaatctgattataacgtgattttgataaaccacttcttttcttgtcttctttttaaagcagaatagacttggagaatatgagccttaaagtaaatctgcagtaaaaaaggatatgtgcagctagttttccacttttaaaaccaaaccacagatgacacatttcctttccactgcaactaaagcacatgtcacaggagggaaaaaaaaaaaaacaacgaaaaagctccaacttctctagttggccactggcatgacaggaggctttgtagaaccaatccccgcctccagagcagggagggttttccacttaatgccttttgacagtatgctcattctataggcctgctacatgctttagtgtcattcaaaagaggttttgaaatggtatcttccatttcaaatcttctctaaaagacttatttgaaatctacagactgatttgaaaatgtgagtttggagtccatgggatactgatcagataatgtaacaattgtggaactgcagcaattatttgagaaaatatctagtaaacttagattatatgggacagaaaatgctttcgtgtggtgtagtgtgtgtatacacacacacacacacacacacacacacacacacaactgtcaaacatcctgtcatcacctcaagtttaacatgactgaaacagactttaagaactaggtatgggctgaacacggtggctcacacctgtaatcccagcacgttgggagggttgacgcaggcagatcacttgaggccaggagttcaagaccagcctggccaacatagagaaaacctgtctctactaaaaatataaaaattaaccaggcagggtagcatgcacctgtagtcccacctacttgggaggctgagacaggagaatagcttgaacccgggacgtggaggctgcagagatcatgagatcttggctgcatgagctaagatcatgccactgcactccagccaggaagacagagtaagactctgtctcaaaaaaaaaaaaaaaaaaaaaaaaaaaaaaaaaaagaactggatatggcagcacatatctgtaatcccagctactaggtaggttgaggtaggaggatcactggtggagcccaggagttcaaatccagcctgggtaacatagcaagactccatctcttaaaaattaattaaattaatgaaataaaaagaactttattttttctttaaaggaggctgcctgtgacagtcttcttgtttctgttcatgatagcaacattctaatatcagaggcttagtatacaacacatcattttaatttaagtcctctcagtcctgatcagactttgaatcatgttggtccttccttcatattgttggatcagtttctttttccctgtttttactgtcaacagtactattttagatccttatcaggtcatacctagactctacagtgccttttcggtagccctgaatccttcttatatcttgtatacatcactgtctttggtcataccaccctttctttaagggaaaataaaaccggttgaacagttccctaatacatacaacaatgattcagaaatgtttgtgtacataaacatcagatgagaagattgtttaaaaattataaaagcaggacatggtggctcacacctgtaatctcagcactttgggaggctgaggcgggaggattacttgagccacagaaattcgagaccagcctgggcagcatggcaaaatcctgtctctacaaaaaatacaaaaaaacaaaaacaaaaaactagccgggcatggtggcgcttatctgtagtcccagctactcaggaggctgaggtgggaggatcacctgagcctggggaggtcaaggctacagtgagctgtgaccgtgccactgcagtccagcctgagttaagggaaaaaaaaaaaagataaaaatttccaggccccactacatagatccatatttagtaggtccaggttgggaccaggaaactgcatttttatcaagcaccacagttgattctgacgccagtagtccacagaacatatgctgagaaatggtgagcccctagtagaaaacctaagccctttggttgggcagttatggtctctccacaatttgactattctgtattttcccagctttatctctcaaaacttctctacctgaatcctccattctggctagactagctgtctcttcaacacatctagttacctgtttcttttcctttttgcctttctccataaggcctgcccagtcctcttgctgagtctgcattcctccttacctgattcagccactgtatcttctatgtagctttcactgactgcccagtttgtgttaatctctctctctctctcctttgtcttaataacagtattttctctgcatttcctttgataagtgattactttctacctcatatcttctatcttgaaatatttgtgttgttttaaaatcatttgacttgtcatatttttatcttattttctcccaacaagattaaaaattctgaggtgaagttttttattgatacatgataatttgtacatattaatggagtatgtgtgatttttttggttttttttgtttttgtttttgttggaatctcgctctatcgcccaggctggagtgcagtggcacaatctcagctcactgcaaactcccctcccaggttcaagcaattctcctgcctcagcctcccaagtagctggggctacaggcacgtgccaccacgcccagctaatttttgtatttttagtagagacagggtttcaccctgttggccaggctagtcttgacctcctgacctcaggtgatctgcccgtcttggcctcccaaagtgctgggattgcaggcgtgagccaccatgccctgcctgtatgtgtgatattttgatacatgcatataatgtgtaatgattaaatcagggtgattaggatatccattgcctcaaagaaaagaaattgtttcgtctagctgttttgaaatatacaatgttattattaactagtcaccttactatgaatagtagaacttgttccttctatctaattctaacaatacatatattatttattttattattatttttttaagacagtctcactgttgcccaggctgaagtgcagtggtacaatctcagctcgctgcagcctctgcctcccaggtccaagtgattctcgtgcctcagcctcccaagtagctgggattacagacatgtaccaccatgcctggctgatttttgtatttttagtagagacagcgttttgccatgttggccaggctggtctcgaactcctggccttatgtaacccacctgcctcagcctcccagagtgctgggaatacaggcgtgagccactgtgcccagccctgattatatttttatatccattaaccaacctctgaggtaaagatttattttaacttacttagtagtattatcaccagaatcatcacatatggaaaactttgggcctaagttaacatagattgttttgatttgaaactttggtaccattacttcagggctttttcatggtcctcactgtggctgctcccatttattagtattcttttggttttaagcaacatatgacctaatatggcttaatcaaaaaatggtatttattggcttatgtaactgagcagtcctgggataaatttgaccccaggagaggctttatctcatacacaaatgatatggccagggttccagtttgtctatttctcagctccttctcttcagtcttttgggaggctcttcttttatatcccaaaatatgagctagcaactcctagggctacgtattcccttgtttataaacaccaggaaagaaatatctcaaatcccaacaatttaagctaaactacctgaactgggcctctttggccctggttgtcctggtttgaataatgtgttcattgctgaatcagtctgtgatcaaggtgggataaatggattggctaaaaccatctcactccagagctccagatgggtcattcctaccagactattcgcctaaggagtttggtgggccctgcaggcaaccaactaattcccactgttttcttcctttcttgactcatgggcaaattttttattgttgtcgtggctcaaaatttttgaattggagatttgtctcttctcttagccttatttctcagtgtccaaaaaacaactgatttaaaaaatgaatccagactttgaagaattgttttatattattctctctagaaaatgaatcataaaataaaattgattagtggcatctgtatatttattttaaacactgctaataatctttgtcttttttgtcattttccttaggttcaaaactggtcaaatcaatggtgatttgctgatataccatgtcttactgactttaaagccatattatgcaaagccatatgaaattgtagtggaccttacccataccgggcctagcaatcgctttaaaacagactttctctctaagtggtttgttgtttttcctggctttgcttacgacaacgtctccgcagtctatatctataactgtaactcctgggtcagggagtacaccaagtatcatgagcggctgctgactggcctcaaaggtagcaaaaggcttgttttcatagactgtcctgggaaactggctgagcacatagagcatgaacaacagaaactacctgctgccaccttggctttagaagaggacctgaaggtattccacaatgctctcaagctagctcacaaagacaccaaagtttctattaaagtaagttccagtctgtgttttgtaaacgattcattgcttttcttgactaactagactatatcctggcctccctaggtgtcctacccctatagtggtgtataaaatgtcacgtaaggctgtcgcggtggctcacgcctgtaatccaagcactttgggatgtcaaggtgggcagatcacgtgaggtcaggagttcaagaccagcctggccaacacggtgaaaccccgtctctactaaaaatacaaacattagccgggtatggtggtgggcacctgtaatctcagctacttggaggctgaggcaggagaatcgcttgaacccgggaggtggaggttgcagtgagccgagattgcgccactgcactccagcctgggcaacagagggacgctctgtctcaaaaaataaaaggttatgtaaatctagatgtaggaagaccaacatttgtgtcatcatggaggtcctgtggaggatatgagacgtatacattttattctagcttaggctggaagtagaagagtgttttggagagggcaatttgttatgtcattcaaattgtaggaatgtgtggagagtagaaattacctaatgagagttctgattattacatgcttttttcagagtgaggaacatgaaccttcaggataaaatcagtacttttctataagattgtttgttttgttttgttttgttttttgatatggagtctcactctgttgcctaggctggagtgcagtggcgtgatctcagagtgcagtggcgtgatctcagagtgcagtggcatgatcttggctcactgcaacctctgcctcccaggttcaagcgattctgctgcctcagcctccccagtagctgggattataggcgcccaccgccacggcaggctagtttttgtaggtttagtagagacaaggttgttggccaggctgatcacgaactcctgacctcaagtgatctgcccacctcggcctcccaaagtgctgggattacagggatgagccactgcacccggccttctataagattcttgacctttttaaaaaggaaaattaaaaaatttttaaatgttttttgtttcttttgagaacatttatcataataattactgaaccatttgaatatacaatggtgggaactcttccttaaatggcatagtgttttgtttggttggttggtttctggagccttttagaattttatgtaaaagagtttaattcttctccacttcaccccgtcaccaccactttccaggttggttctactgctgtccaagtaacttcagcagagcgaacaaaagtcctagggcaatcagtctttctaaatgacatttattatgcttcggaaattgaagaaatctgcctagtagatgagaaccagttcaccttaaccattgcaaaccagggcacgccgctcaccttcatgcaccaggagtgtgaagccattgtccagtctatcattcatatccggacccgctgggaactgtcacagcccgactctatcccccaacacaccaagattcggccaaaagatgtccctgggacactgctcaatatcgcattacttaatttaggcagttctgacccgagtttacggtaggttttttaaaattctcttcagtttgatttggggtttgttgcttttaaaatgagaccatttaatgaattttaaaacagcctctaccttaatattgtaaattggaaggtatgcagtgttggttaaccactgtgacctcatcaagttgtggggtattcacatgaactgtggaattccaaacagggtgattcacactaaaccaatatatgtcctttctccatcatgtaaaacaacacgacatagcagatttttttttccaaagtatcctaaattaagtttttcttcctctaagtcctctaatttttttccattttcagaagtatatcactatttagtttaaaagtcaagtcagattattgctttacaaaagaaggcctaatgttcaataacttggtaacattattgcatactttccacctacatcactcttaacaaaattctcaaaataaatcttaagacaaataagtcatctgagcagagtgtaattggttccatttaggcttaataacttgaatatgcatgtggaaagagcatggctgtggagtgagtagatgtggtttgaacagatatgccactttctagctatgtactttgagcaagatactgaagttttcagatatctagtttccttatttgtgaaataaaggtaattgcctttcttatatacccacaaaagcttaaaaaatagtatgtgtagtagtatagtatagcaaactagcaaatagtttatacttagtaagtagtattttcttatcttttccctccctgccagcatctccttgcaccctttctcccttttctcccctctccttaccaagttaggataattctttgtctcaagtaccctgagactttgaagatttttcagatgtaaattcttaacttctgaaaattttccctgaggataacatagcccaggttttatagtgggccttttaggattccaaattctcctttacttaaagggaaaaagaagaaaatcaagatatgtttacttggatgggcttcagaaattgtacataagattttgtgtatgctttgcttcctttatctcataggtgtctgtgacacctgtcctgggttgaggaagtccaattctttataagtgttgaaatacacaggataaaagttttgtcaaaattgtataacttagaattcctgggaattagtaaaagatacaagctgagcactggcactgtagtcccagctactcgggaggctgaggcgggaggacagcttgagctcaggagttcaaggctgcagtgtgctataatcatgtctgtgaatagccaatgcacaccagcctggggaacatagtgagactctgactaaaagttttttaaaaaagaaaaaagatatgtaaacagaaataataacactaattttcacattttaggaaaatggagctataagcctgcctttaatttctaattcaaagatcttcattgaaaaatacaaccttttaacaattattagcctgggtaaacctgtattcttctctagtgacctaaagcaatctctgacagcttctgctttttgctgaagcatgtcatcccagagaaaaagcctttaggcagacttaaattccagtggctttttttccctatatggttgttgcatcaatatagtagcatgataaacattcagaggtaaggaaaacctgacagttactgaacaaactatttcctttactggacaggggagaaaattaaaatttttaaattgagtctgagtcttttaggctgtctcctaaattgcttaaatatattttcagacatttgtaagtgatgtttggtctcaatgaaacctggatattatagtttttttccatattggtggttatatatgatgtaatgaggtcatagagggaaaaatgggaggacttaattataagttaattttgtttttaaccttcagtttgtagggtaacttttaggacacccagaaagaagttcagcagatcctgattaaagattttcacattctaatttgatgaagggaagggccatctgatatctgtccctatgatccccattataactggatctagtgggaaagagaaccagaatttgagttttggctttgctaaaaatgtatggtgtgccttattctgacttaatttctattgatccacattaggaccataagtcctctcatattttatgtctcagtgagatgtattttaggaaagcctataccccgcccctctgtcataggagcctcacagtgctcttatggttatatcaagtgtgtccctttttataaaatccctaaatgattaaggggtattttggttttactgtagaattataacatcttatttctaactgatcataaaatttaaaaatagttgatcatactttgtaacagaatcacaaattgtatgttatgaaaaaattttggaactataaggaaaaatacgttttaaaacaacttcatttgtgttttctcctaggtcagctgcctataatcttctgtgtgccttaacttgtacctttaatttaaaaatcgagggccagttactagagacatcaggtttatgtatccctgccaacaacaccctctttattgtctctattagtaagacactggcagccaatgagccacacctcacgttagaatttttggaagagtgtatttctggatttagcaaatctagtaagtaatgataattttctttaatactaacaattattctaagagaattcaaagaaaaccctttcatttcagaattttccagtgaagactttcacttacatttttactttttttcctcttctgattttatatctgtggtatcctgtaactgaaggaactctgaaggaactttttggtaggccacattgagaaatccaccaaaattctgataataaaagcaaagcggcaagagtttggtactttacacacctctggaccacttacaaagtattttcttcactgttgcagtttaattagcttcagcatttctcttcatagcagaaaagtccacataagtatccatgttgcctccttaattttagagaactagtcattttctcttttctttaggttgactttgaacaatgaatttattgtaaatgtacagttcacggagagcacagtggcacataatacagggcccagagtcagttctgactttgttttaactaagtcttataaatttaatatccactctttatatttgtccatctttatatcctatagttttataaatgttgatcttctcccagcatatttcctgaccttttcttccctttcctttccctgtaatatataaaacttttttttctgcattcaaacacatttcttgacttttatatattagataattaaaagcttcagcaattcactaagactctttgtcaggtaagagatgtaggactataaccctaacaaaaaaatgtgtaggactgacaaaacaagaaaagtataaactttattcataaatattaatatgagagaagatttgagtgaatgtaaaggcatattgtgttcctgcatgaacagttcttcccagattattacaaatttaatgtaatttcatcaaaataaccatgggatttgaggattgagaatggagatagaacttaaatgattctaaattctacataaaagtgcaataatagctaagaaaatattgaaaggaaagagacttgagacttaatagtacagatgtctgaacactttatagcagtacaataattaaaacatacatgtgcaagaatcagccatcagatcagtttaagagaaacagattgataaagaagcatcacaaactgatgagggagagattaaatcatttaataaatgaggctgggaaatgacttaaattaggtcttcgtcttcaccgtacaccataagataccaagtatgttctgcctgtatttaagagttgagtagggctgtgtgtggtggctctcgcctgtaatcccagcactttgggaggttgaggcaagaggattgtggcaggaggattgcttgagccccagaggtcagggctatagtgagctatcatcgtaccactgcactccagcctggatgatagagtgagacccttctctattaaaaaaaaaaaaaaaaaaaaaaaaaaaaaaaaaaagttgtatataaaagcttggaaccattttaaaaagaagaggaacaagtgaatatttaattgctttctagatgagtaaggacatatgaagtaaaaaagtgataggatgaaacaaaggaaatagcgaacagatttgactacataaaacttcaaaacatagctactcaaaaataaacacaagtgaagataattaaaaactaggaaatacacttggagcaaatatgagaaatgattaatatccttaatcggccagacgcggtggctcacgcctgtaatcccagcactttgggaggctgaggtgggtggatcacaaggtaaggagttcgagaccagcctggccaatatggtgaaatcccctctctactaaaaatacaaaaattagccgggctcggtggtacatgcctgtagtcccagctactcaggaggctgaggcaggagaattgcttgaacccaggaggcagaggttgcagtgagccgagatcactccactgcactccagcctgggcaacagagggagactctgtctcaaaataaataaatgaatgaataaatgaatgaatgaatgaataaaatccttaatcatgaagggtgctgaccgattaataaaaagtggattaacagtaacatacagatcatggttttttttttttttttattatactctaagttttagggtacatgtgcacattgtgcaggttagttacatatgtatacatgtgccatgctggtgcgctgcacccactactgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatgttttttaaaaaagaatatttgtacaaaaaaagaaaaaagccaggcaccatggcacatgcctgtaatcccacctgctcaggaggatcgctaagcccaggagtttgagaccagcctggacaacatagtgaggcccccatctcaaaaagaatatttatattttaagaaattcactaataaaagccaattgaaagaatagtgagataatcagttatcagcttggcaaagattttttttttaagatccattcctggtggtctgtggaattgtgagtagaggcaatttttctagaaaggcatttggaagtggataacaagaccttaagactattcataccttttggcctcataattctgctttttagcatttatcctaaagaattaatgttaaaatgtttattatagcattatttttatgtagatttttaaattgaggtatatcttgtcatcagtaaagtgcaagatcttaagtcaacagcttgatgaacttctacatgcaaatacatcatgaaagtatctccagatctagacatagaacatttctagcatccagagggatattctcagtaccctcccttcaccaagagtaaacactattatgacctctattgcacagatttattttgcctactttagaacttcatatgacattatttataatagcaaaaaaatgaacaggccaaaagtcaaagaataaggaactgattaaattattggttctccatctgatggaataatatgaagccattgaaaaatggctttgttacagaatttcagtttggaagatgaaaaggttctagagatggatggtggtgatggctgcacaatgatttgaatgtactcagtgccactgaactgtgcccttcaaaatgggtaaagccacggaactgtacatttaaaaatagttaaaatggtaaattttgtgttgtgtatattttaccacaattttaaaaactctttgagactttaggtaaagtgtatagataaatttttgtacaatttttgtcttataaatgtgaagctttttcaagtaagtttaaaagaagtttgcagaatttgtaatgttgaataaataatctcagtataggccaggggtggtggctcacgcctgtaatcccagcactttgggaggccgaggcgggcagatcacgaggtcaggagattgagaccatcctggctaacacagtgaaaccccgtctctactcaaaatatgaaaaaaaatttgccgggcgtggtggtgggcgcctgtagtcccagctactcgggaggctgaggcaggagaatggtgtgaacctgtgaacccgggaggcggaacttgcagtgagccgagatcgctcctctgcactccagcctgggcgacagaggagactccatctcaaaaaaaaaaaaaatgaataatctcagtataatcactgaaaaaaatattcagagcctactgcatgtatagcataatccccgtttttgcgggggagtgggagtgggttatacctgtgtacacacacataaatgtacattaactctacataaatttgaaagcctgaggagagatgagatgatacaccaatgttaatacagttttcattttgtggtgatgctttccttttaccaaactttctatgattaccacatttccttttataatgagaataaaacaactttttaacaagaaaggactaaaatggaggaaaataagacaaaacttttcaaaaattggcttactggcttttaaaattactttcttcaaggactgttctttcttcgcctctacaaaaatatatttgccaagtgtcttttctccaggcctgattctaggtaatagtctttaccttttaccattttttccccgaattctttatgttaaataattgttgatgtgattttcattgaccatcacatgctaatagtgtatttttttccaggtattgaattgaaacacctttgtttggaatacatgactccatggctgtcaaatctagttcgtttttgcaagcataatgatgatgccaaacgacaaagagttactgctattcttgacaagctgataacaatgaccatcaatgaaaaacagatgtacccatctattcaagcaaaaatatggggaagccttgggcaggtattgagtttgctcaaatatttatctagtatctcctttgtgcacatatttatctggtgccacattgggcaaagcactgcgctagacactagggatagagttgtaaaaaacacagtttcctccttcagaaagcatgtagacactcacccagctcttcatctggttcaaaattgtaaatgtctagtgcatgtctcagagccagagaaaagctagttatttgcacagtctccttcaaggcataattatatatatatatatatatataattatgccttgaaggagactgtgcaaataactagattttatatatatattatatagaactgtagaaatctggtgacatttctagtgctttattctagttctctacattccaaaggtgtcagtagatgtttcttcttattgatgctatttgggacatctgctttcatttatagttctacataagaatgccaatattaaaataggatataatgtaaattttatttttatctgacaagaattaggcatatcatttcttcaaagtaatcatttaaggaaataatgccctcactcaaacactgctgctcctcctccaaataattagaaataaccttggagccagtgttgcagccctagaaaacatcctggtacttaatgtcatttcctatattttatttttttttgagactgagtctcgctctgtcacccaggctggagtgcagtggtacagtctcggctcattgcaacctctgcctcccaggctcaagtgacccttccacctcagcctcccaagtagctgggcctacaggtgcacaccaacacacctggctaatttttgtatttttttttttttttttttttagagatagggttttgccatgttgcccaggctggtcttgaactcctggcctcaagcaatccgcccgcctcagcctccccaagtgctgggattacaagcgtgagccactgcacccagctctgtattttcaaattactattttatattgatgctacattactgtcttagaaaagcatagagatactttgcaagtgactgaagatagtattgatagagatttaaaatttttgaataccaatctcttaatctctgaaggagtcaaatgaatatactcatcctttactggatattttataataaattgtatttactgacaggcctgtaaataaaatctagtatttttgaggcctcaggtaaaatagaattttcatattgattaggctgttccaatgaatattttttaattaaaaattaaattggtagagtgattaaaaacatgttattttccttcttcaactagattacagatctgcttgatgttgtactagacagtttcatcaaaaccagtgcaacaggtggcttgggatcaataaaagctgaggtgatggcagatactgctgtagctttggcttctggaaatgtgaaattggtttcaagcaaggtaatcacttttcttttgccttctgtactatagcatatctgttttatcatcaggaggttttttgttttgtaattacttttaaattaaactgaacttttttgtgctaaaactttgagtcccatgtttttttttttaaaaaaaaaaatcctgcttctttacaggttattggaaggatgtgcaaaataattgacaagacatgcttatctccaactcctactttagaacaacatcttatgtgggatgatattgctattttagcacgctacatgctgatgctgtccttcaacaattcccttgatgtggcagctcatcttccctacctcttccacgttgttactttcttagtagccacaggtccgctctcccttagagcttccacacatggactggtcattaatatcattcactctctgtgtacttgttcacagcttcattttagtggtaagttctaggaaaggaatttgtgtttaccagttcctttctccattttacttcacctgatcaatatagattatcttatttatgtttgtgctctaacaccaagttgctaatttaagcctccagtaatgacatgaaatattaccaaaaagaaaataaattacttccattccatatcaagctatagtaaagattttctatgcatacttgtcatgtagagttatcccataagcggaatactcagtgccagttgaccatgttcagttaccagcactaatttgtagataaatgaagcaaggagcattaatacaatgtatctagaggtttgatttagggaacatgattatgtaatttttatatggtattcaaattttctaaattcaaaatgaaacatggaactttagaaattaaaaagtaatattttctgtctttacttgttcctttattctcttacagaagagaccaagcaagttttgagactcagtctgacagagttctcattacccaaattttacttgctgtttggcattagcaaagtcaagtcagctgctgtcattgccttccgttccagttaccgggacaggtcattctctcctggctcctatgagagagagacttttgctttgacatccttggaaacagtcacagaagctttgttggagatcatggaggtatagaagccaaaatgataagaaactaagttaaaatctttttttaaaaatatgttaatactatatagaagaaatattggtttattgtgctattttgtacttaatgcttaaataaaaacacttgcatggactgtgttattggtaacaggtcacttaatgacatcataataaacattatttaaacagttctaaaaacatttatgtacaatatgtattcagagtatccccttttttaggcatgcatgagagatattccaacgtgcaagtggctggaccagtggacagaactagctcaaaggtatgtcctaaattaaatataagttgtaaaaatatgcatattgttgaaaatacagctattactgtatgatcaatgttataatttattatttagtatatataaacacaaaggtttttataagttctgtggatcttttaattgcagatttgcattccaatataatccatccctgcaaccaagagctcttgttgtctttgggtgtattagcaaacgagtgtctcatgggcagataaagcagataatccgtattcttagcaaggtacctgttccgccctcacttctcccaaatatttatggttctcaagttgtaaagcatatctttcatttttctaaaagacgtttaaatttgaggtcaatgaaatatcttatatgttacttattaagcctttaaaatgtattttgattatttattgtaattctttgaagaagtcttctctaaagaagctgtctttatatgtaaactctgattacttcattaaggaagatgtctttaaaataaaatatgttgcctcttttgctaagcaggtacacttagtattttaccagttttcaaagcatttaattatatggtaagactatagccttgcataaaattatttaatttgtaattactataataatgtctgactcttataatgtagaaatgtcaaaaaataagaaaacaaatgtacattaagctagctaccaagatcaccatagcatgagaaatcattctagcatttattaaataagtaaatgttcctgaattcattccgagattcagtttaggagttaatgttttatttcaatgaaagtaaaataaaaaattctgttttcctaaaaggcacttgagagttgcttaaaaggacctgacacttacaacagtcaagttctgatagaagctacagtaatagcactaaccaaattacagccacttcttaataaggtaattactgtatagaaaatgagtgcattcattttgggtatcagtgttgaatgttactttctttcaaagagtttagaaaataagatgaattgagaataagttataaagaaaaaactatagttaaagtagaacctcttaaagtttagttgtttgaagtagtcatattagaagaagagtaagtatggatagtatgttctcaagcgcttgtaagtttttggtctcatcagtgctaaaggaaagataggtatatattcttaattattttatcttataactattaattatctgctattgccaagtactgttttaggcgctagagatagagtactaacaaagcccataaaactcactgccttcatggagcttactttctggggtgggtgtggaggttggggagtgaatggataatgaagtaaacaaaatacgtagtatgttagtgattattactatggagaaattaaagctgggagaagtatacttgatcgtcataagagtttgggtgccaaatgaagattatatttaaaaggagtaaaatgaagtggccactgttttaggatggtctgaccttatcccatttttatatttaagatatctggaaatcatgtttttgtattaataaaatgaaaaagattcgataatggcatggtattaccatccagttctaaagtggtttaattctgtgatttgagtacaaaggtatgccagacttgggagaaataacagagaaataatacctgttatattcctggtttgtctacaagcattctaattttgtattatacaaaatggttctctggtccccatcttctaagtgaaaatgagctcagaagggctaaataacttgcccaaagtcacatacctaataaaagaaccatgattctaatgtgatactatttgactctaaagtccatgtattttccctaatatcacagtgctaagtaaagattgccagtaataaatacttttaattcagagcagcaagagattaccatactggttaagagtgacaagaagttgaaaagacagtttaaaataaagttaaagggaaacataggagttaatgtaggtagagagaaagggagagagctgcacaagaatgccaggacaatggagggaaggtgggtagaacattctagttgtaatggagaagcttttcaaaggaatcgagagagggaaagttgtgaggactggatagacctcatctcacattcagcattgttcaaaagagtttggaaatgtacagtttttaagcagacaagtcatacgatgaaagcaggacttagctcctggtggtagtgtgcacagtggattggagtagggagaaactgaagtaaaaagaatccacctttataataaagaaggttggcatgtggtaatgtcattagcaataagaaagaaatgacaaaagatacaaaagagactactctagaagaatcaacaaaccttggtgactggatttagaaatcaaagaacagggagaagtcaaaggaggtgctaagtaacgttctcagtccagctaacagtgtctttagttatacatatggaaaagtgaagagcttactcatatctttatcttccccaaaagagaaaacatgggtaatttaggaagataagctgctttatttttaactgcagtgtgttttgaaagagactatgtcatgattcatcttactagcctcaaacatatcttctttgccaggactcgcctctgcacaaagccctcttttgggtagctgtggctgtgctgcagcttgatgaggtcaacttgtattcagcaggtaccgcacttcttgaacaaaacctgcatactttagatagtctccgtatattcaatgacaaggtaagcaaactttgccttgaggttcctagattactcaaatttagtactcttccatcttttcttgttgctattcttttaaaatcacaagaagtccataacttaagtaggaatttgtataatgtaacttattgtgagtatatttccttaccagctcataaagaactatgtaaacttgaatgcatattttttacataaaaatagcaaaaaaaaaaaaacaaaaaaaaaacagtactggcctaatactagtagaattacagaataaggataaataatacatgatcatccttacagaatgagcataaacaatacatggtaataatattaatagctaccatgccaggccgtatgctaaacactatacatttatttttaattttcataaccttaaggtaaaggttagcattctctgccccccatttcacacgtgaagaaataatctaaaagtaatcttagttttacttaataatgccacttaatgaaaaatacgtataattcatagtagataaggaagttggagagtctaaaggaaacttttgggtacttaattttactagtttttttattctgtctaatcttactttaaaatataccattagtggccaggagtggtggctcatacctgtagtcccagcactttgggaggccaagacaggtggatcagttgagctcaggagttagagaacagcctgggcaacttgcaaaaccccatctctacaaaaaaggcaaaaattagctaggcatggtggcatgcacctacaatcccagctactcgggaggtgaggtaggaggattgcttgagcctgggaggcagaggttgcagtgagctgagatcacgccactgcactccagcttgggcaacagagcaagaccctgtctccaaaaaaaagtgtgtatacatatattacatacacacatatatatgtaatgtatgtgtatatatatatataaagtgtgtgtgtgtgtgtgtgtgtgtgtacacacataaaatatgtaaaatccaactccaattaaggttaataaatgttaggaggggtgctaatggggtgtgtgtgtgtgtgtgcacgtgtgcatgtgtgtgtgtatatatatatgaacatgggcaaattacttcttagttcctttctaatttgtaaaatggagatctaattggggttggattttagttcatagagaatagaggagagaataaaatagtatgaaattacgtcccttttgtctttggataaaaatgggaagggtctaggagaaaagaggggaatgtttttaaaagaatgtgtatatacagtgagatttgcttgaagtgaaattaactgaactgtgggtacaaagaacaggattatggttttaagtgtaaaaagatacttggtctaaacattattagttcagtctaccagatgtagtgtgaacctggaacagatatgggtctgaaaaatatagaagcaaaattttagaggtaagaggtcttatggagtttattaatcagacctccattttgcaaattagaaaggaactaagaagttaagtaacttgcccatgcttgtacatctgttttgggactagaacccctctgtcctaattctcattgccgtttttctaaaactgttttgggacagtggtggtcagcgatatctagttgttggctatttatatgttaagaatatttgcaaattggccgggtgcaatggcgcatgtttgtaattccagcactctgggaggccgagttgggaggatcacttgaggttaggagttcgagaccagcctggccaacatggtgacaccctgtctctactaaaaatacaaaaattagccagggtggcacatgtttgtaactccagcgacctgggaggctgaggtgggaagatctcttgaacccaggaggttgcagtgagccaaggtggtgccactgcactccagcctgggcgacagagtaagactccatctcaaaaaaagaatatttgcaaatggagcattgcaaatggggcatctgcctcggtattttcatcttcaaaacagcccagtagcgggagctaatattgattctagtgccctttggatgctaggcatcagagttaataagcatgttaaaagtcaccgggatgtaaattgacagtcatttattttgtattgtaaataaaagtgatttcatcttccaccatcttcttatttatatgcttgactgtcttgcaccagttaatttgtagtagctaaaatgttctgtggttttctgcagtcaactgaaaataatttctctcaaattgaaaggattacttatcttgtcatactattgaacacaaaattaagtgagcctttaaagaaagctactgtgtgaacctcatcaaccatctcatgattatctttaatagagtccagaggaagtatttatggcaatccggaatcctctggagtggcactgcaagcaaatggatcattttgttggactcaatttcaactctaactttaactttgcattggttggacaccttttaaaaggtaaaaaagccttatttagaatatttttatgaagtactattaagaaaccagaagtaatttgaataagtgattacttgaaataaattgaagtaagttagcccttatgtcttactttaaatgcaaactaggccaggcgtggtggctcacgtctgtaataccaacattttgggaggctgaggcaggaggatcacttgaggctaggagtttgaggccagcctgggcaacatagtgagacttcatctctacagaaaatttaaaaattagccaggcatggtggcacgtgcttgtagtcccagctacttaggaggcatagatggaaggattgcttgagcctgggaagtcgaggctacagtgagccgtgatcacaccactgcactcagccctaggtaacagagtgagactttgtctcaaaaaataaataaataaatgcaaactatatctgtcttaatgagttgtgttttattcaatatgtgttttaagagagcttcatttccaattcaaatatcaaatttgcctgaaaaacaaaagagtttattctggctgggtatggtggctcacacctgtagtcccagcactctgggaggccaaagcagaaggatctcttgagcttaggagttcgagaccagcctgggcaatatggtgaaaccccctttctacaaaaaataaaaacattagccaggtgcggtggcacatgcctatagtgccagctacttgggatgctgaggaaggagaatcacttgagcccaggaggtcaaggctgcagtgggccatgatcgtgccactgcactccagcctgggtgacagagtgagaccctgcctttaaaaaaaaaaaaaaaaaagtgttgattcttacaaaaacctacatactgagtctgataatagctatattaatagtaacaatacctaagtatcttactgattttcaaaatgaaacagactgcaaatcactaagtgttatttgaataatttatattagaaaatgttaagagatttgatcacagattttcttcaacttgtttatagtttattgttgattaatactattattttataccattgtacatcacctttctggcaccctattctcacccctttctatattgcttatagccagtgatctccagctattcctcagagcccgctcattcacttcctaacctggttttactccccgttgctgacttcacagcttgttaactttggttcattaacatggggcagtcatggccagagactgcagttaataagaacagcatgtagtggtgggtcagaagcaaagcaggataaagtaagacctgggataaggagctggcatgaaccccagtggtctcagaagtggatttggccacaatagagattcaagctatagcttgagtcaacaattttgtattaatttaaatcataggcttgagggaccatggagattctcccagtttttatgagagagagagagatatgcatacacccactattgtgaatgtatgcatttgatttcactttcttatgaaatttctacaaaaaatattgacagtgttaatctctaaggtcaatggggatttctcaaaaaatactaccttactaaaggataccaagataagtaattgtaactgggctaataaagtgcttaattattctttatatctaaaagaataccaggctgggtgcagcggctcatgcctgtaatcccaacactttgggaggctgaggcaggtggattgcttgaggccaagagttcaagaccagcctggccaacatggtgaaacccctgcttgaaggcaggagttcaagaccagcctggccaacacggtgaaaccccatctctactaaaaatacaaaaattaggcaggtgaggtggtgcaaacctgtagtttcagccactcaggaggctgaggcacaagaatcgcttgaacctgggaggcagaggttgcagtgagccaagatcctaccactgcactccagcctttgtgacagagtgacactctgtcttaaaagacaagaaaagaaaagaagaccagatactttccatgttcaaatcacctatttttaaatgggggaaggattaatgattaaaagctggccaaagatcaaatttatcctctaatcaaccctatttattgggctcttagagcatatacttcctatgtcatcagcttttcttttaattaaaaatgtttttgtattccgcctgcgactcggtcccggcgctgggctgaggggaggggttgtcttaaaagtctctccttccccctgtaggggcggccggcgagtcccagtgagagcggagggtgccagaggtagggggccgagaaacaaagttcccggggctccctccggggccgcggtcggggctgcgcgtttgaccgcccccctcctcgcgaaggcaatggcttccaaactcctgcgcgcggtcatcctcgggccgcccggctcgggcaagggcaccgtgtgccagaggatcgcccagaactttggtctccagcatctctccagcggccacttcttgcgggagaacatcaaggccagcaccgaagttggtgagatggcaaagcagtatatagagaaaagtcttttggttccagaccatgtgatcacacgcctaatgatgtccgagttggagaataggcgtggccagcactggctccttgatggttttcctaggacattaggacaagccgaagccctggacaaaatctgtgaagtggatctagtgatcagtttgaatattccatttgaaacacttaaagatcgtctcagccgccgttggattcaccctcctagcggaagggtatataacctggacttcaatccacctcatgtacatggtattgatgacgtcactggtgaaccattagtccagcaggaggatgataaacccgaagcagttgctgccaggctaagacagtacaaagacgtggcaaagccagtcattgaattatacaagagccgaggagtgctccaccaattttccggaacggagacgaacaaaatctggccctacgtttacacacttttctcaaacaagatcacacctattcagtccaaagaagcatattgaccctgcccaatggaagaaccaggaagatgtggtcattcattcagtagtgtgtgtagtattggtgctgtgtccaaattagaagctagctgaggtagcttgcagcatcttttctagttgaaatggtgaactgataggaaaacaaatgagtagaaagagttcatgaagaggccctcctctgcctttcaaaagggtggtcacctacacatgtttaaggtgtctctgcacatgtctcaagcccatcacaagaaagcaagtacagtgtggatttcaaatggtgtgtaacttcagctccagctggtttttgacagctgttgctgtggtaatattttttacatgtgatggtgatagtctctggttctccccatccccacaaaggctgttgaaccacagcaccaggaagcctgagaatgaatcctgagggctctagcccaggctttgtcccaggctttctggtgtgtgccctcctggtaacagtgaaattgaagctacttactcatagtggttgtttctctagtcttgagtgactgtgtccacagttcatttttttccggtaggaataactccttttctacatccacactccatagagtctctccttttcagacatcctgggatgaaagaatttggcttttttttttttttttttttttacatctgttttcactcttaggcttttaaacaatagttattgctcttatccctctcagattctaataactgagagcgatggggctatattgaatctctgtatgcactgataactgagctatgaagaggatcttattaaactgctggtctgactctatggattgacactgttcctttcttttattgtgaaaaaaaaaacccctgaaagtcttgggaaccccctaaagtcttttgggaatcctcaaaaagcatgggaagttaagtatttagctacataaatgttgtaagatcatatcttatgtatagaagtaataagaccatttggaattactggactaattgaatagttaaggtttctattcgggacaataaaatgtattttgaaagtgctgctaactattgatgctgacagtgtttcactcctatgagtgacccaaacatattataaatatgtggtaaagggaatggagcctgtggggttgagcagaatgttgtactagctgtgcctggactgagtataacagctttatgattatgagaaaacaaattctttatttttttttctgttccaaagattcatcctatggggtggccataaagtctagaattagatactaatattttgtcattcattataacatatcgataaaccatttgttaaaagatttgcctggtttccagacttggtggccaccttgaataattcttgctgtcttctgggaaggatgatgaaatttattcctgctgccttaaaaatatgtatcccttcttcacccatcatgactgtccccagtgagtgtcctttactattcttgggagtgactcctgtctaacttttcatactggcgagaagaaaagaagcctattttaacactttagtggtgttgaaacacattacttactttctgaagatgtcccagtgaatcctctgtcaattcactgccatatgtaatctatatgataaggaatgcatcttccttctaagtactgcccaaactcttgccagctcctctcccattgtcccttcatgtgaatatttcttggctaccttagtggaaatatagatcagtcttctccccatccatcctctcaaacataatgagattgtttactttttagatttatgcagtgaaaatgcccagtcaggtctgaatcgtcagtgcattatattgactctgagcactttagaatttagagttgcaattgaatgccagctgtggagatggggtgcatatcagatatataaataaagctcaggtttgctagggaaccaggtatagagaaaaataagtctgatatgaggaaggaaaattgcacaatttagagtagttatgccatagagaaaatttccacaaactaggaaatgtagagagttattctatagaatactcaaaagaggaaagtatgtgatttttggaaacaggaaaatcttcaaacttctttcttcacttccctttgtgtttagctgaccctccaatgtgatcattgcctttggagtttgggagaggtacgggaagtggcctgatccctgcttccatacttcactcctccatccatccttccctccctcttcccctccagctaaatggacaattctagccaacattgagtcactcaataagtctcaacagtgggtgtgtttgctgagattgtccagcagttgagcagtttggtctcacctccctcgctagttgagaccaaaaagagacaaataactttttcatggtctttgaaacataatgcttatttcgtggtcaatggctttaaaaaaatctgtttcttgttttcttcaacaaactcactagttttcccttaactgatattgtaaaaattaaagtaatcttgaaaatgttttgacaaaagtaaaattaaagggacatcttttcttaaaaaaaaaaatgtttttgtaaaagaaccctattttcaaatgaaatcttaaggagaattataatacatagatttttttttttaatctctgtgctgctttagggaatagaagatctgaaagactatcatgttttttaattttcctcttcctggagtactgtagagttctagggaatattatattctacacatttttggtacttaatcttatacataattaattattctcattcacatatgcatgttttaccttcccaaatggctattcttggaaagtaggagttatatttcctttccttgcagagttgttagtcagggaagaagacctcagcagatgcttgttcaaaaaattaattcttacttgtttgtttgtttgtttgtttgttttttgtagggtacaggcatccttcacctgctattgttgcaagaacagtcagaattttacatacactactaactctggttaacaaacacagaaattgtgacaaatttgaagtgaatacacagagcgtggcctacttagcaggtaaaaacacaaaataaacaaaattaatcttgctacatctatatataaggatcacccaaaaagtacaaatacctataggttttttggcggttgcgtggcagagcagaaagttcacagtctagtcctttagtggtggttacaattttgagagttttgccagaacatttttctgtaggaaaaaatttaattcccattaaaatctgaaatgtgttcccttggtcatctttggttcaagacactacagtggctctctgttatctgtcataaaatctgaatgcttcagtctagcaccctgggtccttaaatagccctctcagttctgttatctttctctaaatttcatgagcctcattttttattaccactccaaatggatgagctattttaagctaatctacttgccatctcctacaagcaactgcctcttcaatattcattccttatgtcattttatctggagtatctgccctatccccaccattccattaaagcttcctatttgctcttatctgatttttgtttctctactcagcaacacttagcacttatgtacaatacaattcttgaacatagttgtttgatagaaagtgctgattctcagtttcacagacttgtatttgttcaacttttttgtttgaaccgtatcatcttgagcaaatcatttaacatctcagtattttttctcattcagcttaataatacctgccctgcctactttgtgtttgttaaagatcaaatgtatattaaagaacttggaaaataaaagatgcttattaaatctctctgtatatttcacatttatgtagtcttccaaaatatgtgcacatttaacaggtactatgctctttaggagactgtaagaagttcatcctgttttaagtcacacttgtgatttgttaaattttttaacctgccaccgttttccttttagctttacttacagtgtctgaagaagttcgaagtcgctgcagcctaaaacatagaaagtcacttcttcttactgatatttcaatggaaaatgttcctatggatacatatcccattcatcatggtgacccttcctataggtaagtggatttactctcctataattacataatcataatcaagtttcaattttccaactaatggaggcaagcagcagagtaatctagaaggtaacatgggagaaatctagagatggcctaggaagagtaagtgaaactcattttataaatgtgtggtattttatgtgggttagtaggaaagttattcttccagtctgattgtgctaatgttaacattagtttgcctctgaagcacagaccaaatgaacaatgaaaagagatgctcttgaaaatattaggttgcaggggaagggcctggggaaaaaaactaacgcgaaatataaacaacacattacgtgcttggatagagaacgaatctatacagatttgtaaaaatacaggcatgctaacacatttgttgtatttactcatatcacacaagttatttaaaagttttctataatgtagacatagatggtaaaaattatatctgctatacatgggtttgggtagtatatttttcagtataatttagagaaatttcatgaaaatggcatcattgggggatttttctgtattttcaattaaataaaaatatctttaaggtttagggacagtgttgaacacagaaaagttatcttctgttcgcaaaactcgtatcattccatttatcaacatcctgctttttgataaaaagacttcaacaatttccttaagattctaacaatgtacgcaaaaatttttcaaacatggtattcaatagtcttactttcgtcagtcccattattatattactttgagatatgccctttttgttatagaaagggtaaaatagtttgcctgtgttcccctgtcaaagtataaattaatatctgattttcttggtttttaaacaattgcctatttagacttaattttttctgatttaaaaaaaatcagtgcaataagttcaaggtcttttatcaacataactacagttaatgtattttatacttgaaaatagctacgagtagattttaagtattctcaccacaaaagataaatatatgaggtaacacatatgttaatttgcttgatttagccattctacaatgtaaacattttatttatttttatttttctttattaattttttttgagacagagtcttgctctgtcgcccaggctggagtgcagtaacacaatctcggctcactacaacctccgcctcctgggttcaagcgattctcctgcctcatcctcccgagtagctgggattacaggcgcgtgccaccatgcccagctaatttttgtatttttgtagagatggggtttcaccatgttgggcaagctggtcttgaactcctgacctcaggtgatccgcctgcctcggcctcccaaagtgttgggattacaggcgtgagccacagcgcccagccaatgtaaacatattttaaaacatcatgttgtacaccaagcttgctcaacccatggcctgcaggccgcacgcagcccaggatggctttgaatgcagcccaacacaaatttgtaaactttcttaaaacattaagtgattttttggggtttttttttttttttaagctcatcaactgtagttagtgttagtgtattttatatgtggcccagtatattcttctaattccagtgtggcccaggaaagctaagagattggacacccctgttgctatacctttttatttgtcagcttttaaaaattgcagtacagatctttttgttcagcatttggtgagtacctactatgtgcaagatactatggcaagaaagttgataattcctagggatacaccaagagtttgtatcctaaagccctttaaagtgcaattttaaaattaattgattgctgttgttaggaaataggacagccacttggaaggagcaaacgatggttgtatttgtcaccatattaattgatttttctctattgttttcatctttcaggacactaaaggagactcagccatggtcctctcccaaaggttctgaaggataccttgcagccacctatccaactgtcggccagaccagtccccgagccaggaaatccatgagcctggacatggggcaaccttctcaggccaacactaagaagttgcttggttagtttatctaaattatgtagattttttttattatttaaaaaaatagatatttttactcttggaaaattatttgaaatttcaggattatcaaaattttccatgtcagtgtagcaaagtttttgatgccatttaaaagagagtttgatagatcagttaagcattataagttgagatagagaaatgagaatgggaccttgaaacagttttttctgaatcttatactaaatattgtgactctccttattttgttttgcctttgctggccagcagggaatgggactctgagacatattagataaatacctataagaaaggaagagtcttgctgcactcaggggatttaatgatatactgtaatacttcccaaaattatcatctgagagaatatatgaatatggtatgaagctgtaatagtactatttgccgtgctttctttgaaaagacaaaaagacatgcttctcaattaccgaaagaaaataggattcttttttttcttttttcttttcttgatatgaagtcttgttctgttcacccaggctggagtgcagtggcgcaatctcagctcactgcaacctctgcctcccgggctcaagcaattctcctgcctcatcctccctagtagctgggtttacaggcacacgtcaccacatctggctaacttttgtatttttagtagagacagagtttcaccatgttggccaggctagtcttgaactcctgacctcaggtgatacaccctcctcggcctcccaaagtgctgagattacaggcatgagccaccatgcccggccggaagataggattcttgaaattaagattgctcagttacatcaacatttatagaatttttgtctctgagaagtacacctgaaatgctgcgagactcatttccattttagtaactgaaagtaaatgaatgaaaaaacccactaggccaggtgcagtggctcacgcccataatcccagcactttgagggactcaggtgggaggattgctcgagtccaggagttcaagaccagcctgggcaacatgacaaaacccatctctacaaaaaatacaaaacttagctgggcatggtgacgagcacctctagtcccagctacttgggaagatcacttgagcccaggaggtgggggtagcagtaagccaagattgcaccactgcactccagcctgggtgacagagtgggaccccgactccaaacaaacaaacaaacaaaaacactgatcttacatcgctcctcagaggaaatgcagagatgttcttgcattccattgggtaaaattgtaattgttactggaatacattaggatctgtatttcagtagccagcactgaatggttcaacagatttcagttatccatgcaaacatatttaagtatctttaggtattggaaaaatgtttgtgttcataaggaaattagtgaacaaacaacaaattgtaacataaataacgtgccagtaaaccgtgaaagaaatagaaaccatgaatgtgtcaatcacagttactagccacataggtgtgttactgttgtttgagttcccttctgttagtaccttgccataaataatcatttaggagtttcctggttactttgtgttttgtaattctggattttcatgccaatgaagttgtaaatgaaaaactaacctcagaaaaaaatatattgaattcattcaacccatgtactaagtgaaaaagataaggtaactgccctggaagactttgtaatttgtgtccaagacttataatcagccaatcacaacagcaactccaggtgccattaaaatgatatgtcttgatggagaaagctggagatctggggaaattagaagaaaaaaaactgcagagaggagataacatttgggctgtgtcataaagatttaatatatgcttgcaaaatagcaggataagtaggggcatatgtttaagagcagtggggaatagcaagaataaagaaaaggcaggaaagcaactgatgatacatcatggcatcatggggaatggggtaggaaatgagatgagaagaaggactagaactcgattggaaacgactgtatgccatggtaagatatttacccttatcacacattcagctgaggtatttaagtaggagaagaacatgaccaaattttaatttttgccaagtttttctagcagcaatgtggagagacaggaagagatttttagcaagggaaccatttaataaaattgatatagcagtccaagcaaaaaaaatggtgtgggccccgcactaatgcaggagcaatgggagaatggagaagaaccagcaggtttggagctgggcataatggtacacacctctagtcccaggaactcaggaggccaaggcaggaggattgtttgaggctgacctgggcagcatagtcagaccctgtctcaaaaaaaacaaaaatcaggtttggaataggtttctgaagtacaatggacatgacttagtgaccaattgttgcaggtggggaaggggagaagactgtgaaggatgtcagaagcttttagttttaaaaactgtctagatagtgataccattcatagagatcaggactaatacgttcacagtacatgataaatttaggttgattacatttgatatattttcaagacatctatgagtatatatctaagagataaaccacaagatgtacctggaattcgggaagaaagtaaacaagtaaacatttagaattgattagctcacagatagttgaagctatggaagcagaatgagatcttccaggaagaatgcagagaataaaataaaaaggacaagtgagaaaggaaggaaaactaaatgtagaaagtagtgtcccaatctcatgtactttggaaagcactgactggttttagaaaacctgagttttccatctggtcattgtctagatccctagccatgctacctcagactaattacttaactgctcatggcttcatcagtgtacatgtgcatgaaacgaagaagccggactagatccctttggactgttaaattatttggccttggtatttatgactattatgaatagttattcatattcttgaggtaatagactttgtatttctcaagtgttaaattgtcagattttattatattggctttaattctggctttaataaaataatactgttggccgggcatggtggctcatgcctgtaatcccagcactctggggagaccaaggcaggtggattgcttgagcccaggagttcgagaccagcctgggcaacatggagaaaccctgtctctactaaaaatagaaaaatcagctgggtgtggtagtgtgtgcctgtagtcccagctactggggaggctgatgtgggaggatcacctgagcccaggatgtggaggttgcagtgagctgaaatcatatcactgcactccagcctgggccacagagcgagaccctatcaaaagaaaaaaatagtgttaatacatgattacatgattagagaaactaaaagccaaatgggagataatgctacttgctatttttgaagcatctcccagtgtatctggtttttagtattttcaggcatgcatatctttttttcaaagcttaaaaaattaaaatcaaactctgctttcttcctaagcttggaaattactcatgtattaatgagtagttcttggcaccagcagcgtttcttaaactgaaaagactggtcagacatagttgacctttgctactgaataatgcctaccattgcatttattatcagttatcatatttgttgatttacctccagtgtagtttggtttacctccagtgtacagaatacaatctcagtttaatttgcaccagtaaggtgcaacctatcctgaaacagaaagctatgggaacaaaaccctttgagaagatggaaaataaaggaaagaaactgctccagggatgtattagagctttctttgagtcctcagtgaaagcttaaacactttatgtccaaacattttctttttagtgtattcccatttatagacactgtagttaatgaacttgcatattcttaacttttgtttataggaacaaggaaaagttttgatcacttgatatcagacacaaaggctcctaaaaggcaagaaatggaatcagggatcacaacaccccccaaaatgaggagagtagcagaaactgattatgaaatgggtgagaaacaaagtattgatctagatcattgaaaataaggtgggagagtacatgaaagtcatgtttattttccagccatttcttagaatctttagagtgaaatatagaaacgtttgccatttctcaaaagataaactctaccattcaagacagttatcttgaagcttgtgtaaaaattaatcatatatattatatacagcattgtaaataggtagccaaaacttttgtgtaggcgaatagtaattctctatgatgtttatgttagtattttaagtatctactaaagaaagctgttgaattttagaagtaacattgaaatagttaggtgaagtgattatccaggtgtttgatcacgttaattccctatcttgctgcagaaactcagaggatttcctcatcacaacagcacccacatttacgtaaagtttcagtgtctgaatcaaatgttctcttggatgaagaagtacttactgatccgaagatccaggcgctgcttcttactgttctagtaaggatttcccctttttgagtcccccaccctcaaatttttattccagtctacttttaggaggcccttaaatattaaaaacatgaataggatacagtcttctacttctcacccaaacagataacaattcagccacaaagtaaaaatgttgtgtgtttacttttttgcatcttggcaggctacactggtaaaatataccacagatgagtttgatcaacgaattctttatgaatacttagcagaggccagtgttgtgtttcccaaagtctttcctgttgtgtaagtatctccttttgattttaattcaccttcgtgcctgtctttaagttaaatgcttacccagtaatgtgcactggttgcaaagagggcaaaatgagatattgtgatagtgattttagctttgagacagtaggtttaatgagggttaagattagttttgacctactagatctattagaaagtttataaggaaagacttttaaaaaatctggttgatttatttaagtggtttattttgatgatcattgctcattttcctcacttagaagcaaactattagactgctatatctaaatcagcatatctgttttggtttactttttagtagagcttttgtatttatccacagctgagtgaaaacaaaattgaccttctgtttaggaggtgaattgtttactctctcttaaggactaaaaaatattaacctcaaagtgttcaaatttaaatagttcaaataaattcttttcctgatctaggccttctatatcatgtcattattttctttttttaatctcatgttagaattttagagagttagaactcagttatttttattaatggagtgtagccgggttagaaataatttttttcctaagtttcagttggatcatgtatttcactccctctaaactattttgctttccctatttgatctgactcagcattttaaaagcactgattaacattaaatttaatttttttctttttgttttgcacagatcctaaatttagttttaacttcctaagcgcatgtcagtatacaacagatggaaatagtactaaaacatgctaagtagcagacagagccaaccttgtcttaagcaaacatttaccgtatatggttacacatggttatatgacactaccagttgtttgttttcacaatttcttccctggtgactaaaaacaaaagacaaacaaaaacagacacacacacatgttcattgtagaaaatttggaaaatgaagaaatgccccagaaagtaaaaagcactcatctccctttaattttggcacattattctggggaatgtatattatgttttccactacatattttcatttaattttcctctaaaatgttcctctgttgactttttttttcttttaggcataatttgttggactctaagatcaacaccctgttatcattgtgccaagatccaaatttgttaaatccaatccatggaattgtgcagagtgtggtgtaccatgaagaatccccaccacaataccaaacatcttacctgcaaagtaaataaatgtatctggagaaggatggttgatgaacttgctaacatgcgcgctgttgtagaatgcactgactacagaattctttataagggatagacttgttcatacttttatttccatattccatttttttactctctcaactgtatgtccaatgtaactggttgacaactttttatgctgagtatattttaagtaggttttagttgctttgacactcattctaaaaacatgttttcaacatgtacatagggtttatatatcatcagctatatgacttatttaatttctgttacaattaaaagataccttgcttgttataagagtaaaatttgatttgttgcaggttttggttttaatggcttgtggcggtttgcaggaccgttttcaaaggtaagaaaatatatttttctctaacttttggcaaaatgaaggtttctgttcaaattagtatgcctgctttaagaacacacaatgtgctgaaaaccagaaaaataattcacaataaacacatatgttacttttataaaaagtttctcatcacaaggtttttttccaggaggcagcatggtgttggggtgtgtgtattcacttttacaaacaaagtcaacttatgatcaatttttcagaagagtatgataaacctctgtgatacttttctgccacagtcccttgtgtatttgataatcttaatgcacacagttagatatcttatgactagcaaggagcattaccatggttaaaatctatttcatgaaaacatttttatttccagcctattagattagattaatttctctctggatttgtcctcatttgctcttattcagtttttttgtttgtttgtttgttttgtgagacggagtctcactctgtctccaggctggagtgcagtggcgcaatcttggctcactgcaacctctgcctcccaggttcaagcgattctcctgcctcagtctcccgagtagctgagactacaggcatgcagcaccacgcccagctaatttttgtatttttagtagaaacagggtttcaccatgttggccaggatggtcttgatctcttgacctcgtgatctgcccacctcggcctcccaaagtgctgggattacaggcatgagccaccgcacctggcctcagtttgttttttgattggcattagtttatgtagtgctacataagatgtatatgatcattttctctgtatgtgggctctctccaaattgatcaaagttccttgaagacagggtttctgtttcttccttaaacagttcctggtgcagtgttttagatacagggggtgctaaatcaatatgaattgtataaaccttgttccagtttttaagaattgggtattttatttatttcctttcactattacttgaatatctgtcaacatgcaaaggttgtcacttaaaaaatgggcctgaagttacagaaataagtatatcatacagaagtttttgcatttggattgccagtaaccctctgagccctttacagtgtctagtgagtggaatctaaatggcagctggaatgatgatgctctgctcattttctctgttttggaaaattggctagacatcattcctggtgattgtattgtctcagtattacattcagtctgtcttgtgcatggctttcagaaaatgcaggttcatctggaagctttaagctgaatagaactccctgttgtaagtcctatggtagtctataaatattactccactccccttttttaatgataagtaatacaaaggaagaaaaatagtaaattaagtccaaacaaaattaatatttttggcttcagatggggatttacttaaaaaaaaggaactaaaataatttcctattttccattacagcaaacacaaattccagactatgctgagcttattgttaagtttcttgatgccttgattgacacgtacctgcctggaattgatgaagaaaccagtgaagaatccctcctgactcccacatctccttaccctcctgcactgcagagccagcttagtatcactgccaaccttaacctttctaattccatgacctcacttgcaacttcccagcattccccaggtcagtaaatgtgatctttatatgactttgagcaacaatataagacaccaacattaggaattcccttgtgatcagtttatagcaaattttgctcctttttcttatgagattcaccttacatttcttctttaccttgtaactgacttgacttttgttattctatgaagctttctactttcaaacaagttgtacataagacagtaaaatgttaaaatgtccacatgatattccaaggttgacaagtttgtagagtttgggcaggaagaggaacttaaaacacattattctgtaagtgaacagaactataatttatttactagatatactaacattgccctaagggcctctttctctgtctctgatacagcatactatatcaaaaaaaaaaaaaaaaaaaaaaaaaaagaagaagaagaagaaacacaaaatctattaggtacctcactttcctgctgccagcaataactcaaccatccatagaccatcctgaaaatctggaagtaaataaataatcaaacaaaaaattcatctcaagaaaataacatcttaaagcccataagcatatatataccaattcgtaatgcaacttagatttgaatacactgagaaatactaatagctaatagctccagtgggactgagataaacaaggtgggagaaatggcaaacctacagaactctggacttattcagtgtcatagtgaatggtttcatacaactctggttgaccctggaggtgctattcattatagaacttaaactattgtgtgtgttattatgacagtgagtaatgaaggaaagcttttgttatggttgtgttttctatttagaaagatattcttctaaaatggttaaaaataaaagaaactttagttgtttaacgttccattatctgaaaagttcacttatgaaacacatcattgtataaggaaaagttactatatatagttcttttaagtgttagcataaatttaaaaaaaatccaatgacataactattctgtgatattcaagatcaataaatagaattcccagtttatgatctcagttttgcatgaacatttcaacttatgtaattttgaaggttctgaagaatttggcaatacccaattcatattataaactattatgtaattaactatattctattaaattctgcttaacaacaaagctttggtcagcagaggaaacaaattttatttccacatttgtcagtcgccttacaagtaatccttttttcccccagaagtaagagaagtctaactttttttcccatgtaacaaggtttgtttgccctctgccactaactctctagtacagtgtttctccacgtgtgatcccagaccagcagcatcatttgggagcttgttagaaatgcagatgctgtagtttcacctcagatctgcacaaaaaactcccaagtagagcccagccagcagtcagtgtgttaataaataccccaggcgattcttacacacactagaattggagaagcactgccctggggtctgcttctggtcttgcccattatcagcatttcagctgtgaaggccagggcaaaacttaaaatttactttttttacagatactgcagccactgaattccttcctgcttccccgctgataaaccttttagcattttggagctagggaaccatacaggtaatttagttttaggctcacaatattgtgtacattggggagactgagttttagaagagctgggttaactgctttatacagttcttatctagaaccaaggccaggcccttttgtactacattcattgccttccatggctgttgtctgtttgattatctatctactttcccttctccttctttatttccttgtttttgtttgtttattgctaattcattacttctgtctgccttgccttaagcccaccagttcttttttttctgttggactattttctgggttactgaacagaagttgaaaagtttttaaaagtctgcttcatcttaaccaagcttttgccttttgggctactaaactggtgttaaacatgtcaaaaatggttagtttttttattgactttttttacccagtctaattgtagggaaatttctgcctatctttgcccactaatggagacaataaaataatctggatgagaataaagaaccattacaggtttctctgctatttgattagttgcatatgtccagtgttgattggctatttgccaaatcatttgctttggtgaaacagtcttactctacaaccttttacttaaaattgtttattaaaatcagaataggttttatggctttggttccagtttcaaactaatggtgtcacctccattagctctccaaagttggtgcctttattcaggctggaaatctctgactatacacagaagagatgaggaggtttaaaagtaatagagttaagtggtattgtggtgttcaactcttcctgtcactcaattgtgtgtcattggtttgacagtttattttactacatgttttcagagaaagggtttatcttttcaaaagtaaccttactctcccacaaaacccatttgtatctctaaattacaggctcatgttcacaaaaggatcccaatttatatgcccaatcactgagtttttgtcatttgctcttacagaataactcttaatggtaagagttgatcttttgtttataattaggtatattgcttcatatctttagctccatgtaatcttatatccttatctctctctttttttttttttttttttgagacagagtctcgctctgtcgccgaggctggagtcagtggtgcgatctcgactcactgcaacctctgcctcccaggttcatgccattcttctgcctcagcctcccgagtagctgggactacaggcgcccaccaccacacctggctaattttttgtatttttagtagagatggggttttatggtgttagccaggatgatctcgatctcctgacctcgtgatccacccacttcagcctcccaaagtgctgggattacaggcgtgagccactgcgcccagcattttttttttttttccccctttggagacagtgtctcgctcagtagcccaggctggagtgcagtggcgcagtcttggctcactgcaacctctgcctccttggttcaagctattcccctgcctcagcctccctagtagctggaattacaagtgcacaccaccacgcctggctaattattgtatttttagtagaaacccggtttccccatgttgaccaggctggtctcgaactcctgaccttaggtgatccacccatctcagcctcccaaagtgctgggattacaggcttgagccacggcgctcagccatctcatttctttatggcgttgagtttgcttatatcaaaaaaccaaaagaaagttgtccagattcctaactcagtctggcgtttcaactttgctgtttagctgtatagaaaccaaaacatttccttatctccattcccagcagccaagtctcaagcagtagtattgaaagaagttctctgtcattccccgatatggagcataagtttgatttaccatcaaattacccaacatcaacctatacttagtcaactgagatttaaacagataaaggttccattgccctatttcaaaaagcaaatgttgctgatctgcacgcattcaatcctttgctataaatgtttcatgtcaatgcaaaactcttcattctagatctttgatgtttagcaggatcagctactgagctgtattttcttttgtccaacattttctactagcaaatcaacaaaataagagattcatgaacctctcctcctccccctcctgccccagcattaggtcttacttaaattaaacatttgggcagtatttcgttagttaccagctttgaggagaagtggtagtcacttacataaagcaattgtctctgaaaatgcattcttcttgacaaattagcatagcctaattctccatcctaagggggactgttttacaagtctacatataaaagtacctaaatggttgtcttctgaatccctccctagtagaaattgaatttggcatcagtggagccagtgactgtacctgggattcagtgcatatagaattgcattgactgtgaccctttaggcaaatggatgtaagactttggctcttaggattttcccaaacaccaataagagcatcttgaagagaatccatttactttatgatatataaggatatttcaggtttgatattatgatccttattaggtccagtctagctgagctggacatgaattgaagaaccagaattagaactagaaaatgaaacccaggctgagtgcggtggctcacgcctgtaatcctaacacttttgggaggccgaggcaggtggattgcttgagaccagcctgggcaacatgacgaaatcccatctctacaaaaatagaaaaattagccaggcgtagtggcatgcatttgtagtcccagctacttgggaggctggggtgggagaatcacctgagccggagaggtcaaggctgtggtgagctgtgatcatgccactgcactccagtcagggattgagaacctatctcaaaaaaaaaaaaaaaaaaagaaggaaagaaagaaaatgaattaataggatccatttccaaagcattaaaatttaatatatactttatcagggtcttctgatattcttcagaggagaattgttgtaagttaattcaataaacatttgaatacctgttttgtaggtgtatgttaagtatgtattagaatccttgatcaccagagacttgacggtttttgccttgaaagttatttccttccgatccatgttgtttaacaaattctaagtgtgcactattttttttattttaaatacaagattaatactatagtgcactgtagaaaataccaaaattccagatatttatcctacatatatgtattgtttactatatgcaaggggctcttagaccccaggggagcagaggggctgccagggcatgatacctgccttcaatatatttcagatcagaacgggcagtagaatgtacatagataactattttgacctctattgtgatacctgtcatgttgtaccttgtactatatagtattctgatagttcaaagggacatttgtgtggaaggatcatgtaataattatggcaaaagttttataacacatttttcacctcaaaaatgtttttaaacaaaacaagtaaattcgtgatctatttaatttttttttttttttttttgagatggagtcttgctctgtcacccaggctggagtgcagtggcacgatctcagctcactgcaacctccgcctcccaggttcaagcaattctcctgcttcaccctgctgagtagctggcactacaggcacccactaccatgcctggctaatttttgtatttttagtggagacagggtttcaccatattggccatgctggtctcgaactcctgaccttgtgatcctcccacctccacctcccaaagtgctgggaattacaggcatgagccaccgcacctggcctaaaatttttttttactaggaaaaaggctttaacttttttttgtttgatcagctcattttactgttagtattggtgcgtgaattttttagaacaaagacatacttagttcatcgttactttagactcccttcttccatttttatttctggccttggtccaagcctaccagtcattctctcactttgcttctgtaatgtagaccttcttcctgagaagctggctagatcaggtagtgatcataacattcctaaaccaatagtgctgatagctctgtgtacggagggatatttcatctaaaccattgctctaaacttagacttggctctgagtcagtaatacttctgtttactaggtttgaaatatctccctcttagctgggcacagtggcacatgcttgtggtcccagctactagggaggctgaggtgggaggattgcttgagcccaagagttcaagtctggcctgggcaacatcatgagaccctcgtcttttaaaagaaggaaaagaaatatctcccttttagaagaaacctagaagtctctattttgaggccacttaagatctctgaaatgattttaatgttttagagaattgtttatggtattacctgacctttttttcttgatttgttttctttttctttgttattatcctatgtttaagggagaaaaataattttaaattgagcgatttcttggtataattcttgctaatttttaaatctaatttttagcttaattcttaatttaaactaaaattcttaattttaatataagtggtaaaaaaatacatctacaaagttgtaagttctctcatttatttaccaactgtaatatttaggaaattaatggtcagaattcaataattaaaaccagattccttctgaaaaccaaggaacattataattatctagtatctaattgtatttcacccttttttaaatcttatgaacatcacttacttgcttttttttcttccattctttgtaaagcttctctgccttgctctaaatcagcagttttcatgcagctgttccctcatcaaggtactctttattttcatcatctttgcacgaaaatactgcttaccccacactcatcctgggcacatagcatgagactttactcaccggtccctgtaagctcagtctgccttaggcactttaggaacttgtaaagccaccactttataaggtcttggtacttaacaggaattgcacggccagtgtgtggcctgtcttgtttaaggagctgctaatacccacccagaacaatgaagatgcaatcccatacctggactaacaaaggcaggttaataagaaactcaagagagagttaatagagaaagagcagaatacgtggtttgatgaagtttttttagcttagaaaataacttgttttccccaaatagaaagccaaccccagtgtttcctcagaaattaaagctggctgtctattcaatcacctgtggttaaaaaaaggaatatggccaggtgcgatggctcacgcctataatcacagcactttgggaggccaaggtgggcggatcacttgagtccaggagttgaaaaccagcctgggtaacgtggcaaaaccctctttctacaaaaaatacaaaaagctattcacaggactgaggtggggaggttgaggctttggtgagctgagatcgcaccaccgcactccagcctgagtgacagagcaatactctgtctcacaaaaaaattaaaaaaaaaaaatatatggtcattagttagctataaggactaagatgaaaaaatttgacacatttatgtctaatttataaaagatgccttttcttttattcacctgtaattaatatacaaaaagattacacctaaacagaaaaagaagtgctagcagttggtgaacgtcatttttaaaaattcttttttctttttgagacggagtctctctctgttgcccaggctggagtacagtggtgtgatctcagcttactgcaacctccgcctccccagttcaagcgattctcctgcctcagcctcctgagtagctggaattacaggcatgttccaccaagcctggctaattttttttgtattttcagtagagacgaggtttcaccattttggccaggctggtctcgaactcctgacctcaaagatctgcctgccttggcctcccaaaatgttaggattacaggcatgagccacaataccaagccaaaaattcttatagttacaattttttatatttagctcaaaataaaaatatttctaagtatatatttaatacgcctccatgaatgtatttactgtagcttaaaaataggctgtagctacctaagaagatttattctattttgtgcttatttatattagcttcactcattttacaaattctagcataaaattaaagtcctagtatttgttctaaaactcctttgtatcacctggtcttttacttcagatattaggagcatcttaatttgtggagtaattattttatctgtgtgcaaaaattcttcacatagattattttgtctaacaaccctttgaaatagacaagtctgctgttatccttaattgccagattaagaattacaactaaataagaatattgatccaaacaagtctcaaacctaggtcttctgacatgtttaagttctcctgtatgtaataagagttttctaataagtttgccatattgtatatgaaataaactaaatgcagagtaaggtaacctactagtgctcctgcacaggtggcaggagatttcagtttttattagtctgtcatttttgtagtataacttctcacaaattacctaacccatttttccttagcttttcaagagttaaaagcgattctgttgttttattatttcatgatactattataactgattatttcagtttgggaaaccaaaagtgttttttaaaaatgagtgactaaaaaattgtcaggctggagctacatcactagttgtaaaaatacacaaaccttgatacctgccttcaaggaactcatgttctagcagggaagatagacatctaacttaaataacaataatgtaatctaatccttttccccagctactcaaattcactgaattttggccaataacaccttctagttaggattttgtctttatctggaaccaccacaatttattgaaacatagtactgctgatatactgctgtacagaatgtccagctgtttctgctctgcatgtttgtaattggctgcatgtttgaccacagcatatctgtggggtcatttaagctggcaaatcaggaccacagaagttttagctttatttcctttgtgtggtagcctctgggtttctgtcagtcactttgtagttttgtctgtttgttgtccaccaaaggccagaaaggagagccaatgctttaggggcaaaagagataccagaatacaaaactttaaaggggttttgatgaaaagaagtgcagcaccaaggccttctcactaacttaaaatatggcatatagcaatacaggatgtgttctgtctgcattggagtggtctatcagataatctgagagtttttcctatgggatattgaggtgaaatccttcaccagttcctagagagatttctagatttaattttagaggataaaaagaaagaatgctgccaaaattcttagaagtgagaattatgctgagaaacttaaatgccagaactagatactatgatcattctgtttcatactaccttggctttttcaagatatattttggtgtaaacgtaatgcattttaattgtttttttttaatgactttccaagatttttgttagtttctcctttgatccttacagtaaaacatctttgctgtgaagttgaacttaggaatcacagtcacaccacatttacctatgtgtgatttatacagttgggtcactaagtaggaagaaaacatacattccaaaaacaagaatttagatgaaaaatgaatttgagaaaagaagtagaatatcaacttttgacatagtgttgaagcttttggttatgagggatggggctgacaagtcactcgtacttttacatttttaattaatgtgctcattaggaaaaaaattggaaaattcagaaaaataaaaggaaaaagttacccacaatcctatcattctaagatagataaccactgtttattaacattttggtgcatttccttccagtttcttttttttatatacttgaggtcatagtatgtgaacaactttatagcttgttttgtaccctcaacatttaacaggagataaataaggcctttaaaattatttgaggtttgacggttatttgcttcacaaaacagaaagtggaatgttcttagcacttttttgaagataccttcaccctagtgacttcatctacattactacaatttatgtaattgtaattctcaggaataacactgtgcccaaacagaagcattgccacccatgtcatgactgttttcccctcagagtaggccatggtctagtagtagcaagacacacaagaacgagccccagggtagcagattgctggcagagagtcacagggccttcctagtggtcatccatgcttcatgcccctcctgcatgcgggccagctccaagttgtttcaaacctttgtctttttaaggtcctagttttgcctgaatcttattttctattaaagaaacaactcagaattactggacttgaaacttgtaggccaaatgcaaatttgaggaaatggaaggtcaaatacgctgacaaattcataattttaagtggaggatgccaaagggaaaaaaaaaagttctatcttttcaactaaaaatattataccactctctggagatcagggattgcatgctttggggctctgaattacaggtatctagctatcacattttaaaatggaagtgttcagttcattcagtattaattgaaaataatttttcaatgtattgaaaaaataactagattttacaggaaaacaaaaatgaataataatgatctttacccttctcagtgcctttactcagtagaggaagatggatgtacaagttgtagaatcataggcaagttaatttaaaagcaaggaaggagaaagtagttctggcaagagacagaataatgcatcatgaaggaaaaggatatgagaaaaaaaaatatgggttgaattttatcttgtagagatacgcaagacaattaaaagagcctacacaaacatacatcccaaagaagctcaaggcacattccagagatcatgagcagctttctttcagttttgttatttcttttgtaaatagctctggagaggatgcaaataaatatacagaagagaatttaaatagaccagaattctgttacccagagaaaagttccatgaatgtttctagtcatctttctatgcatatgattagattagattagattagaacatgactagccttaaaaaatttaataagggttttaaaaaagatttgaatagaacagattttcagtggtggttcagctatgctcacctcctggagaaatgtcgctgatgtttttccttgcactcatatgcctgatgcagtgcacatgttcataaacagtcactgacaaatgcccatgttcctttgacagcagttcagattttcaagacagcaaatctctgttgagcacgtgtaaaccaggccacgtgcttacagatgcctgatactcttgagtcgaattcagagctgaatccaaatgaaagatgagtggctcctagagggaggtcatcccaagttcatttcctgttcatgagccaacaaataactaactgggtagatctatgtacattttctgtaacataatgaatacttcttgacttgaaatattactttttgtccaaaaatggaaatttttctattctaagatttaaaatttcaatatataaagaagaataaagtacaaattagctgaaatcttgccatacagaggtaaaatatattttttagtcctttggcttctgacagagataaaatattttggcagatgtttacccagccctacgccctctccccacagtgtgtgggtgtttttttcctactccaaaaattgtggtcatctttttgtatcagtaaatatcaatcagtaatgtacattttgatacaaattactaaaacgttctgcagctgtttgctttcccgccaaaatttatgccagcagtaagtataatcagtctaattttgggggtaaattttattgatgtttaacagaaaagttcacaaattgcaagttttcagcttagtgaacttttaaaatgtaaacacacttgaaaatccatcatctacatcaagaaacagaacattaccagcatcccaagaagccatcctcatgcccccttaagtcactacttccgcaagggtgaccacagtcctgttacccaatttgtaatctttcctaatgtgatagataaaaataaaaatcttattttagtttctggttacttttctgaagttactgcttagattatttataatattaattggggtggggtgcagtggctcatgcttgtaatcccagaactttgagaggccaagatggaaggattgcttgagaccaggagttcaagaccagccttggcaacatagtgagactctatctctagacagaattttaaaattagctgggcatggtggcatgcacctgtagtcctagctgtttgggaggctgaggcgagaggatagcttgagcctggaagttcaaggttatagtgagctatgatcacaccactgcactgcagcctgtgcaacagggcaagaccctgtctctaaataaataatcaatcattgttaggcccaggttttggaggtttaatctcctcctcaagagaaataaatggcatctgtttaaggttgcagaatgtgaaatgacttggcatagctgaaaagaagcaaagattctacagtatgacctttgtgatatattattttctcagtaaatagtttctttgggataggcactgtgattaaaaaaataaaagcatcttgagttttctttgaagtgacaaatttgctggaaagatcagtactttctgctgctggagagtatattctgtttataaacatgaatgaggatgtgaataaggctagaagatgacctctgctggaagtttctggtatgatttggaggaaggagcactagtcttccctggtggctgctagcctttcatttagttcaagcctgccagcctctagcttttccttgcaacttgtcttttcatttttcttgtgctattttctgctatgatagcaaactttgcataacaaaatgtgaagttttccatgtgacattaacttagtaaacattttagcaattgactattaaaatgaaatgtgcataaacaatttgccaggttgtatcttatcacaaatatagtcatgtgctgcataacaacattgcagtcaacaacagaacacatatagacagtggtcccgaaagattataatactgtatttttactgtaccttttctgtgttagatatacaaatagttagcattgtgttacaactacataaagtacacaatatggtaacctgctgtacaggtttgttgcctgggagaaacaggctataccatatagccttggtgtgtagtaggctatgctatctaagttcatgtaagtacactccacaatatttgcacagacaaaatcgcctaatgattgtttcctagaatgtgtccccgttgttaagcgacacatgactgcaatgaaattcagtcctggaaggaaaagaagaagtaactggctgttctctttttctccaggaatcgacaaggagaacgttgaactctcccctaccactggccactgtaacagtggacgaactcgccacggatccgcaagccaagtgcagaagcaaagaagcgctggcagtttcaaacgtaatagcattaagaagatcgtgtgaagcttgcttgctttcttttttaaaatcaacttaacatgggctcttcactagtgaccccttccctgtccttgccctttccccccatgttgtaatgctgcacttcctgttttataatgaacccatccggtttgccatgttgccagatgatcaactcttcgaagccttgcctaaatttaatgctgccttttctttaactttttttcttctacttttggcgtgtatctggtatatgtaagtgttcagaacaactgcaaagaaagtgggaggtcaggaaacttttaactgagaaatctcaattgtaagagaggatgaattcttgaatactgctactactggccagtgatgaaagccatttgcacagagctctgccttctgtggttttcccttcttcatcctacagagtaaagtgttagtcctatttatacatttttcaagatacaagtttatgagagaaatagtattataaccccagtatgtttaatcttttagctgtggactttttttttaaccgtacaaaactgaaagaaccatagaggtcaagcctcagtgacttgacaccataaagccacagacaaggtacttgggggggagggcagggaaatttcatattttatagtggattcttaagaaatactaacacttgagtattagcaataattacaggaaaataagtgcgaccacatatatcttaacattactgaattaaaactatggcttctaagtccttatccaaactcagtcatccaaactagtttatttttttctccagttgattatcttttaatttttaattttgctaaaggtggtttttttgtgttttgttttttgtaaaccaaaactatactaagtatagtaattatatatatatatatattttttcccctccccctcttctttcctaactaattctgagcagggtaatcagtgaacaaagtgttgaaaattgttcccagaaggtaattttcatagatgtttgcattagctccatagcaaaatggaatggtacgtgacatttagggtagctgatatttttattttgttaaataatttccaagaatagagtatggtgtatattataaatttctttgataagatgtattttgaatgtcttttaatcttcctcctcctctccaaaaaaatcagaaacctctttaagaaaacatgtaggttatatatgctagaattgcatttaatcactgtgaaaagactggtcagcctgcattagtatgacagtaggggggctgttagaattgctgctatactggtggtatggattatcatggcattggaattttcatagtaatgcagatccaatttctttgtggtacctgcagtttacaaaataatttgacttcagtgagcatattggtatctggatgttccaatttagaactaaaccatatttattacaaaaagatattaatccctctactcccaggttccctttatatgttaagatataatggctttgaggggggaaaaaataaacctaggggagaggggagtttcctgtagtgctgtttcattagaggatttcagtaaattaaattccacagctaattcaataaataatggtacatttaagtgttctgattttaataatatatttcacatttatccacacagtaacaatgtaatatgttaatgtaaataaaattggttttgatactcagaaataacaagaatttaattttttaaatttgtttacagtcctgggaaaagtaagaattatttgccaaaataagaggaaagaaaaccttagtattattaatgagtttaccatagaattgttggaaatactgaagacaggtgcaatttactaaacttttgtttttaaactattgtagaggctgcattagaagaaaatgtttataatgacagagcaactatgactatataaaaaagctgaaattagaactgtgtttagaaatagatcagtaacccagtgccaaggatgccaagctgccaccatggtcttggctctcccacaacccagtgtttctggggtaagtttcacagtttctaggccctggaatagcaggcagtgtaagcctttgataactttagttcgatgtttttcttgtttttgtttgttggtttggtgcatatgatagtgggtgttatgctattttgctcttcccatcaaaataaagaaacttccagaggtttactgttaaaaatactgatatttccataaacgggtttaccaagggtgtagtatttcataccgcctgaaatgatcagcattggcacaaatcaaaattcagccgcctttgaaatgcaaaaatacctttgactagtaagtacatcctaggagtttgaaaacttaactaaggtttaaaatttaccttgtttaaagaacttctgacttttgaggaaaatctagctttccaagtaactaaaatgtacatgagataaacctctcaccactatgtgtcccttgagaaatgcaacacttttttagtcttcatacttgtaatctataaaagaaattctgaagtttagaccaagttgcccatttctgcgtaattgacataagttctgttaaaaatattataagtaattcgtttcggtttgtagatgtttcccctgacttgttaaagaggaaaccaggaactcagtcatgtttttgtcctggataatctacctgttatgccagtactcccatccgaggggcatgcccttagttgcccagatggagatgcagttcagtagatttggggcaaagtggctacagctctgtcttccattcactcaacacctgttcatgactgagccaggtgcccaggacacatcctaaacagtcagcttctatcctgtgtcctagttggggagacagagtgccagccagcaaccctcccaggtttgtaggttttaggggttttcagttttgtttgggttttttgttttttgtttttgtttctacatccttccccgactcccaggcataatgaggcatgtcttactcaatgttatgcaatggatttaggcaaaaattcattcttagtgtcagccacacaattttttttaatgcagtatattcacctgtaaatagtttgtgtaaaatttgacaaaaaaagtatatttactatactgtaaatatatgtgatgatatattgtattattttgcttttttgtaaagcagttagttgctgcacatggataacaacaaaaatttgattattctcgtgttagtattgttaacttctttttgcgactgcgttacatcatttaaagaaaatgctgtgtattgtaaacttaaattgtatatgataacttactgtcctttccatccgggcctaaactttggcagttcctttgtctacaaccttgttaatactgtaaacagttgtacgccagcaggaaaaatactgcccaacagacaaaatcgatcattgtaggggaaaatcatagaaatccatttcagatctttattgttcctcaccccattttcctccttgtgtatgtacttcccccacccccctttttttaagtaaaatgtaaattcaatctgctctaaga

SEQ ID NO: 15 - DNA, 19198 bp, Homo sapiens
acttgtcatggcgactgtccagctttgtgccaggagcctcgcaggggttgatgggattggggttttcccctcccatgtgctcaagactggcgctaaaagttttgagcttctcaaaagtctagagccaccgtccagggagcaggtagctgctgggctccggggacactttgcgttcgggctgggagcgtgctttccacgacggtgacacgcttccctggattgggtaagctcctgactgaacttgatgagtcctctctgagtcacgggctctcggctccgtgtattttcagctcgggaaaatcgctggggctgggggtggggcagtggggacttagcgagtttgggggtgagtgggatggaagcttggctagagggatcatcataggagttgcattgttgggagacctgggtgtagatgatggggatgttaggaccatccgaactcaaagttgaacgcctaggcagaggagtggagctttggggaaccttgagccggcctaaagcgtacttctttgcacatccacccggtgctgggcgtagggaatccctgaaataaaagatgcacaaagcattgaggtctgagacttttggatctcgaaacattgagaactcatagctgtatattttagagcccatggcatcctagtgaaaactggggctccattccgaaatgatcatttgggggtgatccggggagcccaagctgctaaggtcccacaacttccggacctttgtccttcctggagcgatctttccaggcagcccccggctccgctagatggagaaaatccaattgaaggctgtcagtcgtggaagtgagaagtgctaaaccaggggtttgcccgccaggccgaggaggaccgtcgcaatctgagaggcccggcagccctgttattgtttggctccacatttacatttctgcctcttgcagcagcatttccggtttctttttgccggagcagctcactattcacccgatgagaggggaggagagagagagaaaatgtcctttaggccggttcctcttacttggcagagggaggctgctattctccgcctgcatttctttttctggattacttagttatggcctttgcaaaggcaggggtatttgttttgatgcaaacctcaatccctccccttctttgaatggtgtgccccaccccgcgggtcgcctgcaacctaggcggacgctaccatggcgtgagacagggagggaaagaagtgtgcagaaggcaagcccggaggtattttcaagaatgagtatatctcatcttcccggaggaaaaaaaaaaagaatgggtacgtctgagaatcaaattttgaaagagtgcaatgatgggtcgtttgataatttgtcggaaaaacaatctacctgttatctagctttgggctaggccattccagttccagacgcaggctgaacgtcgtgaagcggaaggggcgggcccgcaggcgtccgtgtggtcctccgtgcagccctccggcccgagccggttcttcctggtaggaggcggaactcgaattcatttctcccgctgccccatctcttagctcgcggttgtttcattccgcagtttcttcccatgcacctgccgcgtaccggccactttgtgccgtacttacgtcatctttttcctaaatcgaggtggcatttacacacagcgccagtgcacacagcaagtgcacaggaagatgagttttggcccctaaccgctccgtgatgcctaccaagtcacagacccttttcatcgtcccagaaacgtttcatcacgtctcttcccagtcgattcccgaccccacctttattttgatctccataaccattttgcctgttggagaacttcatatagaatggaatcaggctgggcgctgtggctcacgcctgcactttgggaggccgaggcgggcggattacttgaggataggagttccagaccagcgtggccaacgtggtgaatccccgtctctactaaaaaatacaaaaattagctgggcgtggtgggtgcctgtaatcccagctattcgggagggtgaggcaggagaatcgcttgaacccgggaggcagaggttgcagtgagccaagatcgtgccactacactccagcctgggcgacaagaacgaaactccgtctcaaaaaaaaggggggaatcatacattatgtgctcatttttgtcgggcttctgtccttcaatgtactgtctgacattcgttcatgttgtatatatcagtattttgctccttttcatttagtatagtccatcgattgtatatccgtccttttgatggccttttgagttgtttcccatttgcggttatgaaataaagctgctataaacattcttgtacaattctttttgtgatcatatgttttcgtgtttcttggagaaatacttaggaggggaattgcgagtttggaagtaaaaagtagctgtattttgaactttttcagaagctctgagttttccagagcggttgtaccattttacactccaactagcaaggtatgggagttattatggttgtgccacagccttccggacattaggtattgtcagtctttctaatgtggtatatccttgtggttgtaatttacagttctctattgactaaggatgttcagcattttttcatgtgcctattggccattcgtattttgtttgtaaagtagctcttcgagtcttttacctgttattttggttttttgtttgtttttattgttcagttgtgggactgctttatacattctggatacaagtcctttatcagatccatgtgtcgtgaatgttttcttctgatctgttgcttgcctatttgtttgctttacagagtttacagtatcttaagaggagtggatttatcttttttatgttcagtatttgccttgtcctgtttaggacatctttttttttttttttaaccccagggtcatgaagatattatcttacattttcttttaggacctttatggttgtaagttttacagtaaggtccttgagccattaattaattcttaaaattaattgtttatggtgtgaggtgtaggagtcagtctctggtatctttcctgtatggaaatccagttattctgtctccacttgttgaaataggcttcctttctctactgaatgcttttaattttaattattttacagttggagtatagggctaccattttagtgctattttctttttttctttgttaatttttgagacagggactcacactgttgcccaggctagagtacaatggcacaatcaaggcttactgcagcctcgaacccctgggctcaagcagtcctctagcagcctcacgagtagctgggattactccaccacacccagctaactattttatttttttgtattgacaggatctcactatgttgcccaggctggtctcaaactgctggcctcaagctttcatcccatctcggcctcccaaagtgctgggattacaggtgtgagccaccatgcctgacctcttagtgctattttctatttatctcctctgttctctgctctctttaaacgttggaggaagaaacagtacccatcttacacaaactcttcagaaaacagaggaacagactgggcgcggtggctcatacctgtaatctcagcactttggtacgctgaggcaggggatcatttgaggtcgggagttcgagaccagcctggccaacacggcgaaaccccatctctactaaaaatacaaaaagtagctaggcgtggtgacacatacctgtaatgccagttactcaggaggctgaggcacaagaatcccttgaacctgggaagcggaggttgcagtgagccgagattgcgccactgcactccagcctgggcaacagagtgagaccctgtctcagaaaaaaaaagaaagaaagaaaaaatagaggaatatttcccaacttgttttcgaagccagcataatcctggtaccaaaaccaaacaaggacattataagaaaagaaaatatagaccaatattcctgttagcatagacatgcaacagctaaccaattttagcaaaccaaacctggtaatatagaaaaaaggataaataggccagtcgcggtggctcacgcctgtaatcccagcactttgggaggctgaggcaggcagatcacttgaggtcaggagtttgagaccagcctgaccaacatggtgaaaccccgtttctaataaaaatacaaaaatcaggctgggcacggtggctcacgcctgtaatcccagcactttgggaggccgaggtgggcagatcacgaggtcaggagttcaagaccagcctgaccaatgtggtgaaacgccatctctactaaaaatacaaaaatcagccggtgtggtggcacctgcctgtaatcccagctactcaggaggctgaggcagaattgcttgaacccgggaggcagaggttgcagtgagccaagatcgtgccactgcactccagcctgggcgacagagcaagacttcatctcaaaaaaaaaaaaaaattagctgggcatggtggtgggcacctgaaatcccagctactcgggagtctgaggcaggagaatcgcttgaacccaggaggcagaagttgcactgagctgggatcacaccattgcactccagcctgggcaacagagtgagactccatctcaaaaaaagaaaaagaaaaaggataaatacattctaaccaaataatgtttatctcatgattgtagctgattcaacattcaaaaattggcctggtgcagtagctcaggcctgtaatcccaacattttaggaggctgaggcaggaagatctcttgagcccaggatttcaagaccagcctgggcaacatagtcagactggtctttactggggggaaaaaaatcagtctgtgtaattcaccacattaacaaagggaaacataaaaaccctatgatcatttcaacagatgtagcaaaagcagttaatgatattcaacacatatgcatgattacaaaccaaccaacctcctagcaaactagggaaaggaaacttaacctagtttgataacagggcgtccacagtcggagttccactagcagcatacataatggtagaaaactcagtgctgccgggcgcggtggctcacgcctgtaatgccagcactttgggaggcctaggcgggcggatcacgaggtcaggagatcgagactgtcctgactagcatgctgaaaccccgtctctactaaaaatacaaaaacaaaaaattagccgggcatggtggcgggcgcctatagtcccagctactcgggaggctgaggcgagagaatggcgtgaacccgggaggcggagcttgcagagcctagatcgtgccactgcactccagcctgggtgacagagtgagacttcgtctcaaaaaaaaaaaaaaaaaaaaaagaaaagaaaactcaacgctttttcctctaagatcaggaactagaaaaggatttgactctcacaacgttgataccatactggaggttttaaccaggcaagaaaaagaaataatgagggccgggtgcggtggctcaggcctgtaatcccagcactttgggaagccgagacgggtggatcacgaggtcaggagatcgagaccatcctggctaacacggtgaaaccctgtctctactaaatatacaaaaaattagccgggcgtagtggcgggcgcctgtagtcccagctactcgggaggctgaggcaggagaatggcgtgaactcagggggcggagcttgcagtgagctgagatcgagccactgcactccagcctgggcgacagagcaagactgtgtctcaaaaaaaaaaaaagaaaaagaaataatgattagtggcccgatgtctcacgcctataatcccagcactttgggaggccgaggtgggcagatcacctgaggtctggagttggagaccagcctgacaaagatggtgaaacctcgtctctattaaaatattaaaaaaatagccaggcgttggccgggtacagtggctcatgcctgtaatcccagcactttgggaggccgaggtgggtggatcacctgaggtcaggagttcaacaccagcctggccaacatggtgaaaccccatctctactaaaaatacaaaaattagccgggcgtagtggcgggcgcctgtaatcccagctacttgggaggcttaggcaggagaatcgcttgaacctgggaggcggaggttgtagtgagccgagattgcaccattgcactccagcctgggtgacaaaagcaaaaactccgtctcaaaaaaaaaagaattagccaggggtagtggtgaacgcctgtagtcccagctactcaggaggcagaggcaggagaatcacttgaacccaggaggcagaggttgcagtgagccgagattgtcccattgcactccagcctaggcgacaagagcaaaattccatgtcaaaaaaaaaaaaaaaaaaggaaagaaaaaaaataacgattagaaaggaagaaataaaacacattcacagccagtatgattctatacatacatgtcctaatggggccaggcgtggtggctcatgcctgtaatcctagcacttttaggaggctgaggcaggtggcttccctgggaccagcctggccaacatggtgaaaccccaactctaataaaaatacaaaaaatcagccaggcgtggtgacgggcacctctaatcccagctactcaggaggctgaggcaggagaattgcttggacctgggaggcagaggttgcagtgagccgagatcgcgctattgcactccagcctgggcaacaagagtgaaactccggcagggtgtggtggcttacgcctgtaatcccagcacttcgggaggctgaggcaggccgatcacctgaggtcaggagtttgagaccaacctaacatggtgaaaccccgtctctactaaaaatacaagaattagctgggtgtagtggtgggcgcctgtaatcccagctacttgggaggctgagacagaagaattgcttgaacccaggaggtggaggttgcagtgagctgagatcatgccattgcacaccacgccgggcaacagagcgagattccgtctcaaaaaaaaaaaaaaagagtgaaactctatctcaaaaaaaaaaaaaagtcctaatggaaaatccataaaaagctaccaaaactaataaataaatatagcagggttgcaggttacagggcaatatagttatccctctatctgtaggggcttggttctgggactcctcacacaccaaacccacagatgtctaagtcccatatataagacggtatagtatttggatttaacctacacatatcctcccatatagtttaaattatctctagattacttacattacccccatacaatgaaaatgctaatgtacatgcaagtatgtatgtaagtacttgtactatattgtttagggaatcactggacatataggccttcaagactgataccagcagccactgttaagattctggtcaggcctgcccctgtttggggtctcagttgatctcattgccttcccacccagccaagggcacctgcatttctcttggctccctggccatttggaaggcctagttcagcctggcacatttgtatcctggcccactgatgctggtacccctgggaaggtcctgctctgaaaaacacggagattttagttgctactgaagatttgagagataaagacagggagacctgtctgtagacctgtgtccctccaagtgggattgagactttgggccccccatttcaggacagcacctcctggcctgttgactgaatagatccctgaaggaggtgtacttgcattaatggagtgggggtgggagcagtaccacagatccgcactaacaatcacacagttctctctagaataataatatagaacaagtgaaatagaacaattgcagaaagagctaacctttgttgagctcttactgtgtgcccagcactttcctcaactctacatttcccataatacacagagtactaggtaggccaggcttggtggctcacgcctgtaatcccagcactttaggaggccaaggggggtggatcacctgaggtcgggagttcaagaccagcctgaccaacatggtgaaaccccgtctctactagaagtacaaaattagccaggtgtggtggcacatgcttgtagtcctagctactcagcaggctgaggcaggagaatcatttgaatccgggaggaggttgcagtaagcggagatagtgccactgtactccagcctgggcaataagagctgagactccgtctcaaaataaaataaaataaaataaaataaaataaaataaaataaaaaaagaaaagagcctgccattaaaggagctgtttggtaggggatgttttgtcagtgcaaacaacagaaaagtgggctgggcacagtggttcatgcctgtaatcccagcactttgggaggccaaggcgggcggatcacctgaagttgggagttcaagaccagcctgaccaatatggagaaaccccgtctctactaaaaatacaaaattagccgggcgcagtggcgcatgcctgtaatcccagctactcgggaggctgaggcaggagaatcgcttgaacctgggaggcagaggttgcggtgagccgagatcgcaccattgcactccagcctggacgagagcaaaactctgtctcaaaaaaaaaaaaaaacagaaaagtgtaacaaacacttacagtaggcatgtttcttagcaaatctgatgacaaatttggcataaagaaagagagcatccctgaaaaaaaaaaaaagaaaaagaaagagagcatcctgcctgggcaacatagtgaaaccctgcctctacaaaaaaactcaaaaattggccgggtgcagtggctcacacctgtaatcccagcactttgggagtcggaggcgggaggatcacctgaggtcaggagttcgaaaccagcctggccaacatggcaaaaccccatctctactaaaaatacaaaaaattaatcaggcgcattggtgggcgcctgtaatcccagctactcaggaagttgaggcaagaggatcgcttgaatctgggaggtggaggttacagtgagtcgagatcacaccactgcactctagcctgggtgacagggcgagactccgtctccaaaaaaaaaaagaaaaagaaaaagactaaaaaattagccaggcaggcctctgtggtcccagctacttgggaggctgaggcaggagaatcactgagcccaggagtccgaggctgtagtgagccatgattgcaccactgtaccctagcttgggcaacaaagcaagaccctgcctcaaaagaaaaaagaaagaaagaaagaacatggcgggccaggcacagtggctcacacctgtaatcccagcgctttgagaggccgaggcaggtggatcacaaggtcaggagttccacaccagcctggccaacatggtgaaaccctgtctctactaaaaatacaaaaaatcagccaggcatggtggcaggggcctgtaatcccagctactcgggaggctgaggcaggagaattgcttgaaaccagaaggcagaggttgcagtgagcctagactgcaccactgcactccagcctgggcgaaaagagccaaactccatctcaaaaaacaaacaaaaaaacaaaacaaaagaaaacatggcaaagcctttgaaagcttgtctgggagaaggtgcgatgatagttgcataacttcgtgcaagatgctggtccacacaggggctgccccttgctctttctcgctctcttaacctctcatataacaggcttgtgtgttattcacatttattgagcccaagcaggtgcaaggcattgtgatctaatactttggtcagcaagacaacaagatagatcactgccctgcccttaggaagtgtatatgctattagaggaaacagataaaataaacaaggaaaagtatcagacaatgtaagtgctatgagaatgcaaatgaggtgatgtgaattaaaataggatgacttaaagtctgcacgggaaggagcctacccccatgttcctggctagccaaggaaccaccagttgattagcagagaagggcagccagtctagctagagcttttggggaagagggagtggttgttaagagatgagattaaagaagccgagacgggccattcgtgaggggtttgtaatgcagggctgaggagtgtccgaagagaatgggcaggtgagcggtgagacagttgttcttccagaagctttgcagtgaaaggaatcaaagaaatggagccgtgtatcaggtggggaagggtgggggccaagggggtgtccttccccatacagagattgcaggctgagaatgactatatccttgttaacaggaggtgggagcagggcacggtagctcacacctgtaatcttggcactttaggaggctgaggcgggccgatcacctgaagtaaggagttcgagaccagcctggccaacatgcaaagccctgtctctactaaaaatacaaaaattagctgggtgtggtggtactcgcctgtaatcccagctactcgggagactgaggcaggagaatggcttgaacccggaaggtagaggttgcagtgagctgagatcatgccactgtgctccagcctaggtgacagagagagactccatctcaaaaaaaaaaaaaaaatacaggaagggagttgggaatagggtgcacatttaggaagtcttggggatttagtggtgggaaggttggaagtccctctctgattgtcttttcctcaaagaagtgcatggctggtgaggggtggggcaggagtgcttgggttgtggtgaaacattggaagagagaatgtgaagcagccattcttttcctgctccacaggaagccgagctgtctcagacactggcatggtgttgggggagggggttccttctctgcaggcccaggtgacccagggttggaagtgtctcatgctggatccccacttttcctcttgcagcagccagactgccttccgggtcactgccatggaggagccgcagtcagatcctagcgtcgagccccctctgagtcaggaaacattttcagacctatggaaactgtgagtggatccattggaagggcaggcccaccacccccaccccaaccccagccccctagcagagacctgtgggaagcgaaaattccatgggactgactttctgctcttgtctttcagacttcctgaaaacaacgttctggtaaggacaagggttgggctggggacctggagggctggggacctggagggctggggggctggggggctgaggacctggtcctctgactgctcttttcacccatctacagtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacggtcagttgccctgaggggctggcttccatgagacttcaatgcctggccgtatccccctgcatttcttttgtttggaactttgggattcctcttcaccctttggcttcctgtcagtgtttttttatagtttacccacttaatgtgtgatctctgactcctgtcccaaagttgaatattccccccttgaatttgggcttttatccatcccatcacaccctcagcatctctcctggggatgcagaacttttctttttcttcatccacgtgtattccttggcttttgaaaataagctcctgaccaggcttggtggctcacacctgcaatcccagcactctcaaagaggccaaggcaggcagatcacctgagcccaggagttcaagaccagcctgggtaacatgatgaaacctcgtctctacaaaaaaatacaaaaaattagccaggcatggtggtgcacacctatagtcccagccacttaggaggctgaggtgggaagatcacttgaggccaggagatggaggctgcagtgagctgtgatcacaccactgtgctccagcctgagtgacagagcaagaccctatctcaaaaaaaaaaaaaaaaaagaaaagctcctgaggtgtagacgccaactctctctagctcgctagtgggttgcaggaggtgcttacgcatgtttgtttctttgctgccgtcttccagttgctttatctgttcacttgtgccctgactttcaactctgtctccttcctcttcctacagtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtgagcagctggggctggagagacgacagggctggttgcccagggtccccaggcctctgattcctcactgattgctcttaggtctggcccctcctcagcatcttatccgagtggaaggaaatttgcgtgtggagtatttggatgacagaaacacttttcgacatagtgtggtggtgccctatgagccgcctgaggtctggtttgcaactggggtctctgggaggaggggttaagggtggttgtcagtggccctccaggtgagcagtaggggggctttctcctgctgcttatttgacctccctataaccccatgagatgtgcaaagtaaatgggtttaactattgcacagttgaaaaaactgaagcttacagaggctaagggcctcccctgcttggctgggcgcagtggctcatgcctgtaatcccagcactttgggaggccaaggcaggcggatcacgaggttgggagatcgagaccatcctggctaacggtgaaaccccgtctctactgaaaaatacaaaaaaaaattagccgggcgtggtgctgggcacctgtagtcccagctactcgggaggctgaggaaggagaatggcgtgaacctgggcggtggagcttgcagtgagctgagatcacgccactgcactccagcctgggcgacagagcgagattccatctcaaaaaaaaaaaaaaaaggcctcccctgcttgccacaggtctccccaaggcgcactggcctcatcttgggcctgtgttatctcctaggttggctctgactgtaccaccatccactacaactacatgtgtaacagttcctgcatgggcggcatgaaccggaggcccatcctcaccatcatcacactggaagactccaggtcaggagccacttgccaccctgcacactggcctgctgtgccccagcctctgcttgcctctgacccctgggcccacctcttaccgatttcttccatactactacccatccacctctcatcacatccccggcggggaatctccttactgctcccactcagttttcttttctctggctttgggacctcttaacctgtggcttctcctccacctacctggagctggagcttaggctccagaaaggacaagggtggttgggagtagatggagcctggttttttaaatgggacaggtaggacctgatttccttactgcctcttgcttctcttttcctatcctgagtagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgaggtaagcaagcaggacaagaagcggtggaggagaccaagggtgcagttatgcctcagattcacttttatcacctttccttgcctctttcctagcactgcccaacaacaccagctcctctccccagccaaagaagaaaccactggatggagaatatttcacccttcaggtactaagtcttgggacctcttatcaagtggaaagtttccagtctaacactcaaaatgccgttttcttcttgactgttttacctgcaattggggcatttgccatcagggggcagtgatgcctcaaagacaatggctcctggttgtagctaactaacttcagaacaccaacttataccataatatatattttaaaggaccagaccagctttcaaaaagaaaattgttaaagagagcatgaaaatggttctatgactttgcctgatacagatgctacttgacttacgatggtgttacttcctgataaactcgtcgtaagttgaaaatattgtaagttgaaaatggatttaatacacctaatctaaggaacatcatagcttagcctagcctgctttttttttttttttttttggagacagagtctcactctgtcacccaggctggagtgcagtggcgggatctcggctcactgcaacctccgccttctgggttcaagcgattctcctgcctcagcccactgagtagctgggattacaggcacctgccccgacgcccagctaattttttgttatttatttatttttttttttagtagagatgaggtttcaccatgttggccaggctagtctcgaactcctgaccttgtgatctgcctgccttggcctcccaaagtgctgggattacaggcgtgagccaccgcacccggcctgcctagcctacttttattttatttttaatggagacagcatcttgctctgttgcccaggctggattacagtgatgtgatcatagctcattataccctcctgggctcaagcaatccccctaactctgcctccccagtagctaggaccacaggcatacaccaccatacccagctaatttttaaaattttttgtagatagatagagtctcactatgttgcccaggctggtctctagcctacttttttgagacaaggtcttgctctgtcacccaggctggatagagtgcagtagtgcagtcacagctcactgcagcctccacctcccaggctccatccatcctcccagctcagcctcccaagttgcttcaactacaggcctgcaccaccatgcctggctaatttttatttatttatttttattttattttattttatttttttgagactcagtctcactctgtcgcccaggctggagtgcagtggcatgatctcggctcactgcaacctctgcctcctgggttcaagtgattctcctgcctcagcctcccgaatagctaggactacaagcgcctgctaccacgcccagctaatttttgtatttttagtagagacagggtttcaccatgttggccaggctggtctcgaacttctgaccatgtgatccgcccgcctcggcctcccaaagtgctgggattacaggtgtgagccaccacgcccggctaatttttatttatttatttaaagacagagtctcactctgtcactcaggctagagtgcagtggcaccatctcagctcactgcagccttgacctccctgggctccggtgatttcaccctcccaagtagctaggactacaggcacatgccacgacacccagctaattttttattttctgtgaagtcaaggtcttgctacgttgcccatgctggtatcaaacccctgggctcaatcaatccttccacctcagcctccccaagtattggggttacaggcatgagctaccacactcagccctagcctacttgaaacgtgttcagagcatttaagttaccctacagttgggcaaagtcatctaacacaaagccctttttatagtaataaaatgttgtatatctcatgtgatttattgaatattgttactgaaagtgagaaacagcatggttgcatgaaaggaggcacagtcgagccaggcacagcctgggcgcagagcgagactcaaaaaaagaaaaggccaggcgcactggctcacgcctgtaatcccagcatttcgggaggctgaggcgggtggatcacctgaggtcaggagttcaagaccagcctagccaacatggtgaaaccccgtctctactaaaatacaaaaattaaccgggcgtgatggcaggtgcctgtaatcccagctacttgggaggctgaggcaggagaatcgcttgaaccaggaggcggaggttgcagggagccaagatggcgccactgcactccagcctgggcgatagagtgagactccgtctcagaaaaaaaagaaaagaaacgaggcacagtcgcatgcacatgtagtcccagttacttgagaggctaaggcaggaggatctcttgagcccaagagtttgagtccagcctgaacaacatagcaagacatcatctctaaaatttaaaaaagggccgggcacagtggctcacacctgtaatcccagcactttgggaggtggaggtgggtagatcacctgacgtcaggagttggaaaccagcctggctaacatggtgaagccccatctctactaaaaacacaaaaattagccaggtgtggtagcacacgcctgtagtcccagctactcgggaggctgaggcacaagaatcacttgaaccccagaggcggagattgcaatcagccaagattgcaccattgcactcccgcctgggcaacagagtgagaccccatctcaaaataaataaataaatatttttaaaagtcagctgtataggtacttgaagtgcagtttctactaaatgcatgttgcttttgtaccgtcataaagtcaaacaattgtaacttgaaccatcttttaactcaggtactgtgtatatacttacttctccccctcctctgttgctgcagatccgtgggcgtgagcgcttcgagatgttccgagagctgaatgaggccttggaactcaaggatgcccaggctgggaaggagccaggggggagcagggctcactccaggtgagtgacctcagccccttcctggccctactcccctgccttcctaggttggaaagccataggattccattctcatcctgccttcatggtcaaaggcagctgaccccatctcattgggtcccagccctgcacagacatttttttagtcttcctccggttgaatcctataaccacattcttgcctcagtgtatccacagaacatccaaacccagggacgagtgtggatacttctttgccattctccgcaactcccagcccagagctggagggtctcaaggaggggcctaataattgtgtaatactgaatacagccagagtttcaggtcatatactcagccctgccatgcaccggcaggtcctaggtgacccccgtcaaactcagtttccttatatataaaatggggtaagggggccgggcgcagtggctcacgaatcccacactctgggaggccaaggcgagtggatcacctgaggtcgggagtttgagcccagcctgaccaacatggagaaaccccatctctactaaaaatacaaaagtagccgggcgtggtgatgcatgcctgtaatcccagctacctactcgggaggctgaggcaggagaatcgcttgaacccgggaggcagaggttgcggtgagctgagatctcaccattacactccagcctgggcaacaagagtgaaactccgtctcaaaaaagataaataaagtaaaatggggtaagggaagattacgagactaatacacactaatactctgaggtgctcagtaaacatatttgcatggggtgtggccaccatcttgatttgaattcccgttgtcccagccttaggcccttcaaagcattggtcagggaaaaggggcacagaccctctcactcatgtgatgtcatctctcctccctgcttctgtctcctacagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgaggggtg

SEQ ID NO: 16 - DNA, 108353 bp, Homo sapiens
tggagacagaatggaggtgctgccggactcggaaatggggtaggtgctggagccaccatggccaggcttgctgcggggggaggggggaaggtggttttccctcgcactgtcttaaaccgatggcctttccttggcacagggtccactgcagcatgccaaacgaggaggcaggggcgtcgtccccccgccccccactgcagcactggagatggatttcctgtacttcggatccagggtttttgacagaagaggaagaagggggaggggtagaagtgttaaggggagtctgctgagaaaagctgtttttgaagccagaaggggtttttgtttttataatgccatttgacagagtggaataacagtatctaaggaaacgggtagaggacaacaaagaatggagcatattcatggcgaggagcaaaagctctaccccattgaaaggcttcttttcctccctggcgacaaggacacatgcattggtggccaaaagagagaggagacaaaaccgctgcagatggctgatgtgaatctagtggaaagagctactggggatgagagaaagaggaggaggcaggtactgcagagcgtgagtggtggtgttggttggtgaaatactggtcaccagtagtgtgcctgcttttgtaaaacatctaagtaaactccctgtgaacagggtggcaaacagataccagtgtctttgttagttacaaaatgcagtggtagtggctttttgcggacgactgcagcagtgctttttctccctctgttaggccgaaaagacaactgcagaggaataagaaaccttgcagcaaatgctggggtagaagcccatttacaagaagccatagtttataaatgcagcctgaacagcagaaaaaaaattactgttttttaaagtaggaataatgtcaggctatgaatgttttgtcattggaatgtattggacactttgattctacatcacgaaagtgatgctcaaattctttgatttaacataaatcctatacgaaatcttaataaattatgtatgaaacagtggatcttttcttttgttagtgaagcttttatgccattaattaggtcattcaagagcaaaccactttacaacgtaaattactttgtcaaaaattatggtgaacaaatttttgtaggcctaatatttaagacctatagttaagtaattttatatttctctttggttgcttttagataacactgaataaatatttaagatattaattcagtgtgcaaatattttaaattaaagcaacatggcttttcttctagatgtatttctgtttagtgagtactcatgagatatactcttgatataaagtgtttttcattgagcttttttttcctttacctaaatgtaaaagcctatctttatgcatacttatagtagccagcctgccacacctccccactccctgaacaaggatggcagtggctttgtaaagccctccagggtcagtgacagtgtctcttaaataatgtttatgtaatagaaagtcttaagatgacctattatattgtttcagtaatattttcaagataatgcggaattgggctggcttagataaataagactacataagtttttcactgataaatttaaatagttctttaaaaaattatttctgctttaagaattacttgatcatggatatcagggttaatagtacttaggagccgggcgtggtggcccatgcctgtaatacaagctaaacaggaggctgagggaagctgaggcaggaggatcacttgagccttggcgttcaagaccagcctgggcaaccaagcaagaccctatctcaaaaaaaagtacttagagtctcttttttaaaatctgatggaaactatggctagaactaaagatgtcacattaaaattccaaatgacatttaacagctaatattactcagttctttgaattccattagcatagtgtttgagagtctataaaactattatttttacataaattaccttttaccattttaacagctcattgtagcattatttttattttaaatgttagagactcctattcaagtatgttgtgactttatccaaggtcaaatattgtataacaatgtaaagaacttaagtcttctattttattctaattctataaaactataatgccttttattacatacatacaaaataatatataacagaggtaatttgaaaaacagtgtaagtcactgacaaattattcaaaaaatgaaaaggcaatcctacttggttgtggatttttatctacaatataagaatgctttaaaaaatacctggtgactaagcaaatggagaagcagcagttttcataatgacattcataaacgactttttaaagatcgtcttattaatcatatgaacacatttaagtagaacagtgttagattgagatgtttttctgaattaaataagaaataaagaactaaagtttatttcattcctcttgtagtatatctaatctatgactgacctattggctttagtggtctttgaaattattcactgctctgatatggcctgaattgtgctgtttaaggaatttaaaattaaatattcataaatgttttatgaactgaatttaagctattgaagtttttgttttttgtgtttttttttctttttttttttttttttttgagacagggtctcactttgtcaacccaggctggcgtgcagtagcaaacatggctcacttgcagcttcaacctcgcaggctcaagtgatgctcccacttcagccctccaggtagcagggactacaggcacataccaccgtgcacagctaatttttatattttttgtagagatggggtttcaccatgttgcccagggtggtctcgaactcgtgagctcaaatgatcctcccacctcagcctcccaaagtgctgggatttacaggtgtgagccaccatgaagtttttccatttgcattaattgctctgtagattttaccatttttgtctgttttataaactgttactcattttatgaaatttaaccaatcttttatacttgtatatgtttaaatgatcttttatacttgtatatgtttaaatgttctcttcaattttgatctcccttctcccccttttcttgtattagaatctgaaacctacctatgcagcacataaaatgggatagagtattatggttcagaaaagatgggtaatagtttaggaaatatattcactacatatttattaggataccttctaaatatcatctttgaaaaatgctggagtcaaataagacacgtaaactaatctctaagaaaactcatggtagaattatgtgaaatttcattacaagttaaacactgctttggctactcctaggatatttaaagatttatataatctaagatatcctctaatttagaagaatatggtggattgctgtttgaaacactgctttttcataaaatctgcttagagtcacagagaatttttgaaaactaaattacttttgaagtactaagtatcttgaatgtacaatgagaacattaggtgaataggtatgttctcaaaagttgactttgtaaatcaaatcatacatcatcagttgatacaaggtaagccttctcccctttattctcacaccctgcacccactcttcttgtgtgtttaatatgcataaattcttgagaaatagcatcattttgtgagtctgttttttacagttaatgagatttttaaaaaaattttattgtgataaatatacataaaatttaccatcttaagcacttttaattgtacagttctgtggcattaagttcattcacattgttgtgcaaccatcaccaccacccatctctagaaatttttaatcttccctaattaaaactctgtgcacattaaacactaacatgccattttcccctccccccaacccttggcaaccaccactccactttttgtctcaaagaatttgactattctgggaacctctaataagaaaaaccatttaatatttattcttttgcacctggcttatttcacttagcataatgtctcgaaggttcatccatactgtagccatgtgtcagaatttctttcctttttaggtctaaatgatgttccattgcatgtatatgccacattttgttcattcatctgtcagtggacacttcaggttgtttccaccttttgtctatcatgaataatgctactatgaacgtgggtgtgcaagtgtctgcttgggttttactttttttgtgtgtactcaaacctgtgtttttaatttacataatttttgaacattattaactcaatactgtttttaagatctatccattttactttatgtccatctagtttgtgatgctaactctgctctatagtattctatagtacctatcactgttcctccagtgaaggccgtaagttttctccaaatcccgttaaccacaaacacctttatgatatacattcttatacatatctccttggactatgttatttatgtatttctgtataacaaattgtaccaaaacttagtggcttaaacagtttctgtggggcaagaattcaggaatgtcttagttggatggtctgactgaggcaggatctcttatgaagtagcagtcacgatgtcagtcacagatacagtcatctgaagggcttgactagactgacggatcttcttccaagatggctaactcacatagtctcagtttttcattggctattggcaagagacctcagttccttgtcacgtgggcctctccatggggctgcttgaatgtcttcatgacatagcagctggcttccctcaatgattctaacagaaaggccatttatgacctagactcagaagccacacaccattgcttctgctgtattctctttattagatatgagtcactaagtccagcccaccaaagagaggaattaggatccacctcttaaaggagtagggtcaaagaatttatgatatattttaagatcattacatcgaccagtgaaacagtttcactggatttatccctaggagagggatcactggataataagggcattgtttcctattgctgttgtaacaaattaacacaaacttagtggtttaagagaacacaaatgtattatcttgcagtcctggagatcagacacggttttcactggaccaaaatcaagatatcagtggctctgcgtctcctctagagattctattgaagaatccattttcttgcttttcttcagcttcttgcattccttgtctcatggcctctttctccatcttcagtgccagcagcattctaaatctctctctgaatctgaccctctgctgctcttgtcacatattcttctctgacccttctgcctccttcttaaaagaacctttgtgattacattgggtccacccagataatccaggaaaatcagcttcaagatctttaacttaatcacatctgcaaagttcctttagccacataaggtaacacattcataagttttggggactaggatttggccatctttgtggggccatacacaggcatactcatctggttctccattttttttaagctgaaggatttttttagttatttttacttttgcgaatgtgtgttactttcttttggtaatttcagattttcatttaccaagtttatttaaagcatagtataatatataatgatcaccaagatggtaagcagatattcattgttcaattagattcttgattttatcatcacttaatttatatcagtgtatcagctacttctgacatagtctgtaatagaaactgagaaacgttaaagcaacacagccttattaaatttctctttgtatcttttagactcgttataacaccagttctgtgggcgctttgttgaaacttgatctgtcattgtcttaccagtcattgaacttagggccactctaatccagtatgacctcatctcaaacttgatccatttatgaagactctgtcctcaaataaggtcacatttgacatgacattttttggtgtttttttgtttgttggtttttttccctctgttgcgcaggctagagtagcttctgggctcaagcagtcctcccaactgagcctcccaagtagctaggattacaaacatgtgccaccacagctgactaatttttaatttttttttcataaggagagagtctcactatattgcacaggctggtctcgaactcctgtctacaagtgatcctcccacctcagcctcccagagtgctgggattacaggtgtgagccactgtgctcacacctgtaacatatctttttatgaaacacagttcaacccataacactcccttaatacttggtaccttgtgaataataagatacctaaatatggtaccttgtggataacaaggcatattgtcttactttttttatggaaaagtcatcttggacattctctgaacttgtgccctctctttctgttgtctgccctctgtggctgataatgcaccctttctgttcattcttacgtgtatatttgtcttttatatggctgtcgctgagtaaagcattttgggaattacaaaagctaagtattagatatagaccttgtcttcaagatatttatgctccagctgggaagacaaaacaccccaaggtaaaatggaataatttgagaagttaggccaaattgtatagtatttactgttcagccagcaggaagattcattattggctagagacatcaggaaggttttgtgtaagaaactgagctgggccttaaaggatgaggatatattataacagcagaggaaaaaaggatgtggtattcagaaaggggaggaggtataaacaaaaatataaaggtaagaaatagtttgtagaggaaagtgaggagagacttacttgaggaaggttatcttggaacttaataggaaataagttttgaaggtagactattatcagatataatagattgtgaacaccagacagaagttatacagtctttgagagcatgagcattaaaaacaagtacagatttgaattctggcataggctcttgatatgtgttcttagggaagttatctactgttttggagttccatttttcttaactcaaaaatgagtaacacctacctcataggtggttgtgaggattaaatgagttaatatatagaaagcatttacattacgtgagatattgtaagtactaaatagatatcaggctttctgaatttcacatatcaaatacataaaaaataagggcatatataggatttaaataatatgctggtcagttatagaactttatatacttttccttttaaaacatttttagtaaaatttttatgaaaattagtcaaggcaaacctttaaaaattttcagatggtaacaattttataagcaatagtcttccattaatctaataagcaatgtatcaatgacaataaaaagatgactcaaaaagccttatatacctaacaattgagacagatctttgaagtatcccctagatcaaagaggaaatcaagatggaagtcatgagttatctggaaataaagaggggaacacttcatactaaaacttgtggaatgtagataaggctgtactaagagaaaaattgatgtccttaaaatttatattattaaggatgaaacgaataagtgaatgtttaagtaaagtaaggaaataaatgaattaatattcactttattattattattattattattattattttttgagacggagtctcactctgtcgccgaggctggagtgcagtgttgcaatctcggctcacagcaacctccacctcaagcgattctcctgtcttagcgacccccccaccccacaccatagctgggactacaggcgggtgccaccacgcccagctaatttttgtattgttagtagagacaggatttcaccatgttggccaggctggtctcaaactcctgaccttgacctgcctcgcaaagtatggggattacacgcgtgagccaccacgccagcctttcactttaaataactattaaaaataacaaagtaaaccaaaggaaaataagaggatataattagtaaagataaagaaattgataaaatagaaaataaagtagtggaaagtatgtgttgatgtttttgtttgttttggtaaacaccaataaaataaatgaaaccctaaaaagtttaaaggaataaaaggcaaacagaacatcagtgagaaaagataccttcagataaagaatttttaaatgacagaatatatacaactctgacaatacatttgaaaaactagaggaaagaaatagtttactagtgaactattaatgaataaaattaatacaagatggagaaagcattaaaagagtaaatcacagaagaaactttaaaatactttaaaaaaatcttagctctaaaatggcacctcttttgagtatccgtcactttgataagaaaaaagaaaaaaggcaccttctgatttgaattctagctgactttcaaagaatagacactattcaaactattccagaccatataaaaagatgagatagcataagcttaattgaaaaccttatttcaaaatactataaaaatttaaaactatacattttctctttaaaaattctaagtgaaatatggaaaaatcaacaggctcgtaaaagcataaaacatgaacaactggggtttatttcaggaatggaggataggtcaacattcaaaaatcttataactgactgcatcaagaaattaaaagagaaacgatatgattatacaaaaaagtgctatttacgttcagcaaccactactaacaaaaactttaaactcaaaggaaaatgcctaaacatgtttaaaaaatttactgaaatctgagtaagaatattaaatagtgaaataatatgccattcttattaaaatcgagaataagatagtttattcgacattttaaagtttcaagctaacaataaaacgtgaaaaagaagtgaggtacaaatgcaggaaagaagagtcacaagtatcatcacttacagattatatgattgcatacccagaaaatccactggaaaccctattggaattcatagaatcatttgataaggtggccacacaagggttatgagttaaatagaattagtagcttttatatatactagcaatatttgtttttctttctttcttttattaagagaaggggtcacactgcattacccaagctggtctcactcaagtgatcctccagccccagccttccaaagtgcttggattacaggcatgagccaccacacctggccattagcagtattcgatgtggggtggtggtggtcattcacagcaactcaaatagccaaaagcctagggataaatttgatgtgaaagatacagaggcataggacctttttcttgaggggggaaaaccctggaaaatttgattgcagaggctaaattattcatgagatatagtaagacttagtatggaaatgtgagcctctctcaaattaatataaatatagttacagttctaagtatgagaattgagctataagaaatacgtttccattcagtggaaaagaaatggtttgtttaatagtgctgatgtaattgcactgtttattactactttcagttatccatatgaaacacaataaagttagaccactacactcatgccatacacagcaataaaaatgccttatgaattaaagatctaaatgtaaagtaaaatttcttattcaagctagtgaattaatctcccaaatttatcacctctttcgcctaagaccccattaaagtgatagtaaaaacaaaataaagatgggagcttacaatgccataaagagtaagagacattcaaattgacattgtaacaagtttctggaagatgaagaaatcgtgggaattaaaatggatcactgaaaagaaatcaaggattctaagacttcctagttctctgttctttccaacatggcaggttggaaatttagtatttaaaagtaaaatactaattttagtattaggaatttctcaatggcctttgaaattatttgggttaccttggggtgtttgaaaacccaaattaggaaattatgctttagaccacctgtttttgtaaattaagttttattagagcatgggcatgcccatctatttatgtgtttggggctgcttttgtgctacagctacaaagtcaagtagttgcaacagaaatcatacgacccacaaagccttataatatttattatctggcccttacagaaaatgcttgccaacccccgctcctggtcgttgggatgggcatcttgagacctgcccacacgtggtatgggcttggataggtctagccagtgttatgtagctatttacagaatgtaagcaaaggaaagtgtggggaaagaatatggcaaacagaaaactgaatatcaccacctaatggggccttagtagggaagagaaagagaaatagaaaagggttgttaaagagaaaattaaaatggatgaggtgaattctgcttggaatttaaaactttttggtatattattgattttgtatctggcaagcctaaaatttttatatttctaagatgtttctattttgtttctttccaatgataacactttctcttttttaaattttactgtgtgaattaggacttccaggattatgttgactggaagtgtggatagtagacatcttattcctgattttaaagagaatgtctgtaacatttcactatgaagaatgaagtttatagctgggtgtggagcgcctgtaatcccagcagtttgggaggtggaggcgggcggatcacttgaggtcaggagtttgagaccagcctggccaacaggtaaaaccccatctctgtaatcccagctactcgggaggctgagggatgagaattgcttgaacctgggaggttacagtgagcccagatcatgccactgcactccagcctgggcaacagagcaagactccatctatttaaaaaacaaaaaaaagaatgaggtttacaaaattagctgggcatgttggcttgtgtctgtagtcccagttactctagaggctgaagcaggagggttacttgagacttgagccagggaggtcaaggctgcggtaagcctaggtgacagagtaaaaccctgtctcagaaaaaaagaatgaagtttgctttagctctgacagtttccctcctatttccaggtttttatggaaagttttttctttgtctaagatggtttttctttagtattttaatgtagcgagtgacacatataaatgatcttatattgcactctactcgcattcctggaataaactcagctttgttctgctgtagtttctttactgtatgttattgtattctgcttcctgataatctcgtttagatttttcaaatcaacatttgtaaatattagcttatgattattctttttcacacaatctttgacctgtatgtcatggttagattggcttcatggaatgcattggaaaatatttgctatttttccatccttagaagcatttgtataagattggaatgatttgttccttaaaagtttggtagaaggtgtttgtaaaaccattcagatacggtattttgaaggatttggaggaggaggggaaagatattaatacttactgctccaatttttttttttttttttttttttgatatggagtcttgctctgtcacccaggctggagtgcagtggcatgatcttggcttactgcaacaacctccacctcccgtgttcaagcgattcacctgcctcagcctccggaggcgctgggactacaggcacatgccaccatgcccggctaatttttgtatttttagtagaggcggggtttcaccatgttggccagatggtctcgatctcctgacctcgtgatccacccgccttggcctcccaaagtgctgggattacaggcatgagccaccacgcctggtccaattttttaatagttgtagaactattaaggtttttctgttgcttcttgaatcaattccccctccctagaatctttaatatgtttggaggttgttttctttttcctgtctctaatcatacttagttgtttttttttttttaaatccaacttttggatggttttctttttctctttttttttttgttttttttttttgagatggagtcttgctctgtctccctggctggagtgcagtggcgcgatctcggctcactgcatcctccacctcccaggttcaagctagtctctcacctcagcctcccaagtagctgagattacaggcatatgccaccacgcctggctaatttttgtatttttagtagagatcgggtttcaccatgttggccagactggtcttgaactcctgacctcaagtgatccgcccgcttcagcctcccaaagtgctgggattacaagcatgagccaccgccacctggccaatgctttgcttttcaaactcttcaaagggtatgtaataaaaaggaaggcttaccaccagacaccataccttgattctataagcagtgactgtatttttgtatgttctttaagtgatattttttatccttatgcactcctttatttttactggaagaggagggaccacatgaggcattagtgatgagcattctttttttttttcttggcttttgcctgttttttatgtttgtttgttttgtttttcatcaacctcatttttacatcagcctcattcttcttaataccaatgtagtatttcactgtacagatgtgcattatttattttaacgtagttgtgcttttatagcaaatagaaactttcccatttgtttgaagtaccctaagaatctcctttattactcctagtctagtaacggacatcattactttagagaactctacttggccctctgtgtgtcttacacccattaaacaaattaaaattaaaatgttccataccatcctttgaagagggtgtacaccatttaaatatctttacttaaaaaaataaaagtctgctctcataagcaatgaaatgtttttcaaacatttaaatctctgttcctttttgcaagttatcctagtgtgttgtatgaggaatagatgcagttttttctttttcctcatggctgtcctatttcccagcaccactttaaattccatctttttacaagtattgagatgctactttaatcatatactgaatttatatatatttacttctggattttaaacattgtgttctcgtggttgatctattcatgtactggtattgtagctttttaaaaaacttttaattttaaataactttggacttacagaagagttggaaaaatagtacagagagtttctatataccttttacagattccccagatgattaacatcttatatatctgtactacaattatcaaaacaaaaaaactaatctattggtacaatatagttaactacatttatatggttttaattataaaggctttgtacaatattttaatatgttgttggtttactccctgctcttctttcatattttcaattttttaaatgtctagctgcagaaaataaacaaaagctttatatagtatttttactgggactgtaaaatttataagttagcttagggagaaatggcatttttatgttgctgaatcttggtataccagaataagaaacgtctttccatttgttgaagtctacttttctatctttctcatatatgttttggactctttttgtagtttatgcccagatatttgcattttttattgtaaatgggatcttttctttcatttatcttctgtctggtttctctcccctataaatgaatgatttctgtatattttgtactatactgtattgccaaattatattattataataatatttcatcgatgcttttgtatattccaggtatataattgtgttatctgtgaataatgttccctttctaatttttttctaattttattcattaatttgtgttgactaatattatgactaatagaatggtaccctgactgtaggactatatccagtgtttccacattaagtatgctgttggccttggggttgatagatcatgttaaagaaatgttcttttttattcagtattttcaacaagaatgggtattaaatttgtaaagtgtcttttcctcatctttggcatgaacatatgattttttcccatatctattatgttaaatgatataattaattttctaatagtgactttttcattgtaaattatatttttcatctcttttgggatcagttctgatagattatatcttctagtaaattattttgggttttcaaatttgtttgcatagagttgagcagagtcatcttttatgattcttttgctttcctgccttcttattcatattttcctcatttcatctaaaaatgctggaaaatatatctttgtttttccatgaaaacaaaacaataaaagcagctccattaatgtaaaaaagaagtgatctcaaacttctgaaaataataatcctccacatttaattctgattatcttttgccagcctgaaattttttgcttccttgctttaatttcttacattacttgtaaatttattttctaatgaacatttgaataaaagtctagataatagtccttgtgctttcttctcccctaccccacacttacaaggtgcagcagtgtctttagtggtcatcttaactgcagaaaaacaaattgagaggtttgcatgctctcagtaaagtgaaagattgggaggttttccccatttcatggtgtgtggcagctgtaatgtgatcacacaagtttcaaatttgaaaaatgttttaaagatatatttggtatgcaattcgtgtaattgcaaaaaaggcattccaaagtaaatttatgacttcacaaattttgtatgacttcacaagttttggattagggaggtatggctgcagcatcctaaaacaatataaggttgggtattcttccatgaaacttgttattttttccataaagttagattctttctagagcagaaagaactttaatgattgggaatctggagttaagggaaaaaaagatgattaaaagtttaattgttcatctgaagagttgatttttttattcctgtaataaagggtacttttagcagtctctgctcatcttgcccatccggctctttttgtggttgtgtaaggttataacttctgtgtctcagtaaacttgtgcatgcccatttttttctctgttactaccttttctcttattttgttttattattttgatgtaaaattacctgttaattttatttgaaatgagaaattttaaggttcacattattcaaattctgtcagatccctacctctgtcatatggtttataatgtgctgggtattttcagacctgcttattaaaaagatgtaaaacaaaataatgatcactcctgtggatttttcctttatttttgagatgtctcctttggctgcattacttcttcaccccttgcccattgatcagaggaggggtcttaactatgggtgaaccctatatcttactgaagaggttatgttacatgtatattttcataatataacttacatttacatagtacttttatttttagcatacctttttttattaatcctaataatatcactgtaagttatgttgaagcagattgtaagtgttcatttacaaattgtgaaatgaattaaaatgaaagggcaaagattaaatcatgaccaggcctgaaattaacacacaagactcaatttttttcaaccaaagacttttgtaggtgatccctgcctgcaggactccccttcctcctcagatgtcattggattgtaccaggtttactgtagattctagccgttgtagaactaactagatctaagatgagtcccctgatttcctttggtagagtcttccaattgctgaactccaatattgtcgtgactagccagtgttacaacctgtctgccttattttgtgtaatggatttcatattacagaggcatttttttaatgtcaagatgtttaagtattgcttaagtgcaaactacttaatactttttagctattaagtaattaagataggcaggattttatttgttccaaaatgatttgacctaaactaaaaagagaatgtggatctcctgaatcttacttggttaatcttaatataactcctagcattctataattcttcctaaagtcctcttacctggctatcttttgtatcttctttgtctctcctcttctttcccagtcataataactgccagactctgcttcatttctctttgacagtctctactcctaaggtcatccattctctttaggtatcttttggcctcagtttgagcacagcagatcccaagaccacatatgccatagcataggctattatagtcaaccttttgaataaatgtgattgaactttatgttagtaattcttatttaccatcttcctatcaaaaaggcttaaagtcttcatttaatgctctccttcatgtccattttgttaaatgattgccttttaatgacatcttagaacttcagaactatttcaccatggaggatgtgtaagattagccttttatcaaataaaaagtgtgaaatggaatatgtaatctcattaatccattctggctctaaaattctgtgactatcagataaaattcagaaataaaatagtattactaatataaataaatttttatcataattatatttcctaagttttgcctgtaagaatgggtaaaatatctttaaaaccttgaagaaattattacttgatagaaagtttaatccatctgtgagaaggcaaatgtattcagacacaactaaagttctctcttctattttaatttcatttatcttgaactaagactccactgtttcatcctcttagatgctgctacttgaacaatattgttttgagaccaaaaactagcatattaacacaattcttcttaaacgtcttaagagttttgtttcctttacccctttctttaaaaacaagcagccactaaattttttagtagtgaatttcaaaatcctttttaaccttataggtccaagggtagccaaggatggctgcagcttcatatgatcagttgttaaagcaagttgaggcactgaagatggagaactcaaatcttcgacaagagctagaagataattccaatcatcttacaaaactggaaactgaggcatctaatatgaaggtatcaagactgtgacttttaattgtagtttatccatttttattcagtattccctcttgtaaacttgaggtaagacactttacttaaaagtgtattttaaattaagcaataatatgtaaactctttcttgcaaaagttagcatttatatttttaaataagatatattgaattcattcagtgaatcatataaagaaaataagtgtaaaactccaatggctagttagttcttagttctttttaagattaaagagaagagaccaaatatagcatcactgtactgaggcaaggttttctgtgtagttcatagaaactagcctcatgattttagaatatgccttgaatattaagtgtagccttcctccccaactccctcagatcttgccaccccttaagtgctgcagtgataggtgatcaagaaaatcaggataccctactgggaagagccatgaactgaaagtcagtacctggttctatccctggctttcccacaaactgagctatatgacctctgtatattcttcagaacttaagttgtcttatttggcaagtacaggcatcacactagtctagatgatttccatggcaccttcaagccctaaaattggcttgccaaatagtactgaaaagttctgatcacctccaagacaggttagaaaatcgtctatagtggggaaaatgttctggtttcaaaataattgaggttaaaactttagccattttaattcccacttaggcagattctcttctgactgaatttaataacttcatagaattggacattatcaacaaaaatattacttccaccgggtgtgatggctcaggcctgtaatcccagctcttagtgaggcagaggcaggaggatagcttgagccaaggagctcgagacctgcctgggcaatatagcaagaccccattctcaaaaaaaaaaaaaaattacttcctttataaaaaaaaaaatcttcctgctttgtgttgtttctccctcttggctattttaacatttgagttcctggtccagttcttcctgtctgttcactactcttattccttactaatttcctattctatcctagtttttttcctatgcatttcaaggtttcccttattctccagacttttgtgtgtcactgaggtaactgtttctgcttctcttttaccctttatattcagtatcatcacagctcaacctttgctcatgtgtcctattctctttttccatccctctatcaatcttttctactctaattagcctcttctgtggtaaaactgtccccagcaatgacagacatccaatatacctacttcaaatcccttgggaaataaggtagactataaacaaacattttattctttccacaaactatgggtgacctaaaaagacttgcattagttgcctaacaggttaaaaaagagtagtttggtattttaacattgatcaacacattacatttcaaatcattatacttggcatgtgtttttaaaagttttaaaatacagaattaaaatattctttcatctactttagtatggtatatttcgcagagaactcctcctggcaggcctgtttagatagtacatgtctgttttgtagtgtagaactctgagatctcttttttaaagtttgtttaattccttaagcaattcaaaactcatatttgagagacaatgtaacttacccttagatccatctccacactgaagtggaatgtctctcagagtgacaatagaagtcacaccctcaaatttctacagtggaatatctagttgatcatttatatgtgtggtataatacaagttgagtatcccttacccaaaattgcttcaggccagaagtgttttggattttatattttttcagatttttaaatacttgtattatacttcttgagcattcctaattcgaaaatccaaaatctgaaatgctccattgagcatttcgtttgagtgtcatgttggtgctcagaaagctcaagactttggagcatttcagacttcaaattttcggatttagaatgctcaacctatatacatcaggaatagtggcacttcagatatacctgaaaccaaccataaattttattttactcagcatgtgcttcaacagacatcttgtgaatccattaacatatttccttagaattggacatgtggtaccataacaattacagccctgtaatgaaattatatctctttttaaggttttatgctgtgaaagagcataaaccatgagctatttattttgtcttagaatattgttttgtgtagacacttttgaaaccattggcacttcctactgtggattaaaattaatccacacaatggttatttctcccaaaatcacttgctagactttgtaataccttatataaactcgaatcacgtttcctgttcattaatctctttacccccaaaaaaggcaaaaggaggctgggcaccgtggctcatacctataatcctagcactttcggaggccaagcagaaagattgtttgagctcaggaatttgagaccagcctgggcaacatggcaagactctgtttctgcaaaaaaatacaaaaattagccaggtgtggcgtatatctgtggtcccagctacttggaaggctgaggtgggaagattgtactccagcctgggcaaaagagccagacctggtctgtctgaaaaacaaaaacaaaaacaaaacaaaaaacagcaaaaagtaggtctcctccaaccggattacttaaagtctaaaatttatgtagtagtaccatctagtggcaaaagaggacactgctttgctatttgattatatgtgtctttgtagcagccagggaaataagtgtttatgggttagggaaatgtgaacactgtatattaaggaaatatttatttttaagtataatgatattattgtgtttgtgtttagaaagaatccttgtttaaatatacatattgaaatatttacaaagaagttgtatgatgcctgagctttattttaaaaataagtctgaggcagaggggtggaaatagaggaagtggatatgggtgtagatgagataaaactgaccatgaattgataattattgatgtgggatatgaaggtacatggggctttgttataattttctgcatacttaggtatatgtttgaaattttttgtaatgaaaataaaatagagattacatggaatttagatgatatgaaatcagataaatgcagaattatagctaatcttaaaaaaagttgtgtagtgtattttttactccatggctagagccctccccccaacttgttttttttgtttgtttgttttttgttttttgttttttgttttgagacgaagtctcacactgtcgcctgggctctggtgtgcagtggggcaatctcggcttgctgcagcctccgcctcccgggttcaagcggttctcctgcctcagcttcccaagtagctgggactacgggtgtgcaccaccacgcccggctaatttttatatttttagtacagacggggtttcactatgttggctaggctggtctcgaactcctgacctcgtgatccaccgcctcggcctcccaaagtgctgggattacaggcatgagccaccacgcctggccccctccccacaacttttttttagatggagtttcgttcttgtcgcccaggctggagtgcagtggcacaattttggctcactgcagcctccacctcctgggctcccagagtagctgggattacaggtccctaccgccacgcccggctaatttttgtattttagtagagacggagttttgccatgtttgccaggctggtctcaaactcctgacctcaggtgatccacccgcctcggcctctcaaagtactggaattacaggcatgagtcaccgcacccagcctacctagagctctttaattgactttaaaatactgagtatagcaacaaggtaaatatggcattttagagataaaaagctgaaagatggcatggtgtaggaagaattatctataggcaagttattgaagcatttacatctttgttgtagtttgacaaaatttaatatttataaattggtctataaactgtaaaacaatatacatgtaaagtatatcttttcagaaagtaaggaaaaaccgagatcaacatttcagaatgtattttgaagatgtaattatcaagtgtacttatatctggtaatgaaaagcatctttaattatgatatactgaaataaataaaagtgggtcaagtagcagcctccctgaaatgacaaagttgctcatagataaatatcactggtataaccacagcagatttcatttctaatgaataattttctttctttctttctttcttttttttttttttttttttgagaccgagtcttgctctgtcaccaggctggagtgcagtgacatgatcttggctgtctgcaacctccgcctcccgggttcaagctaatctcctgcctcagcctcccgagtagctgggactacaggcgtgcaccaccacgcccagctaatttttgtatttttagtagagatggggtttcgccatgttagccaggatgttctcaatttcttgaccttgtgatcctcctgcctcggcctccaaagtgctgggattacaggcgtgagccaccgtgcccagcctaatgaataattttctaatgtttctaaaatgttaaaatacttctaagacaatgtgtgattatatagtgtaattaatcttttaaaactgagcttccagaattttaaaatacaaatgaatattctctccttcaaaattacatatgtatttaaaagctgccacttctcaaagaactttttgaaacatttttttttggaactgctttgcaattgtattccattttcttttaaaaactcttcaaaatcaagggcctcttctaggttgtatgcagtatgcagcccccaagaaatctgtcccactcaaaaactagaaaacactggataaaatacaaaaatcatacttttaaggacactggaggactgtggaatcatcaagctctttattaactataattcttaggaagaaagaaccctttctagataagctgagattactggtaattttcttcctggggtatattgattctgggtacagattgagattcatcattggcacaagcaggaggacttcactgggagaaagaaactcttgaggactttctgcaggactaggtatgaaagaaaatgaaatcgttggcagccttgacaaacatgagggcagatgtagagatactagcatttagaggagctctaaatgcatggctcatttttaccatgagatattggccgagtcttgtagtgcaggagacttgggatagactagaaacgcagaatgttagcaggcgaagtcctgctagagggagagacatgttactttcataccacaggtctcctcaagtcatttgccagattttaaattttgtagagcaggagattaaagacctgagtttacaacctccaagagaaacaacatttaaggctagagagttaagtgctaccagagaataaggctgaactggaaaggcaaagtgaaatatcccatattcctgcaatgtttaggaaagacctattagagggagacctacctagtatatcaaacatgactggttttccattcaagataaatgtcagattttgatactgtatagggtaagaagttaactgctgaggagatggagaactttcatattttctatctgaatatagagagacacactcaaggaactgggaaaaccaaaccagttagttgtgaacttaaaattgcaactaggtctcaatccattttttttttttttcaagacagagtctcgctctgtcgcccagtctggagtgcagtggcacagtcttggctcactacaagctccacctcccaggttcacaccattcttctgcctcagcctcccaagtagctgggactacaggcacctgccaccatgcctggctaattttttgtatttttagtagagacggggtttcactgtgttagccaggatggtcttgatctcctgacctcgtgatccacctgactcggcctcccaaagtgctgagattacaggtgtgagccaccacccccagcgggtcccaatccatttttagttgctaattggattgaggagatcagaccccaacaatggaaaaggcagactctctagaggaaaatactatcaatcatcttaagtctcttttgttcttgtatacacagttggcatacagtcaaacgttatatgaaatgcagagaaactggaagattactgataatcaagggaacaaataggtaataggagcaaactcagatgatccacatgttgcagttagtagtcaaggattttaacataagtattataaatgtcttgaaaaaaagaaaaatgaacagatagaaaattttgacagagaattggagtctataattaaaaggaatcaaatagatattctagaactgaaaaatatatttgaaattaacattggatgggcttaacagcaggctgaacactgaattagtgaactagtgagaagacagaattagtgaacttgaaaaaagatcagtagaaaatattcaaactgaagcacagagaaaaaaatggaaaaaacaaaaaagacaaaacaatggcttctagaagaaaacataggtaatagcttcttgtcctgggagtaggcaaagatgtcttaaacagaatgccaaagcaccatatatagaaagaaatttgatagacctcattaaaactaagaactcttgttcatcaaaagactcgagtgtgcttctagaagaaaacataggataatcttatctatgtggccttgggtgggcaaaatttcttaggacacacaaaagactaaacataaaaatgtataagataaacttcatcaaaattaaaaacctgtgcttttcagaagacttcattaagaaaatgaaaaagtaagccatagaggagaaaatatttgcaatacatatatctgaccaaaggctcagttcagaatatattaagtaattccttcagaatatataaatcccacaaaccagtaacaaaaagacaatccagtttttaaaatgtgacccagggacttgaaaagacaattcaaaaagaaagataaatggcagataagtccatgaaaagggattcagcatcatttggcatcagggaaatgcaaagactatttcactcctactcaaatgactgatgtttaaaagactgatcacaccaaatgtggagcattggaatgctcaggcattgctgagagaagtattaaaaaccattttggcagtttcctttaaaattaaaccctatgactcagtgtttgcactcctagaaatgtactcaagagaagtgagggcaagtgtccactaaacggtacaagaatgttcatagtgacattctaaataatagcctgcagactggtaacagcccagatgcccctttaagaggagaaaggatagataaattgggctgtatttatacagtggactgctacatactatacaacatttaaaaacaatgaactgataaggcaacagcatggacagatttcacagatactatgttgaacaaaaaaagtgagacacaaaatacttatgtactgtgtgattccatttatatgaaggtcaagagcatgccaaactcttctgataaagaagccagaatagtggttacctctaggaaatgaagattggtaaaaggagcttgagggaaccctctggggtgctagaaatgtattttcacctagatagtgattacatgggtgtgaaaattcactggatatttaggattagtgtattttacatatgtgtgttgtgcctcaataaaacaggaaaaaaattacttgaggtcagtttttattgtggaatagccataaactgttcacagcaaactagtaaataatgtaggtcatattggatggtatcatcttaaggcaaagtaactggatgtgactgtaaatttacacagattttgttgatgaggttcataactcaaagcacttacaaaagtaatttaacacatcattggagtaagttagtagctttccaaggtgactactttgggaatctttttaaaaattgtttgaccttaaatcttatttacctttatgcttatagctatcaatagatttctaacaatgtgtacagaaatttttaaaaatagaactttattacaagttgagtatattcactattttattaaattaggaagtgtggacaaaaaaaatcaaaatcaactatttttttttaaatttaaatcccatcaccagaggtaaaagtaacctttgatagtatatatatatattcttttctctatacatttatgcaaacttgcatttgatgacatcatattttgcaggttttttttttctgtgtaatttattgtcatcttacgtcagattatgtattttacagttgcatagtattccattgtaggtacagctaaaaaatgctatggtttatttaatacttattgttggacatctgaatttatatggctttttaatttctttttttagtattttaagtttttattatttctttttaaaaagaccattaatgtaccattagttttgaaaaaattagatgtatgtccaatgatgtacgaaggattttttatttttaaacttttaaatctttgtaacttttctaaaaacaagtaggattttttctaatacatattgtttaaaaagtatgacacaacaagtaaaaaagaaattgcttgtaatttcagtctccatagaataacactgttaacattttaatgattctgctttcagcatcagcttcacctgagaacttgttcaaaatgcagattttcagcctctaccccaggcttactgaatcgacagtctatgttttaacaaggtcttcaggtgattctgatccatgctgacgcttgagaacactactgtaggctttggagaagaatcttacaaagagagacctgatcggccgggcgcggtggctcacgcctgtaatcccagcactttgggaggctgacgcgggcggatggtgatgtcaggagatcgagaccatcctggctaacacggtgaaaccccgtctctactatactaaaaaaaaaaaaaaaaaattagccgggcgtggtggcgggagcctgtagtcccagctactggggaggctgaggcaggagaatggcgtgaacttgggaggcggagctttcagtgagccgagattgcgccactgctctccagcctgggcgacagagcgagactccgtctcaaaaaaaaaaaaaaaaaagagacctgatcacagctgtgccttaaaaaggctgctctgacagctctgtgcaaggttgagccacttgggaaattattttcatagtttaggtagggttaataacaagatagtggcagtaagaatatgaaagagatagctgtaagagagctaatagaggtagaatcaccagaaatccataactgggaatgtgaaggaagaggtgctaaggatttgagctggaggagaaagagaaggctaatgccatttaactgagagaatacaaggcaaagaataggctttattggtacaaaatgttagttcagttctggacatttagatgtatggtacctgtcatacagatgtaaagcatccatcagttggttggaaaagtgagtctgaagtttgcaagtgaagttaggattcgagacatgtcattggaaattaactgctcaagggtagttgttgaattgtgagaccggaagcctgagaaataaggataagattaaaaaaggattattgaaggactaaaacagtagcaatggatggaaagagaattggaatcctggaaaaatcacaggtagtctccaatgagagttcttaaatggaagagatggtgccctgaagtttatagtagacattttgatgggcatattcaaattcagtaaaggaagttatcactgagcaaatttgttttctattccacaaatgtaaaacactctggaatattttgaaaataatacagtcaccttcatgcccccacatctacttaccaaagcctttcaaactccaacatagtctattattttgaaggtcagatactaaggctatttattaaaaggaattctggggtttgggggcgatttctttgtttctgtttttttagctgaggtctcactctgtcccccaggctggagtgcagtggtgagactgtggctcactgcagcctcaaacttctgggctcaagtgattctcctgcctcagcctcccaagtagctgggactacaggcacatgccaccactcatggtttttgtttgtttgtttttttaattttgtagggacagagtctcgctatgttgttcaggctggtctcaaactcctggactcaagtgaccttcctgccttagcctcccaaagcgttgaggttacaggcatgagccaccatgaatgcttacaatgtcactgtcaagataaatcagtgaaaccgtctttgctccagtcactcactttttgacaggttttccttttaatgtatttacagattacttttcttataggggaacgttccatttagttacaaagttgcaaatgttcaaatattttgtcttgcattcaggaaacctgattggccaaagaactatgctaggagctagaatggaatgcctcagtaaatggaaaataatataaattattattaagtagcatgcaataagagccaaagttcacaaatgtaatggcagaaaaactggtagaaaatgaaaatttccaacattctttgagaaaaaatgatcaagaaagggattacatgggaaagaagaaaagcatcaaaagtcaagaagtagtgaacatacagtcatttgaatgtatgctaattgtaaattagtatactagcagaatatacttaaatgtggtatataaaagcttgaatgttgaagttgttaaatagattatgtgttaatttggtgttttttatggtcatgttggtgcacgcttaagagacatggattctaaacacataagtagcttttgtaacttgagcaagtctctgggtctcacttgttttatctgaaaaatgagaataatttgcattgttggtttttaggtttgaaataatgaatgtatcttaaatgtgtttctaataccttgcacagagactccccataatcaccattatctcaaaatatcactattattatttggccatgatttatttattaataatgaataataggtaatatatataaggtgcgtgctttgagagtgatctgaatttttttctcagcatacttaaatgtcaagaaatacagaatcatgtcttgaagttatttagaatttcatgttaatatattgtgttctttttaacaggaagtacttaaacaactacaaggaagtattgaagatgaagctatggcttcttctggacagattgatttattagagcgtcttaaaggtagattttaaaaaggtgttttaaaataattttttaagctcaaattgtcatctttaggtgtgtagatccaagtacagcttctctcgatttgggtgttggtatcagttttcttggtatgttagccttaccctcaggatgtaattgttaaagtacaaataaataaaaaatgtatttgtgtgtcatttcttcagttaaacatttaactggctttgaatgaactattttaaatccctcccttaaataattttcggctctttgtaaagcttgttgctattctgccagtcactaaatagggctttagtattctatatgccatagacttgagcctactgtttcattggaagaagtattgtcttcttcattcaggatagaaatactttaaccttttcacatatataagttgattataattcatttttagcagttttaaaaggatatctttctcattctgttgcttgaaaattccagtgtcagaacagagaaagtgcttgataataattgaagccagacagagaaattacttttggattctaaaatattatttagaggaagtctaaggaagtacattttatctaattttcctttaacacactccttatttttaccctgacccaagtggacttttcagggaaagtcctaaataatttttgttttcagtcatgtatatttgtggttaaaatgtaaacctaatatttcactttaaaataatataacattaagaatattttagactgcttaaagcaattgttgtataaaaacttgtttctattttatttagagcttaacttagatagcagtaatttccctggagtaaaactgcggtcaaaaatgtccctccgttcttatggaagccgggaaggatctgtatcaagccgttctggagagtgcagtcctgttcctatgggttcatttccaagaagagggtttgtaaatggaagcagagaaagtactggatatttagaagaacttgagaaagagaggtaacttttcttcatatagtaaacattgccttgtgtactccagtttattgttattttgtaatataatatttaaattgtgaatttatagtaggtgatagctaacacttagagcattttgcatttttaaactcaaagatagcatgttattgattgcacttacattaaatctaaaaatataaacaaggccgtttcctgggattctgaagacctattttgtcacttattttgtttttttgtttgttttttggggtttattttgagacagggtgtcactgtgtctcccaggctggagtgtagtggcatgatctcggctcactgcaacctccacctcctgggttcaagcggttcttgtgcctcagccacccaagtagctgaaactatagacgcctaccaccacgcctggctaatttttgtatttttggtagagacggggtttcttcatgttggccaagctggttatcacttaaatactttgactactctgtacattgagtaatacacataattattatatttatacgtagttaaaatgtgtaacttgccagatactttggcccacacctgtaatcccagctactctggaggctgaggcggtaggattgcttgaggccaggagttcaggactagcctgggtgacatagtaagactctttctttttttttttttttttgagatgcagtttcacttttgttgcccaggctggattgcaatggcacaatctcggctcactgcaacctctgcctcccaggttcaagcgattcttctgcttcagtctcccaagtagctgggattacaggcatgtgccaccacgcctggctaattttatattttgagtagagacagtgtttcaccatgttggtcaggctagtctcaaactcatgaccttaggtgattcccccctgcctcggccttctaaagtgctgggattacaggcatgaggcactacacttggccaagactctgtctctttaccaaaaaaaaaaaaagaaaaaaagtagtaactggatttttattgaatttctgattatctattgaagtatattcagtaactactagattcagtaaaagatgactcttttcattatggaaggcccactacaagtggccacaaatgaaatacttctttttttttttttttttactttataaataataattgtacatttcatggggtacatagtgatgtttctacacatataatttattgcaatcaggttagcatatctgtcatctcagacatttattatttcttcgtgttaggaacattcactgtctaccatctagctatttgaaactatgtaatattgttaactgtgctcatcctatggtagcgtagaacacagccctgtacagtagcgtagaacacagtcctgtacagtagcgtagaacacagtcctgtacagtagcgtagaacacagtcctgtacagtagcgtagaacacagtcctgtacagtagcgtagaacacagtcttatacagtagtgtagaacacagtcctatacagtagtgtagaacactagaacttattcctcctatctagctgtaattttatattctttaacaaatctctctttatctcttctttccctctgtgtttcctagcctctagtatttactttttacttctgttagtaaaaagtaaatttttcttttttttcttcttttttttttttttttttttgagataagagtcttcctgtcgcccaggctagagtgcagtggcgcaatcttggctcctgcaacctccacctcctaggttcaagcaattctcatgtctcagcctcccgggtagctgggattacaggcacgccccaccgcgtccggctaatttttgtatttttagtagagatgggatttcaccatgttggccaggctggtctcgatctcctgacctcaggtgatctgcctgccttggcctcccaaagttttgggattacaggcatgagccactgcgcctggccaacaaaacatttcttaatgtataagttttaatacctgaaaaaaaattgcttgatgtatggaatgagttctgatttttcacagctagtgtattaattcttctcttcctaaagttaacattatctcactgcagataccaaaatatagatcattatcaggaacttcgtcaaatgttttatgtcccctaaaagattccttaatgcacatattaaggaatatctttattatctttatatttctaaaagttctattagacattcagaaaatggtaaaatatataaaagcttcatattatctctgtgaccttggttaagtcattaaatttttgtaccattttcttctgtaagataaagatatggttctactttgtggcattgttgtgaaaattgaatattagtatataggaaatgcccagcatatctccctgagaggcagaagaccttttataactttctctccagtttcatatatgcccatttataaaaatagggataattatctggacgagaaatgatgtttcactgtcttttatttcttaagtttacataagtctctgtttcatacattgatcctagactattgaaacaccatcttgaaaaataaggagtgaacttgggtccataatcttccatctctttttcccctttgagctctattaagaggcagagggcatgcatactaacctttccttacttgctttcttttccttactttgctttatgtaggcaaagtcctgattttattagcagagagagggaatttcagagaaaaatattaatttttgaaataagttttactgcaaatactagtaaacctaacaaatacagctgtaagtggtaaggaatacttgtaataaaaatgttcttagtttctgtcttgacattatttcttgctagtcttccagagttctttgcatctaaatctaggaaaagcttatttctctgttcaaagacttaaatgcaatgatccccatgttttatttattatataataccactgtaagtaactttaagctagtattctgacttttaactccaagtggaaaatacatttctttttaaaaatatttaaaggtgctttagccttttctgttgttactgtagaaaagacgtcttgtttttgttttcgtttttctcccaaaatatggcccaacttctaattcaggctttattacactctataaaaagttgctttatctggagagaaagaggtatcaacatggtgttgttagaaggttctcaactctcactgatcattagtatcactagtttagctttataaagcatcataaatgaaaagtatcagtattcctttgctatgttcagtctcatttcccatgagatagttacttctataactctaaataatatgtttatattgctagtattggacatgacttactgactcaccactctgaaagatgaagatttgttaaattcactcaattatccatccagtttttaattctgtaccaattctttggtcgaatttgtatacatatacacataagcaaatacacatacatatatataagttctatttcttgttctttcctgtgagtgactgtgtctactgaagccccgctgtataagatttggcaactgtgtgtttacctttattttgttaagactgttaacagttacatcatactatatatatttaagtcttcatgtttttttattctgtaaattaagcataatgttgatgtgaaataagtgggtttttttaggactctgtagtcgttggacactgtgagtcagtagtatgccagaattaatttttgctccctattgatagaatatcatactctttgtgctgtttaaaggaagatgatgctatttggactgtgtctttcttatatagctctttgtttttgtctcaagtttctaattgcctttcttttatgttttcgggagcagaaacttgtgcctttatgataatatgaggatctagtttcattttattcataaataaatttttattggagccaatgaatttttctgatctaatttgtaccatttgcttcctgagcctgctacaagactgtcataccactgttgtcattatgcttcccatttaggtctaatatgtttgggtgttcttgactcttgctgtgttggagagagataaattgatttcttgcttgtgtgatagtatacttattttgctctcacacttgattgatagttcaggtaggtttaggttcaaactcatttttcttcattatcaaggtaccaatgagaaatttgataccagtctgaatcttattcctttgtagatggccatttttcctctttggaagcttttgaatgttttggtatgcatattttcctcattcatcatgctgaatatttactgtacccttttgatctggaaatttatttattcagcttttttctgttatattacttctttgatgattttcccctttagttttttctgttctttctttctagaccttcttaaagtcatagtttatatcttcttcctttatctgtactcctcaagataaatgctagaagttggttaagccaggacttaaacccagcttgtagctttataagctgggttttgaacctcagttttctagttagtaaagtgatcatgagaataacgacctcaaaggatatcatgaggattaaattagatttttttaaagtccttagcactatgcccagtacatacagcattcaataatgttaggaattgttgctgtcatgttcactattaatttatttaacaaatatttattgaatgctaatacaaatgtgccatgctcttctaggtgacccccagtaaggtagaggactaagaagacatgagatttatgtgaaaaagcatttttaaagaagaccattggcaatcacaaaataggcctttagtacactaaaccctaatgactctgcctgttctgagtctagccttagtttcagttctgagccttatgaactgctgttgtgtgagtcacaaggtcaactaccataatttaatcacttgctatcattttagctgaagacactataaccttggcttccccagagtattttactacaggttaatcttaaacttgatagtagcaaattgtccctagtgtccctaacctcccccttacttcaacactgccactgacattggcctgtcaatttaagcacttttaatgcccagctcttttttttttttttttttaagacgaaatctcactctgtcacctaggctggagtgcagtggcacgatcttggctcactgcaacctccgcctccctgattcaagagattctcatgcctcagcctcccaagcagctaggactatgagtatctgccacagcgcccagctaatttctgtatttttagtagagacggggtttcaccatgttggccaggctggtctcgaactcctgacttcaagtgatccacctgcctcagcctcccaaagtactgggattacaggcgtgacccgccgtgcctggccccaactcttatttcataagttcatttattaggaagtaatggaggaaatagtagcatcaccatctattttattctttttcccaccttggacctggtaggtcctgcaggtcctcactagggaaaactgaaaaatagaattaaatctcatctttatgggagttgtggtacccagctgtgaatggagttcaggctttctgcagtgctttctcctgttcctgttgtcagaaatcggagggagagagcagcttgtctttagtgtgccttttctgagggatgctacatcataagcaggggcttcctttcttcccaatcagtccatcactattaaggttgccacataagaacaaaagcttatttcttattttttaagttgcttctcagtaaaggaaaatacattttagcaagaacagaaccttccacatactcactactaagattcattcccatatttcctaagaaacaataatcaagcagaacttttaaagtaatagtatcagagtggggaacgtctctctgtatgaccaaactccagaatctgtaatagaaaatatctacaaatcggactgcatggaaatcaaaattttctacatggcaaaacgttacagttgacccttgaacaattcagggattggcgtacccacccactacgtgcagtcaaaaatatatatataacttttgactgcccgaaaactttactgattgcctgtctattgacctgaagccttactgataacataaacagtcaagtaacaaatattttgtatgttatatgtattatatactatgttaagttagagaaaacatgttattaagaaaatcataatgaagtggaagggaattcttgtataagtggacccatgcagttcacacccatattcaagggtcaactgagtaaaaaatgttaaaaagacaagtgtcaagttcagaaaattatatgcagcccaacaactgacaaagcactatcatttttaatatagaaaaggtcctacaaataagaaaaatcacagaaaaggaaatacaaatggtttataaacttgaacaaaatgtttaatctcactcatagtaagagaaatcaaattaaaaccagtgatacaccatttaaaaaaactagacatgaaaaagcaaaaagttgaattaaacacttaaattggtgatgatggtagcatacattggtataacatctcacaagggcagtaagttaaaaatttatatattctaggaatttcttttatataaatgagtgtatatgtattaaatgaggtataggtataaggctattcaatgcagcattgtttataataacaaaagattagaaaagccttaagtaccctccaactaagagttggttgtagtgtatccctacatagatttatgaatactagggaattcttggaatattatgtagctaacaaaaaaaatacctagtatagattgagcatcccaaatctggaaatagaaaattctccaaaatcctaaagtttttgagtaacatgatgctcaaaggaaatgctaattagagcatttttggatttgagatgcccaactggtaagtataatagaaatattccaaaatccaaaaacacttctagtcacaatcattttgaataagggatactcaacctgtgcctatttgtgttctgcaagatcgattttttttttttttttttttggaaaggagtccattgcccaggctggaatgcagtggtatgatctcagctcactgcagccttggcctcctgggctcaagtgattctcccagctcaacctcccaagtagctgggactacaggtatgcaccaccacacctggctagtttttgtatttttttgtagagatgggattttggggtttgggttttcatcatgttgcccaggctggtattgaactcctgagctcaagtgatccacctgcctcggcttccctaagtattggcattacaggcatgtgccaccacacctggcccccaggatcaatttttaagtgaaaaaaagttgcaggacaacatacactataataatatgctacaatttatatttaaaatgtacatataagtatgcacatatgtccttgtatttttatagaatagctctagaagtatacctaagaaaattataacagtggtagctctggcaaagagccacgtgaaaagagataaattatatactttttgtacctcttgagttttatccctgtaacactcttactgtgcatttatgtttataatgctcaggtatacagtttcttagtacagattgctatggagaacaccatcatttggtgttcagattccaaactaagaagtttttctccgtcataacttcctcttatttcaaaatgacagtatatttcttattattttggctgctgtgaagctgaaagccacatcagtgtccaaagtaatagcttcttatattctgggtttgttttctgggcatcattgctgcttttcttatttcctttactatactttttattcttatattaattttgagttttgttatatgtgtatcttttacctatcattatattcttagactataaatatgaagaaagcctttggtgaagtgtaagtattcttttaaggatgattaccagtttatttagaaaaaaagttctttttaatactctaattttaatgactgtaatattctaagtcctacctttaaaaattgaaatcaatgtaaattttttgagtaattcattattagcactttaggtagagaagtttgcaataacaactgatgtaagtattgctcttctgcagtctttattagcattgtttaaacgtacctttttttaaaaaaaaaaaaataggtcattgcttcttgctgatcttgacaaagaagaaaaggaaaaagactggtattacgctcaacttcagaatctcactaaaagaatagatagtcttcctttaactgaaaatgtaagtaacttggcagtacaacttatttgaaactttaataacttgatattttaaagtacctaggtaatccattaaaattcaggataactgaatttatagttatttgtaaattgcaatatgttttacccaactttaggcctgaatatataatagttaatgaatttttgttggtaaagatgataaaactttattgtgctcaaatgttttatttaaagctcttatttagaaaatctataaagtttgaattctagaggacctcagggttcaactaggcaactagttttttaactccgtgtattgaattgccaaacatactctatagaaatatttatcaccatctgcctattttttgtactgtgttgcaggaatcatgccaaatagtttttgcaataaaaatatctctgaaaatattctagatataaatgccaatagctatagcacggatattagcatttttgcaagcactaaagctggtttgttttgtccaccagtattcacaataaattaacagtatgcagttgaataacattctgatttactacaaagggttatttttcttggcctctgctgaaccagtaaaacatatactgaaaagatcgaacctgcatataatgaatgtgttggagtaaagaaaaaacatgcaagtcaatagtttagattacagaagtttgttcaccgatttatgacagcaggtcctaaactgccaacatctctaaccatctgattaggtttccatgagccaagtcttagatattccatgaatcataaccttttagtcagtgtaacacagggatttcaactttttgttaagaaatgactcaacatggtggaggcttatgcctgtaaccccagcactttgggaggctgagaaaggtggatcacttaaggccaggagttcgagaccagcctggtcaacatggtgaaactctgtctctactaaagtaaatacaaaaattagccagacatggtggtgcatgcctgtaatctcagctacttgggaggctgaggcaggaaaagcacttgaacctgggaggcagaggttgcaatgatccaagttcatgccactgcactccatccagcctgggtgacagagcaagactccatctcaaaacaaaaagaaaaaataaaaaaaaaaataaatgactcactagaggaatctttaagtgtccatttaactgtcttgtttagctaattaaaatacactaggatttgtctggtttcctcatctggatgttgctagcaatggtaacatttttcattttagaaattttgcaaaccattgcatttatagatatgaattctgatatggctgctttaaaattatccaatttaaattgtccaattaaaatcattcatttaacttgaaatgtatgacttaaggaaatttttcaatttaacttgaagtgatttatttttcttagattgttcagaatgatggcatttcagaaacattggattacctgtgatttttgttttggtaaatgtttaaaaacaataaaaaaggaaaacatttacgtgtgcattttctttatacacacacacacacgaaaaaaaaacaagtaagaaacccagaatggtccttaggcatatgagaacagaagttctgattgagtaatggctatggaaatttcccctaatatatttagaaaagctgttctctcatgcagtggatataatataccatggtatctaatttttctttctgatgaaggaagcaactacagaaagcttttatttatttgttcaaagtgaccagtgcaattaatgcaaaagaaaatccacagcaactctcccaatactactttcaaaacaaacataccaaacttgattttcattaaaatgtagttatttcttcacactagtaaatcaaaaaccaagacccatataaaacagggcgaacaattactgtgcttcatcttctggacaagaatgccaagttagtttctcttttataagcaattacattttgaggacccttcatatttgcctcttttgccagcagcaactctgcctaatctgaatccttccatttcatgagaaacagcagttctccactgctgtctgtggcaccaattactccttcaggatcaagacatctggcaaagccttttagtttgtcagcagcatcccttctcttctttgatttactgtcatcagattcactgtcagataaagattttctgtttgtgccatctttttcttgactagttttttgagaattaagaaatgcttcaattaaccctgaaccatctaaattttctttaggttcccaagtgttgtcaacatctgtaaatcccttccgcttaaggaaatatcccactttcctattcactacacgtcagtctagtacattttccatcacagattcttccggctctgcctcttcatcttttttactctttccattctgtttgtttcctattttttgcaatgtagttttattggaggccattttttattgcagacttgaggagctgatattcaccacctccaagctgctctgggttataggtctgcagtgttctgtaaaaaaaaaattctaatcctgtcagcctctccctctccatgtcaatgattttattcatgggatggcacatataagaatatttctcaaatacatttatagtggctgcgtcagcagcacatatcctaaaactggaatgaggcagaggagtttagcatggcccttgctcaaggatgacatggaaattgatgaagtattctatatttaaaaaaaaaaaaaaagaaaattatataatctcaaacaagactacatattttagctattatccataaatatttcacgtaacttattttttttttttttgagatggagtctcgctctgtcgcccaggctggaatgcagtggcgcaatctcagctcactgcaacctctgactcccaggttcaagcgattctcctgcctcagcctcccaagtagctgggactacagcatgccaccatgtccagctaattttttgtacttttagtagagacaaggttttgatgtgttagccaggatgttcttgatatcctgacctcgtgatccacccaccttggtctcccaaagtgttgggattacaggtgtgagccactgcgcccagccacatgtaattttttaaaagaaaatagactaattaaaatataacgtactctcttagcttagatttttcattttctactactactttgagagaccaaaatagacaaaaaggtaaaaactgaaagagagaaaaccgttttgaaaacatgtagctagccaggtttcctgagtggacgttggctgacaggaggtggaactggaagcttaagtgctcattctcctagaataatcattcagggttttgagagagaaaggatccctttttctgagagggcccttaacatgttaacacttaacagtgctcctgggaattaaggagcacagataatgagagaacagttattgttagcctgtgaggattaggaattttgggggatttgttgggactataacttatgaagaaaaataccaaagtgtagttttgcttaccgttaattttggtcattagagaatatacaaaaatccagaatcccactgtctacatgaagtcaggttcaggaaagagcttaaatgtacatgacaactcaagagtatttggttactatctgaaacaaagatcagttgtcaagttaattattctctactaatttattaagtagatcacatttatttaatatgatatataagacattatcaggcaccattggcaacatcagcaaatttaaactctgcttgtattttataagtattttttattttcacaaattttgcatttatgttgggaagccaagctaatgaacactttatgtggaaatacctacttatcaaaacattactgaaaacatcagatctaaaccacattattgcaacatactgtgtcatgttcaattttttttttttgcagagagggtttgggaagtggaggactaataagtggagttacaactggctcagtaggaataagaaataacatgcagactatttcatctctattgcaacccataatttgggtatgcctaagggaatgcattctgcatatgaatgtcatctgtatgttgcaaagggaaaagggtgagaactaatctaactacaactgacaacacaatttggagttcttggaccagaatgccattctgagtcagatatatgtcatatacagttttctaagggcacacagaaaatctataacattgcctgattcccttcatggcccattataagtctgttacctatcattttatttaatcagcttttattgccttttgggcatgggtttatatgtttcattaccttgtccttttaaaatcctgttgcatgcttggcagttatcacagtccttggaattttaattaaagggttaataaatttttgaatgagttattacccattctgaagaagtacctctttttgtttcaactttgctttacttttgaatttttaccaaagtctgtgttgactttatctactctatttatgattatctttcttacatgtaggctttttcttgtcccatattcctcatttgattaatgaaaaagttctctcaacttaatctgtatgtatatggtaatccttaccttaagttgaagtatgagcttaagaatgatggacttgtttcttgatatttctatgttgtccacgttaatatgctagtatttaataattaaaagtagtgcctcttcagtagagaagagtcataaggcaactgaatttaacctcactctaactggaccaattatatattttaagtgaaataggccaatctaattaaagccacttgtgactttggcaaataagtgtttgaattccacgtcacatcagggatccagattgagtctgacacctataatcaaatttaaacactccttggagtaaaaaataattttctcatgcaccatgactgacgtatttgcttattcattttctttattggttcttatatgcttttttgcttttactgattaacgtaaatacaagatattgatacttttttattatttgtggttttagttttccttacaaacagatatgaccagaaggcaattggaatatgaagcaaggcaaatcagagttgcgatggaagaacaactaggtacctgccaggatatggaaaaacgagcacaggtaagttacttgtttctaagtgataaaacagcgaagagctattaggaataaaatgaattacagctctgttaatattgattaaattttattaaagacataaggctgtgtttattttggctctatttcaaaataagatttatcatggctgctgagcaacataatcaatattcacatagttgtgtctttaccatattcatttcccctggtactgttctgttctgccttggaattataagggagagacagagttagatggtggtcttccggtagctaatgactagcttcagttctcctttgaaatttttacttcttgtaatcttagactgtataaaggcattcagaacatgtcactgctcttcaaattgtgcacttaaaaaaccctcattcaaggataataggaaggaaacaaagagaattttaggagagatgaagtaagttgtatggagaacattcccatatttctaccctcaatgtcaagaaagagtattagctagctttgctattaagtatttttatatattattgaatatagcctttttatattcaaacaagtttatgactgactaatgttttaaagccctgaagaggccttgccaattgccttatctgtttcaaaactagcgtgggttgttgttttcttttttaacttttgggacaaattgggaggaaaacatttaaagattttctttaagtaaatatagcaaataaaagcagagaccaacatttacatggtagtgatacacatacattttgtattctataaaacatattaaatagttttaaaatggctactgtaggatattttacattccttgaagtatagtctttattttttttgtgacacttcctaaacataatgatttttttttttttttcttgagtctcaccctgttgcccaggctgaagtgcaatggcatgatctcacctgcaacttccgcctcctgggctcaagcaatgctcctgcctcagccacctgagtagctgggattacaggcgtgcgccaccatgcccagctagtttttgtttcgccatgtttgccaggctggtcttgaactgctgacctcaagtgatccaccggcctcagcctcccaaagtgctaggatttagagtcatcatgcccagtgtattagtttgttttcaggcttctgataaatacatacccgagactgggcagtttacaaaagaaagaggtttaagggacttaacagttctacgtggctggggaatcctcacaatcatggtggaaggcaaggaggaacaagtcatgtcttacatgggtggcagcaggcaaagagagagagactgacagggaaactcccatttttaaaaccatcagatctcgtgagaattatttactatcacaagaacagcacaggagagacccacccccataatttaattatctcccactgggtccctcccacaacacatgggagctgcaagatgagatttgggtggggacacagccaaaccatatcacccagcctaaacataatgtatattctatctgttttggagtatggtggaaggctaaggtgctactaaaacaccagtaccatactacatttcatagtccatacatgttagtttcatagtgaaggttaagatcataatgaggttgggggcttaactagtgtttgtgtgcatgtgcatgtatgtgtacatgttagttataatacgtgtatatatcattttttcttaccttccctcttgcccctatcccagtcagaaagattcgtgacttaaatgtcaaaagtaaaactttaaacctttcagtagaaaatatacataagtatgtttctgatattagagtaggaaagtatttcttaagaaagacttaaaacgctaatgataaaagaccaataagtttactgtattaaaattaagaatttatcttcaacaggtacctgaaagaaagtgaaaagataacttacaaattgggagaagatatttattaccatataactggcaaagaactaaaatcaagaatatataaataacttctaaaaatacattgcattttacatttagatttaaattttagattttcatggaattattttaaaatgttaggtttatttgtttcaaaaaaacaagtattactttggtttatatgaatttgcatttttagaacatgaatatatgggatactgtagacataagttagtttttctgtgtctgttaatgtgagcttttttttagagagagagatcctaaaagaacaagatgtgatggtagttgtaaaaattcttgtgctatataaatataagtaggtgtattccagacattttatatccctgaggagaggttaacttgagttctttcttggccattttgttcacataagcgctgatactgtcattcttactttattctggaatgccgtatccttcattttggtagttaatattctaaggaaattttattctgtattttgagaaacatacgtgttcatttattctggaaatagttatatgaaggttaaggttaaagaaattgtaaacaagataaaaaggcaaataatggaaatgttggtagaatatataagagatttaatatccctactctacaaggatcacctacaaatcaattgaaaatggtcaaccatgccaggcatggtgattcacacctgtaattctagcactttgagaggctgaggcagaaggatcacttgagcccaggagttcgagaccagcctgagcaagatagcaagaccctgcctctaccaaaaaaaaaaaaaaaaaagctgagtatgatggtgcacatctgtagacctagttacttgggaggctgaggctgaggaggatcccttgagcccaggagttcaaggctgcagtgagctacaatctcaccactgcactcaaaaaaaaaaaaaaaaaaagagaaagaaaggaaagaaaagaaaagaaagaaaacagataaccaaatagcaaaatagtcagaagatgtgaatagttccatcagaaaattaagttcaagtgtctaataaacaattgtgaaaagatgcttaaacatcactacacatcagggaaatgtaatataaagtaaggtactattttttttttgcctatcagctgcccgaaactttataatttttgatgacatgcagtattagcaagggtgtgaaagtaaaaacatcatctacctttaaatcttttttgtttgctttgttttttctttttgagacacagtcttgctctgtcacacaggctggagtgcagtggtttgatttcgccttactgcaacccccacctcctggcttcaagcgattctcatgcctgagcctcctgagtagctgggactatagttgtgtgccaccacgcccagctaatttttgtatttttagtagaaacagggtttcaccatattggtcaggctggtcttgaactcttggcctcaagtgatctgcctgccttgacctcccaaagtgctgggattacaggcatgagccactgcacccagccaacattgtctgccctgttcttttaagaataaattgatacatttttggaggacaatttggcattatttgccaaaattaaaatgcctgtgctctatgaccgtgtgtttctataggacttctaggaatatgttgcgtacagaaatacttactttagggcagaatgtagatacatattttaaattattaaatgaatagtatgcaagctattataaaataccatactgagaatagtgggaatatggtagccaaagcactcctttccctcctaactccctgcttgggtgattcagcaagtgaaacaagaacggccctggaagaggagatctcaggagggtctgaggctatgagaaaaaatatgggatctcatttgcaaggggaaggagtaaataagaattccaaataaaataagaatagaatgaaagtttttaaacataagtattaccacaaaccagaagcaaaccttatattaagaaaatagtgactgagtgaaatagctcaggcctgtaatcccagcactttgggaggctgacgcaagaggatcacaagttagcagtagtgttggcacacaactgtaatcccagctgccttaaggaatgctgaggtggtaggattgcttgagcttaggaattagaggttgcagtgagctatgatcatgccactgcactccaacctgggtgaccgagcaagaccctgtcttgaaaaagaaaacagaaataatgaggtaatcattgttgctatcattaatatgtttgagtagcttgccgtcatcactattatttaactttgtttgacaggcttgactaatgcaagtagaaaaaacaaaataagtgttatgaatcctacactatttttgaactagaaaggaagagattaaataattatttgtaaatgatgtggtggtttgcctagaaaagctatacaaaatgaactaaaaagtatttaaactagtaagagaatttagtaaggtaactcaagttaagatacatacaaaaatcagcaataactaccagttaaaggtggaaatgggggtaggaggacctgttcacagtaacaggaaactttaaagtaactagaaaaagcctgcataaagaaaaacataaaattgttgaaggacactaaattttttggaacctagaaaaatgattataaagtttataatgcaagaatttccaaaaacatttatgaaagaacgcataattgaagatttaccttaccatttgttaaaatctattgtgaagatgttgtaataatcacagtatgataatagcacaggaataaatttaggcaaatgatagagactagaaagaggtacaggaatatttacaacctttatatgacagaagttacattataaattttggagaaattgataaattactcaataaattatataggtacaaccaatgacctgttcagaagatgagaaattaaacccttacctcacatcttaagaaaagttataggttgattagctattcaaatgtgaaaaataaatctaaaattaatagaataaaatacaggcaagagatcttcttaaatatgaatggaaactcaaaagcaataaagaggaaggaaagttgggatttatctcataacattttaaatcattcattgcacaaaagataaattagaaaaatacttataacacataaaggggaaaatggtaatatctctaaaatataagaattcctacaaatgaataagaaaaagacaaccctgtgtttttgttttgttcagagagggggttttgctggttgcccaggctgtagtgcagtggccattcacaggagcaatcataatacactacagcctcaaacggctctagcaaccctccttcctcagcctcccacatagttgggactttaggcgtgtacatcgcacctgcctaacccatgttttttaatggacagaggatgtaataaggcagttcattaaaaagatggcaaatgaccagtaaaacacagatgactagtaaataatttaggaaaactcaaaatccacttgtgcctacctatgtgagattgttagtctccaggtacctcttaactgcatggttatttatttactcttacttgttcagtgtgtatttggtcacctagtatggtggtacttacccttccataggcatgtaagcaaaggttggaaaagtgcacatcagtttgttaatagagcttactactgggatgtgggaattggtggggtgaaggtgtaagtacacctctatattgccataattgatgatactgtttaatgtagtttatctcctccctagttgatggacacttaagttgattctaatttttcagttaaaaacagcacatgtaccctaaaacttaaagtattaaaaaagaaaacagctctgataaacatacttattcatgtcttgtaaacaaacatgcaagagtttctctaggtgaggagtcagcaatctttttcttagaaggccacatagtaaatatttaggttttgtggaccatatggtctcttttgcaactactcaaccctgcctttttctttttctttttttttttttttttttgagtcagagtcttactctgtcacctaggctggagtacagtcatgcaattttgtctcactgcaacctccgcctctaaggttcaaacgattcttgtgcctcaggctcccaagtagctggaattacaggcatgtgccaccacgcctggctaatttttgtatttttagtagagacggggtttcactatgttgcccagtctggcctcgaactcctgacctcaggtgatccacctgcctcagcctcccaaaatgttgagattacaggcgtgagccaccactctcggcctcaaccgtgccttttaacaagaaagcaaccatagataatttatgaacacaaatgggcatggctgtgtttcagtaaaacttaatttataaaaacagatggcttagtaggccctagtttgctgactgttgccctagcatatatatctaaaagcataattactggtcataaggtatgagtgttttgaatgagtgtttgccaaattgctcttaaagtaatctttttagtttacattcctaatagtagtatgtgacaattcttgtttctgtatgtcttctccatcacttgtgagtcagaatttatcattaacaatcagtgggtagtgaaacattttgtcatcttaaactttgtattttcctgagctactgaagttgaatctcgaaaatatttattagattttggggttttctttctaagttacttcctcatatcccttgctcattccctactgttaaatgtcttgttttcatttgtttgagagatgttttaatatcctcttgataccaatcctttgtagataatatacatctcaattcctccccaccaaatctgttatctgtattagcctcataacaaaaataaacttttatgatagagctaaattagttatattgccagatttatacatcttttcctgtactgaagtcgtaaaggtaatcttctattagctccttaattcatcttgagtttgctattatgtatgttgtggaggcaggaatctaacttatatgtatattacttatatatgtgtgtatgtgtattatacatgcacatgatttatacatgtgtgtatatatagttatgtatagtcatacatacatatatttatgttgttaactgaatttctcattatcatgtattggataccgcactagttcctcatcgatgagtaatgtcatctcttatcacataacaagtttatatatgctggatatttctggactttcttctgttagtccactttagcttctccatgcctgcactgataccacattttttatttgctgcagttttataaatcttgatatccagttgggtgaatcgttctttgtttttaaaaatgtagtattctgccttattactcttgtcatgtaaactttaatgtcagcttctaattcagataaaagcttcatgggcttttgattagaattacattaaatttatagattaaggagaagtcagaccttcataatatttagtcttggttgaaaggatggactctggaaccagaccttctatattcaaatcccagacctgccacttagcaacaccatgatcctaggtaaattctctgcctcagttttcttgtcagtacaatacagatagtgataaactgtaaaatgtgaggattaaatgagttgatatatgtaaaagcactcagaacctggcacatagtaagcaaattattaggtattcttactaattttatatctctctattcatttaggctttattttatatccttcaataaggttttgtcaaattcttcacaggggtcttacatatcatttaaaaaagttattcctagatatgttacagtttttgttgctattataagtgagaatttctttaattatattactaaattacatttaagtgaaaagtatccagcagtcttcctgaaatattttattatatcatcgccggtttaagattctatacactgtcatattgttcgcaaataatgacagtttgtttatcctttccagtccttacagcgttttttcttttgttgtattgtgtaagaactctaatacatctttgaatggaaacaatgatagtggtcttctttttcttgtcttgactttaaagggaattcttctaaaatttcacagttaagtgtgttgtttacacagttaagtgtaccctttatcaagttaagggatttaccttctattctaatttgtggagagttatcctgaatctgtattactactgcagtttttaaaaatcacttttttctaaagtcatatcaagtccatactcctgaacagtttgttattaaatataacttcacaaatattcttgtcatatagaaaaaggaaagaaatacttagtggttaagcatcctaatccaaaaatccaaattgtgaagtgctgcagtgagcatttcctttgagcaccatgtgggtgctccaaaagtttcctgttttggagcattttgggttttggatttttgtattaggtatagggattaggaatactcaaggtgtagtggcttcttctattttcatattagaaacagaagcacaaggaatgtcatgtcagaaaccatccacctcactggacatcaagacatagacatgacctcagtatttagtgagatactggcaatatggaaatgtagtgtaaaacggagaggagtgggagatataatttcctattttcatcctctaaatattaaaaatttttatttaggcctatattgatggaagggagctaattatatagaaactgattatatagaaaaggaggaaacaatcaaatttagaaatccagtaattttatgtagcttggctatttctctaaagctaggaagtacttgccacctggttatggaaatgatcactcatctttgcaatatctttagaaaactagcaaaagtacaggtacttcttcagatggttttcatactgtgaattggacatggtaagatttgttacttaaagaatatttttttttttttctatttttttgagacagtctggctctgtctcccaggctggagggcagtggcacgatatcgctcactgcaacctccgcctcccaggctcaagccatcctccctcctcagcttcccaagtcactgggactacaggcgtatgccctcatgcctggctaatttttgtattttttgtagagacggggtttcaccatgttccctaggctggtctcaaactcctgagcttaagcagtctgcccaccttggcctcccagtgtgccgggattacaggcctgagccacggtgcctggcctgagaatatttttttaccttaagtttactactttcagaatcatgatagagactcagcttagttatattgttaaaaagaaagaaaagagggagaaaattaagatagattaatttgggactgtgagcacagcttcttgttttatttgggttttttttggggggtgggggttgtttttgtttttgttttgagacggagtctcactctcgcccaggctggagtgctgtagcatgatctcagctcactgcaacctctgcctcctgggttcgagcgattctcctgccttagcctcccgagtagctgggattacaggcacgcgtcacccatgcctggctaatttctttttgtatttttagtagagacggggtttcactgtgttggccagagtggtctcaatcttctgacctagtgatccatctgcctcggcctcctgaagtgctgggattgcaggcgtgagccaccgtgcccggcagcgaacacaacttgagttttctgttctttgtttatcataagactggatgatagcagtaaacatttttactatggtagtaagaaaagcatgaaggcattgtatttaagtaaaactagatgtgatcaaagagtaagttttataactgcatgtatttaaagctaattgccatagtacttttattatttatctgttgggggtgatatttgttccgaaatattttattgatggagaacataactgaaaaatgtttggaaatactccatctagcttctaacacacacacaccccttattgaaacagtttacttttataatataatttttgatttctcaatattaggatgtcaataactatagaattattacagaaaatggtacaacattgtcagtacttgtttttaaaacatatgtgtttgatttgtcataaactagctttatgagacatttgcaaagtctttattcataagtgagttgttttttccacttccactagtattcataaaagttaaaatgaagtctagcttaaaaaacacacacacacacacacaatatattccccacattgtttccattccatgtggttcaatctgtagttactgctttgtgaccagttgatggtctccatatagtggaaaagcaaaagctctatcctctttatgatcctagtgttggagaaaaaataatgtttagccacagttaggtacttggaaaggctgaaaaatactactaacttatgacagaagtaactttggggaagagttgggcctactgtttaaaccaggggtccccagcccccaggccacgagcaagcattaccacctgagccctgcctcctgccaccatcagtggctgcattaggagcatgaacccgcttgtgaactgcacatgtgagggatctaggttgcgggctccttatgagaatcttatctaatgcctgaggacctgaggtggagcagttttatcctgagacttcccctgccccagtcagtagacaaatttcttccacgaaaccagtccctggtgccaaaaaggttggggaccctgatatttattaaaacaaatcagatgttctttccctttactggtatactatgtttatataaatttattatattgtattaatgtctcgattaatataaaagattaaatgcaggtgtaattttctctttgttgaaatattttttgagaataaattttcacaatgtgtattgtgtcaattttcataattcatgcaacatacaatttgatatatgacttgtatttccagttttactaagcagatctagacatctgttgaataaagtccagtgtattacaaaaaattgaactgacccagggccgggcacagtggctcacgcctgtaagcccacagcactttgggaagccgaggcaggcggatcacaaggtcaggacttcgagaccagcctggccagtatggtgaaaccccatcgctactaaaaatacaaaaattagctgggcgtggtggtgcgcgcctgtagtcccagctactcgggagcctgaggcaaaagaatcacttgaacccggaaggcggaggttgcggtgagctgagattatgccactgcactccagccagggcaacagagcgagactctgtctcgaaaaaaaaagaaaaaaagaaaagaaaaattgaactgaccccaatttgttattaaagggtgaatatatttatatgtctagctttttaaatgagaatgatttgacataaccctgagcttttaagtggtagccatagtatgattatttctattaatattattaataaaaacataactaattaggtttcttgttttattttagcgaagaatagccagaattcagcaaatcgaaaaggacatacttcgtatacgacagcttttacagtcccaagcaacagaagcagaggttagtaaattgcctttcttgtttgtgggtataaaaataggtagttattctgagaaaagaaaacatgtataatttaatgtgacaccattgaaatatagatgttctttcagagaatttaaataccgtaatttttttcgtgaaattaaattatcaaagatttggactattttgattttatctaacttttaggcagttaaaatttataaaactgtaaatatagataccttactttagctgtcagtttacatataatcaaatagttaacttaatttggctactatccagtaagtaaacttttttatagataatccatagtaagaattgataatacacatttacctgtgtttactccagaaaccccattaaagtgatagtaaaaggatacaatgaaagaggcattaagaccagggaaggtgaccacagtaaaatccgtggagctggaaagcaggtaaacaagtgataacattctagcatatcagagagggttgacccataaggcagcaataggaatgaaaagtcatgaagcaactagatacctctgggtgtgagagtaaaaaagggttaaaagcaggaagatatttgaaaatctgttaagaagcagatggactttccagaacctccctacaaccctgtacagctaggtgactgctcctttccaatcccagcaaaagatgagagctttctcctctgaagaggtggagagggtaaacaaagggtctttggttaggggtcaaccttgtttaattgaacgtgagggtatcatacgaaacactgaattacatgaaaatttacctactgaatgctgaaacccccactggcatccaggcttataatctccaggcaagtttctggaaggaacttctataaggaatgtgactaaccctgattctgctgagagaacattaaaaagggagaaaaaaaatcagaagaatgtgactaacccaagaaaaaaaacttaaagagacttacatggaaaaattcacccaacaaaacaacccacctagatcaccctatagggtaatatagttgacaaaatccattcttcaggcatagagcttcatttaactttttcatagatagcccgctcttaaatatgagtggacactaactaccagacagtatagatcattctaggaaggttcaatatccaaataaaaggagttccaaaaagaaaatggagaaactggagacaggaaattagagaaataaatcaaaatttctcagaaattttaacaaggggcttagttttccaaaaaattggtctctccagtatctaacatcatgtataagaataatcctacactaagacacatcatgaggaaatttcaaatcactggggataaaaagaatattctaacaaccttctggagaaggaagagaaaacaaatttcacataaaggaacaggaatgcaaatgcctttacatttgtaaataacagcactggaaactgggaagtagggtaggcatttcttaaaacttttctttttttaagagacgtggaactaagtctcttaaaaaaaaaaaaaaggtaggatgatctagctgggttgttttgttggtgaatcctgccatgtaagtaagtctctttaaaaagtttctgtcacccaggctggagtgcagtggcgcaatctcggctcactgcaacctctgcttcctgggttcaagtgatcttcccacctcagcccccgagtagctcatgtgccaccatgcctgactaatttttgtattttttgtagagacgaggttttgccatgttgcccaggctggtctcgaactcctgagctcaagcaatctgcctgtcttggccttccaaagtgtgggattacaggcgtgagccactgcgcctgacccctgttaaaccttttaaaagaaaatatgtgcagctatgttttgaccccagttctttgacaccactgtatatcctccagttgggttcaattttgatcctaactacccagagttagagtcagctccacaagtaaaagacaaagtcagtcacaagactgtccacttcaaacgccagccacaagttttgggtgtccctaagccaccaggactgctgccaagctgtctataaattccaccccgtgtgcgtgtgctgtggtaccattccattctcacactaactacccagagttagcacagccccaacaggttaagagccgactccttcacaagactgctcccacctcagatgccagccacaaatgttgagtatctccaagccactcacatttctgcccagtgtgttacaaattccaggcttccacatccccttcacgttcagtaattcattagaatggctcacaactcactgaaagtgctatacttaggattaacagttttattataaggatacagatcaagaatggccaaatgaagagacatatggggcaaggcctaaggaaggggtgtaggaatggggatgggggtgcagagatttcatgctttctcctagtggaatctaggcatgtcactcttctagcacttcattgttttgtttttgtttttgtttgagacagagtctcgctctgtagcccaggctggagtgcagtggcgtgatcttggcacactgcaacctccgcctcctgggttcaagcgattctcctgcctcagcctccctagtagctgggattgtaggtgtctgccaccatgcctggctaatattttgtatttttagtagagatggggtttcaccatattggccaggctgggcttgaactcctgacctcatgatctgcccgcctcggcctcccaaagtgttaggattacaggcataagccaccgttcccagccttttccagcacttcagtgtattcaccaatcagaaagctgcactgagttttggtatccataatttttattgaaattttattctgtaggcatgattaattaaataattggccacatgaggattaaactcgatttccagcctccttctcttcctggaggtccgtctggcccaaagttctaactctcttatcacatggtgacagccacccatctttttgctatctggtggcctaccctgagttgcctcattagcataacacacacccctatcactcgagaaattccaagggtatttgaagctctctcaggtacaaatgaacaaagaccagctatattttttattataccattctagcctttaatcaaagtgttaaatttgagagtggaataaagacacttttagataggcaaagtgtcaaatacgtttttctcatgcacccttttctggaacctattaaaggatatactcaagtgaaatcgaaatgtaaagcaagaaaaatgaattttttcaactcaagacccaggggatataatacaagagaaagagatgagtgaaactacagagtaaagatgaagggacatcctgagataaatggtaaagaaagcaaccagtccatattgaaactattgagaggattccaggagagattaagtccaagaagatgaaatcagcagaatacctgcggtttctgaatgtattgaagggaaaggaaatttacacagtaggagagaagctgagcatcagtcatatgtacccagaaacccaaatgaacaaaaaataaagataacctttaactccatggacaacaggaagttgtaaaggaaggtgattatagtataccatctgccagctatgattagaatttcatagtcaaagtaatgtaaatagtggaaaatttgtgtaacaataaagtggaactgaaatgaagcattcaactgaaaaatgcagaactagccattgaagcaggttatttggagatcggagggggtgagtatccccccttccccaaaaactcagctgaaagagattagaaagaaagagttctttcaaaaaacattttcatccatgtctggcttttttaatatctgaggaactttggatttagtacatctgaatctgaaatatgtagaaacttatttgctaagtagacagtttaagtacaatgtgatagtcataatcctaaaagcagtttaacatgactgtcttaagcaaatataagtcaaatatttgcaatttaaagaatgtgttcatttttgcaatggactctttttttacctggcccttggaaagggccaggaaaaaaagcagtatttttttgctccttttcagttctgttggtattgatgtatgtagcattctacttattatgacctttttggctttctactgaagtttttatgtgtctttcatccttaagcaaatttgttttggtctattttttaaattatttttaaataggcagtgttttgtttttaattgaatagctttagttacagttagttctttcccccccatctttcttgtattctgattattactgttttgctgcatctaacaggttttgatatttctaaatcaatagtcacatttttttctagttgattgaatcttttatttatgtaatataaaatagccctctattttatttaatgctgttcaccttcaatttcattgtagtaccatttattaatagtaatcctcattttccagtactgttacaagtttcaggttggaaacttgtttgtgtttcttgtatctgttcaaaactttttattcatattattggatttagggcagactgtctgctactatgatccaacctcttattgcttccttttgttatgataatagttacatcagttgcattattctgatagtttgtaaatgtaagccaaaggaaggtgccatttcacatttaagaaagaacaaaaccactttttacaattttgccgtttgtggtttgtttattgcattattttattcttctaatgtaagttagagggagaagctagaagatggagaaaattggggattggacacttgcaaattagttcatagagcagtagatatgagaaagggaaaagcttctgccaaataatttctctatcatgaagcatatttcttatagcattttctttggctacctgtattataactctggtttaaggtctagatgctggacgtgatttaagtctactaattattacacatgattcaaaactcagaagttacataaaggtatgtgaggcaaccagtgctgtgactttcttgtgtgttcttccagacatagtttatttattaacaagcaagtacattgggtggaatgggagctgtgaggacaatgcagtgtgtcttaaaagataatagcaaatgaagaatacttactaaagtcacagtattcttgcaactcattaataaagataaatacaactcaccttttaagtgggcaaaagatttaaataggcatttcaccacagaaggtatatataggaatggcaaataagtacatgaaaatatgctcaatcattaaggaaatgcaaatcaaagcccaagtgagatactgcttcacacccattatgatggctttaatcataaaggcaataataagcattgacgaagatgtggagaagcaggatccctcattgctggtgggaatttaaatagtacagccaccattttaaaacagttgagtgattcctcaaaatattaaacatatagttatgtgactcagcaatcttactcctaggtatctggccaagagaaatgaaaatatatgtgtacacaaagacttagacttgtatgttcattcactagcagcattttttcataatagcctcaaaggagaagcagtgcaaatgtgtatcaactagtgaataaataaacaaaatttgttatatcccttcagtggaatattattcagcaattaaaagtaagttactgatgcagaatttataacatggatgaacctccagaacatgctaagtaaaataagccagagatataagtccatttatatcaaatgtccagaaaaggcaaaatttctaaagacaaaaagtacattagtggttgtctgactgtaagtggaaatgaggattaactgtaaatggacagcaggaattttattggaatgatgaaaatgttctaaaactggattacagctgtgcttgataaatctaaaagtcatttaattgaacacttaaaatggatggattttgtgatatttaaatacctcaccaaaattttttttcaagttctatcacctagagtagaaaaccttggagaagttgtaaagcaactatggaaatgaggaaactagttagaattaatctttcataatagtgaacaaccacttcttttgtcttcagtgtatcgaagcgtgcaggcaggcctgtagcctaggatcagtgaaagaataaaaaaaagtaattaggaaagaggagggaggaaagaaaatgaagatagtaaatgttaaatggtagtttgggttggaattgcctgggttggaattccagctctgactctgccatttactagatatgtgactgaaaacaagttacttatattctctgtgcctccatctctttatctataaaatggggataatggccgggcactgtggctcatgcctgtaatcccagcactttgggaaactgaggtgggcagatcacctgaggtcaggagttcaagaccaacctaaccaacatggtgaaaccctgtctctactaaaaatacaaaacataaccagcatggtggtgggcgcctgtaatcccagctacttgggaggctgaggcatgagaatcgtttgagccgagattgcgccattgcactccagcctgggtgacagggcgagactctgtctcaaaaaaaaaaaaaaaaaaaaaggcactttaatattactcaacatattcaaaacataattaatgatctgttcctcctaagccctctttactaccccaccttgcagcaaaaaaccttcatcctccctcagtattacctatctctgtgaggagtagcaccatcattattgaattgtgtgagctaaggaatgtaggagtaatactccacaccagacctcttcctccactccccatatcctgtcagcgaacccgatcagatttacctctatgtctccacttcttttatctctgtcactgcttccctagtgcatagtgccactgtctcacacttatattaatacattagcctcctaactggtctttcctatgtttcctccctacttagaccatttaaaatttgacttaaaaaataaaatttacttgcaactttatccattaatatattagtattaattatgtgggggcaatcatgcagtggcctcactgtaacttgcaagtagaaaaggcaagaatgccatctaagaatcgcagaaaaaggcattaaaatttaaatttttttatcatattctttttgttctactttcctccttatttttggtgcttcatccacaccatgattcgttgacacgctaaaacaagccacactccctcctaccctgggtcctctgcatgtgatctgttttacccagaacactcatcctctactcctcccctttgcctagttaactcctatttactcttcaagtctttactcaaacagcacttcccaagagagctcttccaaacctccagagtatatcatatctctctgttatatatatttacagcaccttgtacccttctttcatggcatttgtcaattttacctttattatttctgtcattatttgacagtgtccctgactaaactgtaaggtccaagagagcatagaacaatgtctagttttgctagcactgtattccccagcatctattgcaagtaactaacatagtagatggtcagtaattttctttaaatatgttgacatcttcacttacgttagtgtcaaatctttgtggtcttagattcattttgtctctaggttgactttatgtatgtatatctattcttgtggattccattaaattctatagcatgattttcagatggtactaattattcttatatttctggattactgagtgctacctcacttttgccagcatataactgatactagtttattgatggaaatgttgcatataaattaaatttttaagtcacattttttaaatgatctaggaaagcttgatgtttaaagaaattacgttaggaatcattttgtaatttaattatccactgttaggtcagatttttaatgtataatttttattttagatatttttttcctagaacaagcatataggtgtttctataaatgaccgtgagaaattcttttatttctttaattttgtggtggtatttttataaagtgactgctttgtgctagggataatctatcttgaaatgactgcttttactggatgtaatctgtcattttaatttcctgttaacagatggtggttgcattagaaaaggctttgggttttattcatatcagaagctaagagcctatcattttatttcacctaacttttattagaagatatacatatatatatatatattctatgtgaaaatatacctaagtagaagatatttgtaagcttaggtaatagtttaactgttgtatttgcagctccattaaatgtcagaatcatgtgtccttgcagaaaagatagttatttgttctacttgggttatgttcctgatagtaatgtgagcgcagctggtagaggatggcattcctgtgagtctcagaaaatcctttgtctcgtgcagctctaatgctcaagggacacacttcactttccccttaccgagatagtcgaccgccaatcgtactggaggttatgaagtgtaatacacagttccatgcctttatcagtctgtataattgatgcattcagagctttaaagcaaaaaaagaaaaaaagccttgggctaagaaagcctacaccatttttgcatgtactgatgttaactccatcttaacagaggtcatctcagaacaagcatgaaaccggctcacatgatgctgagcggcagaatgaaggtcaaggagtgggagaaatcaacatggcaacttctggtaatggtcaggtaaataaattattttatcatattttttaaaattatttaaatatcagaaaagtatgaagcaagatggttctaagaatgatctataaatcttacctattttcttagtcctgaatgcatatttccagaagcattcagtaccaatgtgctgtcatttctctttattatatcagcaataatgctgtaaggattttctagatctatttctatagctatagattgtgtgtttatgttttagtctaaaatgattgtgagtagttttttttaataactctaagctgcattttgattatgtatatgatttgacctagttatttttgcttgccttgaataggtttgctctttcactaagaccttcaatgtaaagacatttttatggttttttttaaagttataaaggctttatttcctgttgtacttaaagattatataaatctagaaatccaagtcttactgaaaaagataattgtaatgcacacaaaaaagtaaggcaacatggcctaattatgcttaatattaccacatcattttcagcaaaattatgaaagtaaactttttttttttacatacagaactgttatttgttatgctaccatccgttatcttattagatttttattgaaatacagtgcaataggacagaatttttctttagggtgttctgtattctccaaattttcttcaatgaatatttttagagtgtaaatgaatgactttttaaaaacagaatttcactaaattgttcttaaaggtaatttttctactgttgatacagaaaattttcttagtctctctaggttacttttgatagtattgtttttaagaatatgcttctattagttcattaaaatgtaaagcttaaaatgtcttattaagtatttaaatttattttactgagttaaaacaaacatacttcattcagtattactagttagcattatattggaaaacaagtggtaaattaggacaaaggcaatcatgtttaaacagcacatttgagttatgtatctgtcttttgtttagggaattagttgcaacatttatatattcctacacatatgtagaaggaagaaaaatttaatcctatatgacagaaaaaaatatttacataggaatagatctactcgtagtgctttgggtcatcttccaattattatgtactttggaaaccttacctatccagtaagctggctatgataaattggatccatattacacttactacatcaaaataaattctaagtagattagatttaatgtcaaaatgaaaatcattaaaaatataaaaagattagaagaaaatgtgggtagcgtttttataatcatgatgtaggtgggagacccataaagaaaggattgatagatttcacgttacagcatgagacttcagtatgccaggaaatcatagcgagattccaaaacaaacaaccaagatcacattatttgcaaacatttatgacgtgtaaaaagttaaaattcaagatgcaaaaaacagtatttatataccagctatttaaagagtatcttaaaatggttccaagccatcgtagaagtaaaaaaataaataataattttaaaaataaaattaaaatgggcaaaggatatgaacaggaaataaaagaagaaattaaaatgacttgtaaacatggaaagatggtcaactttactaatcatgatatataaatacaaattaaaactaaagtcagatttcgtgggggggccatttagttggcaaaaatcaataacactcagtaatggtgagcaaacaggcattctcatatgttgcttttaattgtatgacatgaaacaggctttctggagagcaattttgtcaaatgcatctagcattatttataatgtgcctgttgtgaagctcatcactacaacatctaagattttttgctaatgagataatcagtcaagagtgatcagacatgtttgaagagattcatcataatactaacaatagcaaaaagttagaaataacctaaatggacattgatcgtaaaatggttaaattattagtcagctgtagattagttaagtggctctggagtcaacaaacctgggaaatcacactccctcactaactagcttagtaacaaaaagtctctgagctttagtgtttcctctttagtaaaataagatgatgataaaacctctacctcatagaacagttgggagagttaaatgcaagatacccttaacacagtccctggcatattgtcagagcttagtaaaaggtaaccgattctgttgttaacaagtgttaataattatctttaaattaacaaatatgccagatactgtgttggactctagaattgataattgaaaaggacagacagtccttggcctcatggaacctatatggtgcatccatgcaaatattaaaaatgataaattacatctctatttatgtaaagatctaatttttagccttcaattgttgccttttctagtatatccttcatattataatcagttattcttctaaaacatgaatctgattatatcacttatttgtttaaacctttcagtggctactcacctcccatatattagaatccagattcttcatgttgcttactcttccaagagtatctcacaatatttgcccacatttctcaccactccctcaacttcaacttcttcagttccttgagtatgtccaggccttccacaggacattcctttggtctaaaactgtcttctgcttcagttcatattatatgttttactcatccttccccaccgtttaaatgtcacttcttcctggacattttccttgtctccacctacctggaataaataaagtactctttgatacgctgtattcctgctctcatagtgcttagcacaatttatcattggtttaattgtcttccttccttcttaaagtcctttaagccacacctgctcctcactgtatgccagccaactaatatgtacctggcagagagcatttatgttgaatattaataaatattattgacttaggtaattataactttttttttggagacagagtctcgctctgtcagcaggctggagtgcaatggtgggatctcagctcactataacctccacctcctaggttcaagcaattctgcctcagcctcccgagtagctgggactacaggtgtgtgccaccacaccaagctaatttttgtatttttagtagatacagggtctcattgtgttggccaggatagtctcaatctcttgacctcgtgatcctcccgcctcggcctcccaaattgctgggataacaggcgtgagccactgcgcccggccaattacaacttttttaatttaaaaatagcaagtatgctgggcatggtggctcacacctataatcccaacacttagggaggccaagcgggaaggattgcttcagggtagaagttcgagttcaacctgggcaacatagggagactttgcctctgcaaaaaaaaataaaaattagccgtgtgtggtagtcccagctacttgggaggccgtgtgggaggatcacttgagcctgggaggtcaaggctgcagtgggctatgatcatgccactgcattccagcctgggtaacaaggcaaaaaatattttttttaatttttattttttgtctaaaaaataaaaaaaaaaacttaaaagcaagtaagtatgatctcattatacatatgtataatgtgtgtatatgcatagagaaatgtgtgggagaatgttctttaaactgttatcaatagttatctctgagtgttgggatttttgtgggttttacttattcttttgtgtgtcgttttattttttgtaatgaacatgtattactataatttataacacccaaaacccattttcattttgggaaaatagaagaaagcactgtcttgatttccgttgtatggtagtttaggttgccatacttcagagtcctaccatgacatacatcatgtcatttatgtcagtatagggatggcagaggaaaagatctattgaaaatagtaaatcagggcccggtattcattcctcctttaagtgatgaactctgatagtgctgtgaattcagaggtaaacataagtatgtttgtttagcagtagcaatcatagacttgcccaccatattggtgtttgtatgacactaatgctgctaatactatctggttactttcagtcactgttttaaaacaatattgcagctattcccagatcctgatgtagatgtgtgacctgtatctgtgggactgtgatttgttattccaaaagtcctttcatctaaataggatctatacacatgatcgcctcttggggtttattagtttgttttgttttattatttgctcaaaagacaaaagccaccaacactagttgaaaatgaaaatcagtctctgactttctcaggatcacagtagcatgctctgccaaagttctgtcctagagtaattctcttcaccaccacgtgggaatgtattctaccgcttctctcacctggtttcctgcccacaatcattctctttgaaaaatccttcattggcttcccttgattcttagaaaaatgataaccatttattgtgacccaggtaacctggcccctacctatcttgtcagctttatgtcacatcttgctctcacacctccacactggccttctctcagtacctcatatttactgggccttctcctaccacagcctgtgcacatctatacctgttccatgtagtgtttgtttcatcccattttgctcagttaacaccagttcatgtgtgtctgagcttaagcaccagtttctcagagaggctcgaacagatcaaatctcactaccataggctgtcacagcatgttcctctcgtttgaagactactacatttgcagttttacattaatttgtgtgatgacttgattaatatttgtgtttcccccactagactgtaagctccagaaaggcagggattctatctagttttgttattttcatacccacacagtccctgataaatagtagataacaataaatatgtggtgtgtgtaatatccctgctaaagaaagggtttcttgatctgtttttaatctctcatggaagttaaatggaaggaaaagcttaggagtaaattatacaggccagatccctgcttgcttagcatataactatgtgtataatttatttattagttggttctcaactttatttatttatttatttatttatttatttatttatttattgagatagggtctcactctgtcactgtacaccactgcacagtggtgcaatctcggctcattgcaacctctgcctcccaggctcaagccattcttccactgtcattcttggatagttgggaccacaggtgcacaccactgtgcctggctaattttttaatttttttatagagataggatctcactatattgtccaggctggttttgaattcccaagctcaagcaatcctccagcattggcctcccaaagtgctacgattggctgggcatggtgctcacacatgtaatcccagcactttgggaggctgagatgagtggatcacttgaggtcaggagttcgagaccagcctggccaacatggtgaaaccccatctctactaaaaatacaaaaattagccaggcatggtggcgtgcatctgtaatcccagctacttgggaggctgaggcaggaaaatctcttgaacctaggaggctgaggttgcagtgagttgagattgtaccactgcactctagcctgggtgacagagcaagactctatctcaaggaaaaaaaaaaaaaaaacgtaaaaccaaagtgctggaactacaggcgtgcaccaccatgcccagcctgtggaaagtgttgaccaaatatcttctgtatatcagagtgtttctatggcaattacagtttgacagtttactgtggtaattgtattttagggagttctgggtttttgtaatttgttatttggggaatttaagaaattagtttttccagtaccctttattctttttatacgttacattgttacttgtgaatcagccatatataatttttatataaacaatatttttatactatacaacttactcttgtcatttaataatactttgagatatcttttcctatctatatgtggtttatagatatggaagtttttaatccatttttctttcactattttttctttttttcaagcaacctaagcttttctatttgaaatttagaaccaggtctctggtaatagccagtatataataataaagctcaattaaaagtgggaaaaagatggaatgatagaaaaacccactctactgccactggtttttaaaactttttcttatggaaaattttaaacatttacaaagacaataatgtagtgattcatatcgacatgtaacctattcaccttaacctcccattttattttttaagaagattccaggcatcatcatcacttcttccctgtttcactgtgtatttacaaaagataaaagtacttattaaaaatacataactggccaggtgtggtggctcacacctgtaatctcagcatttccagaggccggggtgagcggatcacttgaggtcaggagttcaagaccagcctggccaacatggtgaaaccctgtctctactgaaaatacaaaaattagccagatgtggtggcgcacacgtgtagtcccagctactcgggaagctgaggcaggagaatcacttgaatccaggaggcagaggttgcagggagccgagatcgcaccactgcactccaccctgggcaagagagcgagactctgcctcaaaaaaataaaaaaattaaaaaataaataactgcagtggcattattacatctccaaagactctaacagtaattgtttaatagcatcatttatccagtcagtattcaaacttgcagttgtttcataaatgtctttttcacagtttatttgcctcagggtccagataaggtccatgaataggaattagtatatctctgatatctgttctaatctgtatgttccttctttttgttttacggccatttagttattgaagaactaaagttgtttttcttttttctttatggttttctggggttttgtttttgtttttgtttttttagtcaggatctcactctcgcctggactagagtgcagtggcaaagctcactgcagccttgaactcctgggcttaagcgatcctctcgagtagctggtgctataggcactcaccaccatgccctaggcctccctctgttccccaggctggtcttgaactcaaactgatctcaagcagtcctcctgcctcagcctcctgagttgctgggattacaggtttgagccatcatgcctggcttccaaatgttttttttatagagtgtcccatactctagattttgctgatgactccccatgatatacttcaacatgtttctttatcatctgtatgtcctataaattggtagatttcagtatctgagaatattcaagaagtagaatcagtcaagcttagggattggatatgagtgtttagggggaaggagaagtcgagaattactcgcaggtttctgttaggcagctagaagggtagtgatgcaatttagtaataatgctagatgagaaggaggtttgtgagagaaaataatgagtctagttttggaaaaatgttaagtttaactttaaagatgttaggtctgagacatcaaagcagaaatgcacctgggtgcagtagctcatgcctgtaatcccagcactttgggaagcaaaggcaggtggatcacttgaacccaagagtttgagaccagtctcagcaacataaggagaccctgtctctacaaaaaatacaaaaaaaaaaaaaaattaggcgtggtggcatgtgcctgaggtcccagctacttgggaggttgaggtggctgaccctggaaggtcaagactgcagtaagctgaaatcatggcactgtactccagcctaggcaacagagtgagaccctgtctcaaaaaaataaaataaacacacaaagtagaaatgtgaggtaggctattagatttggaattgagaggaaaggtaaagaattggtaattaaaggtattaaagatttttacatccccaatgagtatacagtgagaagatgaatacctagcctaaaattccaaagcagtagaataatattgttacaacaaagagggaacagttaacagtttccaccattgccatgaggactaaaaaatcaccttgggtttcaccaaaaaaaaaaaaaaaaaagttcattgctgatcttgtcaaatgcaattccttgggccttctttcctactatattatattggagtgagttgaagttaaatggaaggttaaaaagtagaagagagcagtcaggcgtgatggctcacgcctgtaatccagcactttgggaggccgagatgggcggatcacgaggtcaggagcttaagaccatcctggccttggtgaaaccctgtctctactaaaaatacaaaaattagctgggcgtggcagcgcgtgcctgtaatcccagctactcgggaggctgaggcaggagaatcgcttgaacccaggagggagaggttgcagtgagctgagatccttccactgcactccagcctggtgacagagcaagactccgtctcaaaaaaaaaagtagaagagagcaattttagctaactgtaaagatgtctagatgtgaactgcccaagagagaaaagatcgttaactgatacagactataagtttgagagaaaatttatttctgtttttaagatagaaaagatgaggatgtttgaatgctgatgggaaggagccagtagagaagagagttgaagatccctaagatcaaagagaaatggagagagaaaggatccagagcacatctaaagggatggaccttagataggaggaggggaactctgatgtcacagcaaaaggtggcgatggatatatacgcaggtaattttaaggttctggttagcaagaagttgaggaaattttgtctgttggctattttttctataaagtagaaggtaaagttatatgcagtaagagaagaagagccacagttttatatgatacaaaatgaggcatatcaaaaatagccaaagaaaggagagctgacaagggaaacaaaaagatggcagttatagcacggagagtctaggtgtattggtgaccataaatgtatatcgacagcatcctaaagagttacgtaagtttctcacatgctcaaatttctctaatgctgcctggcacttcatgtcagggtgtagagaaaacagacagttggattcatctgtgattgcaatgtttccagacaaatggggtggaataagtgcagggcaaagctgttaaaagctagcaagagaattatgaaagtgataaccacaagaaatccaacctgaaatacatgctggatttgctagtcatttcaaggaagcagtatcttacttgcggtcaggagtttgagaccagcctggccaacatggtgaaaccctgtctctactaaaaatacaaaacttagccaggagtggtggcacatgcctgtaatcccagctactctggaggctgaagcaggagaatcacttgaacctgggagccagagttggtagtgagctgagatcacgccactgcactccagcctgggcaacacagcaaaactccatctcacacacacacacacaaaaaaagaaccaacatcttagagaaagttgaagaccaggaaataaaaggagcatgaagtaaaatgttgaggatgtatggatatttataaagcattgaatgtggatggtacaggaaagttggataggaaaaaggacagtgggaaatagtgtctcacacatttggacactgagtgtcaggaatgatacagcgagtgcttctatctttggacaatgagcaaagctgattcaagggatgtgcaatcatgactgacttagcaggtcttgaggttgtgagaaagttcatcacactcaagtttattcagaatttagttttgagttgggtgggaaacaattcttaggaagttattaatcatttcttgtggatagggagactctagtccctccgaaagaagttggctcaggtctagccttaataaaacgcccaagaaagactctcatggaccaagttctaggctcatagagaatacgagtatgtgtacctcttggtatctcctaataataaatacatctaaatttctactgagacagattggtgaatgaagagtgtctcaaaatccaggagctatataggaagataactaagactgaagcttagaaaagatttgttgtctacactgaaatgaatgtcagaaacatgttttattgtggaaacaggttttcccttgtttcataattaaacctcctgttttcttttgtttcaagtagtacattagttagctattgctgcataacaaattgcccccaaaacttaacagcattagtagacatttatatttgcttctatggatcagaaatcctggtgcagctgagctgcctgtctctggttcagggtctcccacaagacttaagggtattggctggggttgcagtcatctccacacataaccaggggaggatctgcttctaagttcacttacggctattgaaggcctcagatcctcattggatgtcagccagagagacatcagttccttgttacatgggcctcaccaagggcagttcacagcatagtaacgcttccctcagagggaacaagagaggtgcccaagatggaagacacgtctttgtaaccttatcttgagagtgcttctcatcacctctatagcattttattcactagaagcaagtcactaaatctagccaagactaaaggggaagggattacaaaaacgcgtgaataccaggaggcaaagatctatcttagaggctacctacaaacagtaaaaatatttagacatcttccaagattgtgtgtttgcttcagggtaaagactcatttcccttctatagaccaagaaaaaggttccttgtctgaatttactaaaaaagccccaactatcctccttagcctgagtctcagtccctcagatctatcctttattagttagaaccagagtaagctccttatgttcagatttatttgtagttctgcctccccttcctctccacacacacacaaacacaactataccatattcttctgacccttgcttatgcctctgcctttgcctgggctgccctgtggctaatccccctcattctttttattaactaaattactcctcatggttcaagtccaaattcagatgccactttttcaggaaccaagactgaattgtgtatcttcctgtgtgttcatatagtttctgtcaaagcacttacccacacgtattttcatgttcagctcctcatctagattgtgtgtgtagtgtgggtgagaatgtcttattcatttatattcctggtgactaatatactacctggaaagtagcaggggctcaggcaatatttgttgcttggttgcatgtggatttaaagaccattccagaagcagtcaatagctggtggcagtggaaagagatgtaagatgagtctttccttgatgcctcttttcccttccctaaggaggattactaattagttttgtcctagaagtgtccctagtcagcataaagagtccagacccacaaaggaagtagagactggaaaggggagccactctggactctgaactagtattctcagtccaaccccagacttccctatgcgagtatgaataagtggattatcttgcctttatatggggacacattttttaaaacctctcaagttaggattttttaaagatcacttttattgaagaaagattagtatgtgataaaatgtacccattttaagtgtacagttgaatgagttttgacaaatgtagttttctctttaaaatgctgatctaaaatagctaattattgtgaacgatgatctaaaatagttttgtgcactagtcaggaaaacctcaccttggcttataacatgacttatacagaagttctaagcagccctcataaaaattaactttggagtattacctatttaaggactttatgaaacaaatttataacaaatttgaacaaggaatttattacgaattcagaaatctctgtatgagcccttaattattgcttgattaaaatcctgacgaatcacttaggaatacattgttaacagttttctatgttgtctaccaaagtggaagttatctggcaaacagtttacgttgctagctaacagggaagaaaagtttctaatacgtcaccatagctgggctcattggctcgtgcctgtagtcccggctactctggaggctgaggtgagaggatcacttgagccaaagaattcagagccagcctgggcaacatagtgaaaccttgtctctaaaaaaaaaaaaagaaaaaagaaaaaaaaatcaccaaaagtgaaatttatgcacaaaaggaagttataaggtgtgttggttccagaattctccccttgtaccctctagagtaggaggtgccatctcacagtcctcaaaacctattactcccattgtggttttctctttaccttcttcaattagccagagcctgtatatctgaaagacaattcgaatgatgtcctgcatcttgacattcttacggattttactaatagctcctcatttatttataattcaacaaatattctgtggatacctactaagcttaagaccacccttggtactaagaatgcagcagcgaacagaataaagtttctgtcctcaaataacttacattttagctttccattctgcaaggttgagaactgcaaaagaatgcctgcaaatattgctgacactattcttacagtcatttccttaattattaatgaatggatttagctgtggcctatattttgataggtcccagttatttatctgcaaccccacctcctgtccagagttgcatcctttgttttcaggtgcccattggggattcttactggatgtcagattcaaagtgagctcagttcccccaatgaaagccatcatttatttctgggtttccgatatccattacgagcatcattacttacccatttatccaagcttgacacctccaagttgtcctcgactcccagcccctctttactcacatccagtcaagttactcaagccagttaatttgaccttcagttcaagccaattaatttgaatatccttcaagagcatccccacttctctattctcactgccttagtttgtgccctcagaaccactcaactgctgaaaataccctctccctcatttcctacctgtgatctctccgtgctgtttttaagacgtaattctgattgtaccattctcctgcctgaagtccagtgactccacagcttgacagcaacatctttgaaatgacatgagatacttaatgatttaacccaacctttatctctaaccatacaccttgtgttctgtccacattacattggaacactccacgctctccgtatttgtacctttgcacagtctcctccgtcagtctcctgtcacaaaatgcctaccttaaatgttactgattttatacagcctctaatagtccctatgcagtaatttctttcttcctgttttccctcagtgttttgttcattcttctactgcggtgtttatattatactgcactgcagtcatttattttttcatgtctttgtccagtaaaagttttaaacagccctttctaaactgtgagatcttagagaacttggactgtagcaaattcatacttagttttctggcaatttggagcatttcagaatttgaacattccttcaatgcttttcatcaatgaacttatctgaatgtggttttatttatttagatctatgaaaaattactaccctagaatttcttcagtctttggttaagtccattctgcagtttaatgctcatatgcaagaaactctcttttctttagtttttctctaaaacatacttagtaagcgtataggtaaaaaatattttgaacagttataatggtcatacttttatgatgtatttaattgtttatcatacagacacttcatttggagtaccttaacatgatgttatctgtatttacctatagtctaaattataccatctataatgtgcttaatttttagggttcaactacacgaatggaccatgaaacagccagtgttttgagttctagtagcacacactctgcacctcgaaggctgacaagtcatctgggaaccaaggtaacagaagattacaaaccctggtcactaatgccatgactactttgctaagacattcttggccaggtgcagtggctcacacctgtaatcccagcattttgggaggccaaggcaggtggatcacttgaggccaggagttcaagaccagcctgggcaacgtggcaaaaccccatctctactaaaaatacaaaaatttagccagtgtggtggcacacacctgtggtcccagctactcaggaggctgaggcatgagaatagttggaacccaggaggcagaggttgcagtgagctgagattacaccgctttctagtggagaattctgattcacagtctcttgaagaaattacatatttttatacaacgaagcataaacaagggaaaaatcaggtttataaaaagtgccagattagctaatttttaattctttttcagtctttacatccacttttctgcaagaatactgagttccagccaaactggctcacttcctgcttcctgaacattccctgtgactttccccctcccttccttgcctgcattggtggggaccaccataaatgtctgtcagaatcctagccagccttcaaaactcttcttgggctttgctttttcacaaaacattttctgattcccaaggtcctcttacctccccatgtgatccatctgcctcatttgaatcactaacaatttgcatgaacctgtcttttggaaatcaagaaatgtttttttacttatcttttgctgtgtctaacagagtgcctgcacatgagtaaatatgtattgaggtgaatggaaaaattgttgaagttgagtgttatttcatgctgataagtgagctttcttagagtatctttcttagatgttagcaaatattttaggatttgggaataatgtttgaaaagaaaatagttactttaagccggatgtggtggctcacacctgtaatcccagaaatttgggaggctgaggtgggtggatcacttgaggccaggagttcgaaaccagcctgaccaacatggtgaaaccccgtctctactaaaaatacaaaattagccaggcatggtggcacatggctgtaatcccagctactcgggaggctgaggcaggagaattgtttgaacctgggaggcggaggttgcagtgagctgagattgtgccattgcactccagcctgggcaacaagagcaaaactccatttcaaaagaaaaaaaaaagaggaaaatatagttactttattattttaaagtcagagatttgattttatttttattttatttatttatttattttttgagatggagtcttgctctgttgcccaggctgtagtgcagtggcacgatcttggctcactgcaacccccacctccagggtttaagtgattctcctgcctcagcctcccaagtagctgggattacaggtgcgtgccaccatgcccggctaattttttgtatttttagtagagatggggttttgccatgttggccaggctggtctcgaactcctgatctcaggtgatgcgctcatctctgcctcccaaagtgctgggattagaggcatgagtgaccacacccggcccatcagagattttaatattcactaagatgaaatgaaattctaatattactaaacgatgtattttcgattaactcgaattccattaattgttttcacagcatactctgtatactctttctttactgtaaataatataatagctcttgggaaaggtattactgaaataactaatgttgatttaagtaatgattttagaataatcaatgatattctcactatgaggcttaatcctgtttatacttcttgggacctcatatgccattcactgtgccaggagttgtatgtaccttatctctggtcctctccaaaattctatgaagtatccatatttctctaaatgagaaaactgaagcaaaaaaaattttaggcatggaaatttaattccagatctgtctaacctcaacatgtagtttttactataaagaaaatcttgaatattcaagagtaatattgtgtgaaaactggcaattagaatactgtttctttttgaagtaatttatgcatgataatattaagaccctagtatgtattttgaatgctagctactgtcctatacatgtattattttatttcaccttaatggagaaaaccttgttaggtaggtaaatttctccattttgcagctcagaaaactgaggctcagagaaatcaaatagcttaactataatagtatcacagcttgctcctaagaggtggagccaaaatttgaacctagctccgatgaaaacccatttatccgcagtcctatactgccttcctaaaactttcatatctaaaggtgtatgtgtatttacgcatctaaagcagcatttctaaacctcagcactattggctggataattctttgttgcattctagaatgtatagtaacgtccctggtctctccccactagattcccctaaaatacccatcctacaattgtgacaaccaaaaatgtctccaagatgttgtcaaatgtgtcccgatgggggcaaaattgcccccagttgagaaccattgacttatagagaatgatgcattctttatataatagcctctacttttatataataccctctagcgttaaaatgagtggaccatggcccaggataactgggtgccactttccggtttctaatctgcttctaactaaatacgtagaatttattgtcagagagtaattagtacttaccagttgctttttaaaaaactgactacaaatcctggctctcactctgtatgatcatggcattttcctttttatgacaaaatgtttttaaatttataatcgtataattttaataatattatcatctgacgagaattaatgattgctgagaattagtacttaaaattgttgcagaaatgttttctgtttattgcttataggtatagattaaaagaaataagataaagttttaaattatgtaaagatttagataaactacattctctatgtgtgtgaaatccgttgtttttcactgattatagtcagtggattagcaccaacttatctaggcaaacagcactaacagtttgttagtgagtatgcaaaaacctacttttgcttttaatactgtatattaccactcatactatttactcacataaacaaattggtgatgatacatagattttgaaataacactgattacttcatcctggaaaggttttccggttttttgttttttttttggcggggggggttgttttgtttttttagagttatagtaaatatcccattcatcacttaattggtttttggcttttggatattaaagtcgtaattttgtttctaaactcatttggcccacaggtggaaatggtgtattcattgttgtcaatgcttggtactcatgataaggatgatatgtcgcgaactttgctagctatgtctagctcccaagacagctgtatatccatgcgacagtctggatgtcttcctctcctcatccagcttttacatggcaatgacaaagactctgtattgttgggaaattcccggggcagtaaagaggctcgggccagggccagtgcagcactccacaacatcattcactcacagcctgatgacaagagaggcaggcgtgaaatccgagtccttcatcttttggaacagatacgcgcttactgtgaaacctgttgggagtggcaggaagctcatgaaccaggcatggaccaggacaaaaatccaagtatgttctctatagtgtacatcgtagtgcatgtttcaaagcaaatgtgaaatttttaaacagaaaacatgtttagttaatatgctgtctttatgactaagaggagaaaattcatatcagccatttgtgctactcatatttaaaagattaagtctgtatttccctagaaaaatttagcaaaggaaaatgttatgtgcactactataagaacagtaagtcaagagaaatttatacaatcatagcatagtagggccttagtagagctagaaagaacttgagcaattatgttgcccatctttcacttcatagctgaagctcatttcatagatgaaagtgactttacgtaagttcctatagccattagtgtccaaaccataatcttttacatttgcatatcattatattcaggggatacagagcagcgttacatctgttatgttatttgctcctcacatcaacctactgaagtaggaagggaaggtattatcatctccattttacagatgaaaaaactgaggctcagaagagctaaaggacttaaccatggcctcacacctagtaagtggtagacccaggaacagagcccagatctcctgactctcagctcggtgctcttcctactgtaccatccagctgtagacagtgggcctcagttgctgggagtgataatccacccagctcttcactcaggaagggacccttagacctcagccccactcccgcaggagcagcatgggagttaggacctatggggatataacttatttcattcctgtagccaagaaccaaaagcagtaagtatgtaaggtaagaccttcctttcacctgataagaactgacacacacacacacacacacacacacacacacacgtgcactacaagtagatgattctactgtatcagcctattgatgtgaagaggagatgatacaaacatgacttatgaacctatagcagatttttttaagcttaggtatgaaggtgaatttatttgaaatctaaaaatgttcaaggataagaaaggccaggtgtggtggttcatgcctgtaatggcagcactttgggaggctgagacaggaggattgcttaagcccaggagttaaagaccagctgggcagcacagtgagacactatctcatttttaaaaaatttaaaaagcataagaaaaaagggattgcctttcatatctatttgtcctggggtgaggggaactagtaagattttactgggagaacattgccttcctggattgtttctttggctatccacagttacgtaatgacccacattttgtactcctgatatttgttctcaaaaaattaaatagaataaaatgatacttcttttgagaagttttttaaaaacttacgtcaaatgagttttgaaacctcgtgcatagtattgaatgtggaggtacattttcttagtcacccttttaaaaaatatctgtttactgtctagtatatctgtgtaactttttgtattagagatcacatttgtacatagccacatgctttttttctctgtttgtattgagacagggtctcacacaagcgcccagactgtaatgcagtggtgcgatcacagttcactgcagcctcaacctcccaggctcaagcactcctcctacctcagcctcctgagagtatctgggactacaagcatgtgccaccacaactgactaattttttttttttttttttttgagagacggggttttgccatgtttcccaggctggtcttgaactccttgggctcaaggatctgctcacttcagcctcccaaagtgctgggattactggtgtgagccactgcacctagcaccatgtgcttttaacccacactcatgatagtagtttaaatagaaattataaactgggctaagcacggtggctcgtgcctataattctagcactatgggaggcccgggcaggagcggcacttgaggccaggagtttgagactaccctgggcaacatagcaagaccctatctctacaaaaaattttaaaaattagctagggattgtggggtatgcctgtagtcctagctgctccggaagctgaggcaggaaggtcaattgagcccaggaatacaaggctgcggtgaaagctatgatcattccactcgagcctgggcaacagagcaagaccctgttttgttttttttttgttgtttttttaaagaaagaaagaaattataaacaaaattaaaccattttataccaaaatatttttattattttgtatactcaacataattttaagttattagctatatgagtaatagcataaacctcctagacttattctaagagacttagtcaagggcagatgagtggtaaacatttttatggaaacaaatccctttattcctattttttgttccacatttgtagtatttattcatcctttcagcaaatatttgttgatccactaaaattccgtgaattagggttatattagtgatccctgcatatttttaaagtacaataaacatcattgctcttcaaataacaaagcattatggtttatgttgattttatttttcagtgccagctcctgttgaacatcagatctgtcctgctgtgtgtgttctaatgaaactttcatttgatgaagagcatagacatgcaatgaatgaactaggtaagacaaaaatgttttttaatgacatagacaattactggtggatttttaaatcatggtagaaattcagtatagtaaataaagatttttaatcattgatgaattaggatataaggccaccaacttctgttatcagctgcttcctctgtgtagcaaaaaattgtaccctggtttccagcatagaaaggatcctgaatcacagaaactgctaccctgtcataagctaactttttcaaaatcgaagccggagattgaaaaaaaatgacaaaatgggtcactctttgtcccttttgccaaagtagactctatatgtgccagctgatgaggatggtaatttgaattattttgaaatgtggagctgctgtattgtgattgaactcagtcacttttgatgagcatcagagggaattattattaagattgtcatttatcttcatggttattggtactttacaggattttcatcataagcagcctggtatctttgaaattggttaatatagaaaagtattatgctttaagtcagaaacatttcattataactttggaatgattacttctttaggtatgtattttcacacactaagccttatataaccagcagtgcactccattttttatgtaatggtttttctttgatttctaggttcattttgtacatgtggtatttataaattgcatcatgctgaaccatctcatgtgaactggatctctctagtcatgccacaagcaagaaccatacgcttaattcccattttagtgtaattgtgcccttgctttttgtgccgtttatgttacattatgttccagccaccactttatattcctatcccctcatcgtttcattcgtcatttatcttaaaagtgatgaagtcatgagactcttacacagagaacctgaacagccaaaagtattgtctccttcagagtcatcactttgggaggctctgcaccttaagatttcaggcctgccctctggccatgctttccttcctagtggtgtagcaattggcctacctgattctctttcctccccctggtctcctgtggattctcagttaatcttatgaattctcccctcgttaatacaatctcagcatttgtgaacattttaaattttttaaaatgctaatcataacaggaaggggataaaaaataatgaataaacaggaaaacattcagttttaagatacctcaaaagttattctgtaaatgttcctgtattccaatggattgtagactaggactgagacattaatcatctggatttcaaaataaaacctagactcagtatttgttcctcttccttcttcaggtaggaaggctacccggggcatttcatcacaggagctagggcaggggctttcaggtgaggagcaggatggggcctctgggggtgtgactgctggggacatagccacaggggattaccttcttctcactcctcacctccagatttgcactggggcaaaaggaggattagggtgtgtggattgcggggagataatagtacaagacagcacaaggttttggcagtaagggataaggagaaaagaaatcccaaataggtaaaggggaattccttagttcagtcagctgggatggtcatttgtacatatatgaagattctacagctatcagtcatttaagtttgcacttattagtattagaagttttagaatataatttccatgatatatgtttattgattccctaatctaccccagaaactgtgctaggcactagatttttataatgattaagacctggtcctggctttcagggaactcacagtttatttgcattagtgtttcacaaaatacctaaatcataatgatcacccagaggcactcgtcaaactggattttctggcactgtagcaaacagaatctccaggggaagggcctaggaatcaatgtgataagtggcctggctgattcttatgttcgggaaattttgtgaaacaccagtagaatattcttgttgagcctgtgatatttattttagaacaaggcatttcatgctaatggtgactatctaaaccaaataaaacaaaagcaatatgctttttaaaattatcagtctttcttttgttcataagagtctaaattaaggattctgttgaatgtcacctgagtctgttggtgctctactatcggtagttttaccctattgggcaatagtccggtctatttagaccactgttttctaacaggcaccaagaaaattgtagaaggacatgttcatcatctttgcattaccatgaaacatcctgatttttcttagagcaaccagtttttaattgtatcaatccagtcatgaatttgcatattttagcaaatccatttataggtttaacctatgaattctattctgtgcctcaaaattctctgaaatcttttcatttgcctgaaatcaaaaagcacttcctcttttatctgatagtctaaatttttttgaatgttctttttttattagccatgttcttcctgaatctgttgatatctgccacattcttatttaatctttattttcagtatcaaatcctaagatttttagtttttccatacaagagtactcaactctttgatcatgtagtgccttcttggcatcttctttaggtgcattttatctttcttaagaaagtatcccagttattgtcacaccaggcaagattttatacagacaaaaggcatagtttgttttgttttggtattgatcctctgctttaaaatactcgacatcttggggatctcattagtataccaggccaagtcttaaggtcttccctgtcaatttcatgggtcaaaattctcagttcttttacaggctccttttcttttacccaagtgtaaaatggtggaattccttgaagctctgccctaggctcttttcctttctctctatgcttctgttatagtttttgtttttgttttcaaatttacagctcaatttgagttttttccctgagttttagacacattattgaactgactatgtgacatcttcccttaggtggtattttagacacttctaactcaactgtcacaaactgaattcgtaatctttcccatccctgaatctcttatcttttcccagtttccttttctcagaaattccaatccagttgctcaaatttcaaaatcttggaaatcattcacgatgccatccttatcccctgcaaatagcaactgactgctttaattctgctacttaaaagtatcttatgtcatcactcttctcttcatccccagtccaagccaccatcgtctctcctgttctacaatactttgtcttacttctcttcccatttccactcatagtcgattttgttcactgaaaccatagtaatctgtttagagtgtgcatctaattattcctttttctgcgtaaaatctttaatgtggcacataaagtcttatgtgatccggcatctacccatgtttatagcctcattttgtggccctctccttgctgttaaatatttcaggcccaggggccctttcacatgctgtttcctttgcttagaacgcatctttcttcttcctgccccacccttgttagatacgcattcatctggccagacctgatggctcatgcctgtaatcccagcactttgggaggccgaggcaggagaatcacttgaacctaggagttcgcaaccagctcgggcaacatagtggcaccctgtctctaccaaaataaaaataaaaagaaagatacacattcatcctttacgtttcaacttaaacattaaaagattatttcctcagcctttttcttatggagcctaatcccaggtctaagttaagtccacctattatatcaccctgtggttctacatagttcatctatctttgctccaatctgtacgctcttcataaagacagtgactgatttttgttcactgtctctgtattttgccactgttgcaggtgaatggaggaaaattttcctaaatatgatttggattttctttaaccaaattaattttcacttacctacattcaaacatgtctgtcattcctgctagtaataaagttttgcataaatcttcctacatttaaatcccttggcttggaattcttgacccacgacagaactttgttttacaaacttgcagattcttctgcatattgaacttcccagatcacttattaaaaatattaacgtactggctgtcttgcagatgaatgacctaattagacttgtagtatccaagaattgcctgtttatattcatctttttctttctgagtcccgtgatgattaatatttgatgaattatattttgaatagcctccacatgcatttttctcttttgttcacttcctcaccattttgcttcactttttttttaactgcttcctttgtgtctttcccattcctttacctttgttttctccttgacttcctattgttggccattgtgggcattgtttagcattttcagtggaaagaatcaggggaaagaaaatactaaatcttagtatagttaatatttgatattatcaacgagaagtaagaaatgttttgaaaaacacaaatcagtagttttatataacttaataaattgaacagatgatcattttttgtaaaaaaaaaaaaaaacaaaactttttagtttttcttcatgcacagtttcatttaaaggcatccgtattcctaagggtaattatttgccaaaaaaaaaaaattaaagtagttaggccacagtgtatgacaataaagagtgtttataaagccctaataataataataagttacctttttctgcttatgttcacgaagaactagtgttagaaaatagccttcttcactgttggcaaggtgcagtgtatatgcagtaaatagaaaataattatttcgctcagcaagataaggggctgggggtggagaaactggcataaaatggaataattgtcagttgtactttataaatatattatacagaagttctttataacagtttttgtagcttataattctaaaggcaaatttaaaccatatattctcattgattgagtttttttttcctagtatttaagttaccaacttggtaccagtttgttttattttagatgattgtctttttcctcttgccctttttaaattagggggactacaggccattgcagaattattgcaagtggactgtgaaatgtatgggcttactaatgaccactacagtattacactaagacgatatgctggaatggctttgacaaacttgacttttggagatgtagccaacaaggtatgtttttataacatgtatttcttaagatagctcaggtatgagttaatttactttcatacaaatacattttactgattttcttttttttcactctcctcattaaacaatgactgataaaaacctgtgcttcacattcgcttatctttactcatttgtttgtcttatgcctaaacaaaggcaaaggtacatctacagatggaacacagtagtgaatttatgtaattgcattaaaaacaccattcataagaatatacttgtagggatcatttctgtgatccattactagagaagtttaactgtgtagaattaaaaaataaaagataaaacacttcctaggaatgggattaaaaatctaaaaattcttaagaccaaggcaagtgttacacacacattgattccatccaaataagaggctttactctaaaacctgttgcttatcatttctcaccacttattcactttatttctctagtttgacaaaggaagaacagatagcaaagaattaggagaatatttgtcttttatttaggtaatcttattctagattttttatgagtgaagtatcagttatgattaaaacaaaataatgaaaactgaattagacatttagtagccaaaaataaagcttggcttcaagttgtctttttaatgatcctctattctgtatttaatttacaggctacgctatgctctatgaaaggctgcatgagagcacttgtggcccaactaaaatctgaaagtgaagacttacagcaggtactatttagaatttcacctgtttttcttttttctctttttctttgaggcagggtctcactctgtcacccaggcttagagggcagttgtgcaatctcagctcactgcaacctctgcctccagggttcaagcaatcctcccacttcagcctctcgaggctgggcctacaggtgcacaccaccatgccaaacgaatttttgtattttttatagagacggggtttcaccacacctgggctcaagcaatctgcccacctcagcatctcaaaatgctgggattacaggcgtgtgccaccacacccagctaatatcctgatttagattgttgctcagtatttagtatctcatgtataaaagatagttccattaacactagaaaaagaaaaataattatattgtggttagactgtaggaaatctttttggcactgtagtagcatttaggaggaatttaaaaaaaaaaaaaaaaacaggatctccctctcttgcccaggctggagtgcagtggtgcgattatggctcacagtaacctcaagctcctgggatcctcctgcttcagcctcccaagtagctagaactactgcaggcgcatgccaccatgcccagctaatttttaaaaagttttcatagagacagggtctcactgtgttacccagaaggtcttgaactcctggtctcaggagatcctcctgcctcagcctcccaaagtgataggattacaggcgtgagtcaccacggctagccagaatttctttcttaatagatttctattcttactgctagcattaaaaacaaaaaagcaactagtatgattttatgtataaattaatctaaaattgattaatttgcaggttattgcgagtgttttgaggaatttgtcttggcgagcagatgtaaatagtaaaaagacgttgcgagaagttggaagtgtgaaagcattgatggaatgtgctttagaagttaaaaaggtacctttgaaaacatttagtactataatatgaatttcatgtttggcttttttttgctgccttcttttagccatgagatttcctaatttcttacctgtgtattattcagtactataatatgaatttcatgtttagctttttttgctgccttcttttagccatgagattccctaatttcttttttgagatggggtctctttctctcgcccaggctggagtgcagtggtctgatcttggctcactgcaacctccgtctcccatgttcaagtgattctcctgcctcagcctcctgagtagctgggattacagtgcacgccaccactcccggctatttgtatttttagtagagatggggtttcaccatgttggtaaggctggtctcgaactactcctgactttgtgatctgcccaactcggcctcccaaagtgctgggattataggcgcaagccatcacgcccagcctagattccctaatttcttacctgtttatctcaccagtccatagttttagagtaccgcaaactcctaaagtactaaggtagaaaagattatataaggggatttaatgtatatcagggtttctctgcctcagcactatagacatttttgaccagataattcttcgttttgctggggctgacctgtgcactgtagattgtttagcagcatccctggcctttgccaactggctgccagtataccctccccctagttatgccgatcaaaattgtctccagatactgtcagatgtctgtgggagggaggaaggacaacgtcaccaccaattaagaatcactggtataagtgtacctttgtgctctccaaacctcaatcccctcaaattttgatggtcaacttatcaagaggtgatcagagccaagggtgaggaatcatcaaataataatttgtttacagaaggaaatatctccaggcagtccatctgcttcagaaactaggctaaatttaaaaagaaaaaaaaaagtaaacttgaaatctgagagggaccaagcaagttgtcttagctagtctaggtttcctttcacccagctagtcctcctatacccacagcctacatgttcttcttcaaaactttcctcttcagagaaggcaaaaggtttgtttttttttggtttagttatgcatttttggtaaagtatattattttgttcttggaaaacccttgaaaatttattagatagaaaagcattcagctaaattattagttataaagataatattcaaatatacttagcatctgcataaaaatacctgtatcactgttgaatggagagaagacatttaagaaaagaacatggccgataagcccttgaaaagatacttaatatcattaatcatcagggaatacaaattaaaactacaatgagataccattatgcatatcatattggttaaaatttaaaagattgaccatgcattttcaaggatgttgagcagctggaaatcatgtattctgctagtgggaatataaaatggtataatcactttggacaacatttggcagtgtttttaagttaaacatacacctgccatatgacccaaccattccacttctaagtatttacccaagaggagcaaaagtgctgacacgaagacttacacacaaacatccacaataatttatgatagtcaaaaactagaaataactatgtctgtcagcaggtgaatggtaagcaaattgtggaatatttgtacaaagtaataggattcggctgtgaaaaagaatgactattgatacatgcagtaatctgtaatgacagaaaacagattagtggtggcctggggttgggagtagaagagaaggggaggattatgagagggtaggaaacttttggggatgatataaatgtttgttatcttgattggactggcagttttatgggtgtatacatgtatgaaaaattatcaaattgtaaacttgaaatgtgtgcagtttactgttcttcaattatatttcaataaagttcaaaaaaattagtgcttgcacacttaagtactcctactctaataaccctgtgtagtttcagaaggatttaatgtgtgtgtgtattatgagaatttgcactgctgctaactggttcatgacttaattctctctcaaggacctaaactcttctataaattttttttttttttgagatggagtcttgctctgctgccaggctggagtgcagtggcaggatctcggctaactgcaacctccaactccctggttcaagcgattatcctgcctcagcctcccaagtagctgggattataggcatgcgccaccatgcccagctagtttttgtatttttagtagagacggggtttcaccatgttggccaggatggtcttcatctcctgacctcatgacccgcctgccttggccttccaaagtgctgggattacaggcatgatataatgcatggtcaatcttggaaaaactagctgtcagaaatttataatatccagttctgatttgggcctaattctggttagcagtattagaatttatttattttttccctctttttctacatttagtgcagcagtcatgaacattcttcttctctttttcattcaatatcaattccctctcaacttcagctactaatgagcaagagaatcagaactaccttctagctcccctgcatgttccacatcactttaactcactcagagctcttactctagagctttcctttaccagcactctgtactccgttcacttaaagctgttggtcccttactcttgtcttctacatattctctactggatccttcttttttatgtttcagttctctagaagaagcccaatgttttgaaaaacaaaaattttctgtggcttctattacagtgtttctcttttccagtaacaaccaaaaccctgaacaatggttttgaccaaatacctttgtgtatcagagtgtttctggggcagttacaatttgacagttgactttgacttgcttcatttctaaactggctgtactatcttgagttcctcctaattttgcttctgacacaacccttctccttgatcatagaatctagatttgtagatttatttaagtttttctattctaccttcacctgtattttatactttttggtcactcacttttgctgttactacttgtattaataacctctaattatttattttgtgtcttctaatttgaactataaaaacatttttgaaacaaaacctctggcccttgacatgtagccccacagagaggaacttttgtatttttctaccttcaactctcaactctgggccagttgcatcttaattcagtcctttaaattcttgctttttttgttctcaggatacttggagtgccccacctttatctcagtcacaatgtaattaaaattgggctcatcttgattgatgtgagaaggacaaaggcacttcttgcataaaagcactctatctgcctcctaccacttatgtgacaaattatgtctaaacctgctcctagattgttttgttcacttaatttcttgatgaagagagtaaagtagctatttattgggttagacccaaaatgtttgctgtgacattcaaggcctggcttttgtctctctggacttattttccactgttccccatcatggactgtgatctcctttgcatcttctttctgggtcatcagtactcccgcgctgattcccacttccctgcctttcctcattctacttcccctgccagcagcaactggattctcttctctgggaatgtacaggtctaatcctcctaaagagctgttctcctccatgaaatatttgattgatttgattaaattcagggtgtaatagttttttctttggagcactttgtttcatgtatatttttgtatctttttttccccccaaagcaaattgctaacaccttcaatcactggtatcagtttgctatgtttgcatcctctagagtgcctctcattgcaataggcacagagttgatttctaattaatgtttgtttcctgatggatatatagtaagaagacagattgacatcaccatcatgccaagttttgggtttgggttttttttttttgcttttgcttttgcttttgcttttttgagacagggtctcactctgccacacagccttgacctcctgggctcaagctagcctcccgcctcagcttctcaagtagctggacctataggtgtgcaccaccatgcctggctaattttttttttttttttttttgagaccgagtctcgctctgtcacctaggctggagtatagtggcgcaatctcggctcactgcaacctctgcctccctggttcaagcgattcccctgcctcagcctcccaagtagctaggattacaggtgcccaccaccacaccgggctaattttttgtattttagtagagacagggtttcaccatgttgatcaggatggtctcgatctcctgacctcgtgatccgtgcaccttggcccctcaaagtgctgggattacaggcatgagccattgcgcctggccgcctggctactttttatattttttgtagagattgggtattgctgtgttgcccaggctggtttttaactcctaggcttaagtgatccacccacctcagcctcccaaagtgctgggcctgaaggcatgagccaccacacccagcacatggcaagttttgaccaaatacctttaattgtgtatcagagtgtttctgtggccattacaatttgacagttgactttgataattgtatgttagggagttccaggttttcataatttgttatgtggggaattttaagaaattatagcttttctagtaccctttattgtttttataaattacattgttaattttgaatcaaccacttgtatataatgctttttatataaacagaatattgtatatactacactgcaacttgctcttgtcatttaataatacttccaagatatctttccatatctatgtatggtttacagaattttaaaaatctactttcttttttttttgagacagggtctcactgtcaaccaggcttgagtgcagtggcgcgatcatggcttactgcagccttgacctcccaggcgcaagtgatcctcccaagcagctgtgactgcaggcgcgtgccaccatacccagctcattttttttttattttttgtacagacgggatttcaccatgttgtccaggctggtctcaaattcctaaactcccagtcacgccagtcagccttccaaagtgctgggattacaggcatgagccaccacgttgcgccttttttttttttttttttttttaaaaagagtttcgctctgtcagccaggctagaatgcagtgttgcagtctcggctcactgcgacctctgcctcccaggttcaagcgattctcccacctcagcctcccaagtagctgggattacaggcacctgccatgaagcccggctaatttttttttgtatttttgtagagacggggttttaccacattggcgaggctggtcttgaactcctgacctcagatgatccacccgtcagcctcccaaagtgctgggattacaggcatgagccactgtgcccggccacatgccgggccttaatccacttcctgttcacttttttttttcttttttcaagcaaccccagcctgagaataacccacattctattctgaaaatgttttcttttcataatgcacatcagttgtgcctcatattctaagatgtgtgtactatctaaacacttagaataaagtttataaaagtcattagttaaatattgtgttctgcttgttttatagagatatcactgatataaatactatttggtattttatgaacatttttctaaatggaaagttcttaatttaccagtgagggacgggcaataggatagattaaaaaatagcttttattcaatatcagtaacatagaagttaatgagagacaaattccaactctaattagatgacccatattctgtttcttactaggaatcaaccctcaaaagcgtattgagtgccttatggaatttgtcagcacattgcactgagaataaagctgatatatgtgctgtagatggtgcacttgcatttttggttggcactcttacttaccggagccagacaaacactttagccattattgaaagtggaggtgggatattacggaatgtgtccagcttgatagctacaaatgaggaccacaggtatatatagagttttatattacttttaaagtacagaattcatactctcaaaaagacctaattgtaagcaatgttttatataatcatgaaagttttaagccaaaatatatttattactgtgaaaagataactactaactcttagtttaactcattagtgtacttaatgtaataacagtttatagtattatagaggagactaaattaagcaaattatagttgagaggtgtagcccataggtggaggaaaaaatagtcacaaatattgtaacaaaataatccatttctattagtatagtataaaagagtatgaaaacaaaatttagaacaagacaaaaactatgagcgtgatccagagaatataaaggttcacatttttctaatgatgtcttagtatccataataataattttttttttttttttttgagacagggtctcactctgtctcccagactggagggcagtgttgtgatcttggctcactgcaacctccacctcctgggttcaagcgattctcccacctcagcttcccaacaagctgggactacagatgcacgccacaacacccggctaatttttctattttttggtagagatggggtttcacaatgttgtccagctgctcttgaactcctggcctccagtgacccacctgtctcagcctccctaagtgctgggattacaggtgtgagccaccgcgcccggccaataatcataatattatttagctaacagccattcatccaatctgctagagttgtaaaacccaagagagtgcttcagatacagggcacacattttcagaactcggatgctgtattatatcaacaaaaatacaactgtcttttttttttttttttttttttttttcttgagatggagtcttgcactcttgcccgggctggagtacagtggcacaatctttgctcactgcaacctctgcctttggggttcaagcgattctcctgcctcagcctcccgagtagctgggattacaggtccccccccccccccgccaccgtgcccggctaatttttatatttttagtagagacggggcttcaccatgttggccaggctggccttgaactcctgaccttaggtgatccgcccacctcggcctcccaaagtgctgggattataggcatgggctactgcgcctagccaaaaatatggttgttttttatagcttattcattttttaagtctgtgatgcagaaactacaagcctagtctccctttctgctatacagagaagatttcttaagtccagtaactactggactgctaagagaagacgaccatgttaaagctcattatgtacccttgccattcagttttaaagcccactaaagctgaatatgctgtcattaatcttcagtttgcctgcgttaaacaagctgttgctctttcatgtccagagttcattatgctgattctcactccttgtttttatatgccttaaatgtttcaaaaactttaatttacttgattttttaaaaataataagcacacagtctgccaaagagcagtttttcttttcttttttttcttttttttgagatggagtctcactctgttgtccaggttggagtgcagtggtgtgatctcggctcactgcaacctctgcctcccaagtgattctcctggctcagcctcctgagtagctgggactacaggcatgcactaccatgcccggctaatttttgtatttttagtagagacagggtttcaccatgttggccaggctggtcttgatctcctaatctcaggtgatccgcctgcctcagcctcctaaagtgctgggattacaggcatgagccactgtgtctggccaagagcactcgtaagaaggatggcagtatcacaaaatcaagccagagatacagagattactctaaaaagtaagtgttctaatctaagagcttataatgtgcactgactgcagaaaaatcttcaatcaattctatctacctcttccaagataactcaatatcaatatcagagtggcacccaaccatagattaaattaccacaaagttcctattcaacataggatttcatgatatagtttttaaattgggaaactgttatatgaatagagtaaatgtatgtgccccaccccctgcaaatgttttaagctattgggtcagaataggaaatgtagaattgacaaaaaataacacctttactttttttagtgtgacagattagtactttaaaacattaaacattacatgaaattagaacaaaaggagatgtggaatacttggaatttataggataattggtacaatcatattatgccttttgtcttctatccttttatttgttgttactgcatacacattgtgaccttaattttgtgatctcttgattttatttcaggcaaatcctaagagagaacaactgtctacaaactttattacaacacttaaaatctcatagtttgacaatagtcagtaatgcatgtggaactttgtggaatctctcagcaagaaatcctaaagaccaggaagcattatgggacatgggggcagttagcatgctcaagaacctcattcattcaaagcacaaaatgattgctatgggaagtgctgcagctttaaggaatctcatggcaaataggcctgcgaagtacaaggatgccaatattatgtctcctggctcaagcttgccatctcttcatgttaggaaacaaaaagccctagaagcagaattagatgctcagcacttatcagaaacttttgacaatatagacaatttaagtcccaaggcatctcatcgtagtaagcagagacacaagcaaagtctctatggtgattatgtttttgacaccaatcgacatgatgataataggtcagacaattttaatactggcaacatgactgtcctttcaccatatttgaatactacagtgttacccagctcctcttcatcaagaggaagcttagatagttctcgttctgaaaaagatagaagtttggagagagaacgcggaattggtctaggcaactaccatccagcaacagaaaatccaggaacttcttcaaagcgaggtttgcagatctccaccactgcagcccagattgccaaagtcatggaagaagtgtcagccattcatacctctcaggaagacagaagttctgggtctaccactgaattacattgtgtgacagatgagagaaatgcacttagaagaagctctgctgcccatacacattcaaacacttacaatttcactaagtcggaaaattcaaataggacatgttctatgccttatgccaaattagaatacaagagatcttcaaatgatagtttaaatagtgtcagtagtagtgatggttatggtaaaagaggtcaaatgaaaccctcgattgaatcctattctgaagatgatgaaagtaagttttgcagttatggtcaatacccagccgacctagcccataaaatacatagtgcaaatcatatggatgataatgatggagaactagatacaccaataaattatagtcttaaatattcagatgagcagttgaactctggaaggcaaagtccttcacagaatgaaagatgggcaagacccaaacacataatagaagatgaaataaaacaaagtgagcaaagacaatcaaggaatcaaagtacaacttatcctgtttatactgagagcactgatgataaacacctcaagttccaaccacattttggacagcaggaatgtgtttctccatacaggtcacggggagccaatggttcagaaacaaatcgagtgggttctaatcatggaattaatcaaaatgtaagccagtctttgtgtcaagaagatgactatgaagatgataagcctaccaattatagtgaacgttactctgaagaagaacagcatgaagaagaagagagaccaacaaattatagcataaaatataatgaagagaaacgtcatgtggatcagcctattgattatagtttaaaatatgccacagatattccttcatcacagaaacagtcattttcattctcaaagagttcatctggacaaagcagtaaaaccgaacatatgtcttcaagcagtgagaatacgtccacaccttcatctaatgccaagaggcagaatcagctccatccaagttctgcacagagtagaagtggtcagcctcaaaaggctgccacttgcaaagtttcttctattaaccaagaaacaatacagacttattgtgtagaagatactccaatatgtttttcaagatgtagttcattatcatctttgtcatcagctgaagatgaaataggatgtaatcagacgacacaggaagcagattctgctaataccctgcaaatagcagaaataaaagaaaagattggaactaggtcagctgaagatcctgtgagcgaagttccagcagtgtcacagcaccctagaaccaaatccagcagactgcagggttctagtttatcttcagaatcagccaggcacaaagctgttgaattttcttcaggagcgaaatctccctccaaaagtggtgctcagacacccaaaagtccacctgaacactatgttcaggagaccccactcatgtttagcagatgtacttctgtcagttcacttgatagttttgagagtcgttcgattgccagctccgttcagagtgaaccatgcagtggaatggtaagtggcattataagccccagtgatcttccagatagccctggacaaaccatgccaccaagcagaagtaaaacacctccaccacctcctcaaacagctcaaaccaagcgagaagtacctaaaaataaagcacctactgctgaaaagagagagagtggacctaagcaagctgcagtaaatgctgcagttcagagggtccaggttcttccagatgctgatactttattacattttgccacggaaagtactccagatggattttcttgttcatccagcctgagtgctctgagcctcgatgagccatttatacagaaagatgtggaattaagaataatgcctccagttcaggaaaatgacaatgggaatgaaacagaatcagagcagcctaaagaatcaaatgaaaaccaagagaaagaggcagaaaaaactattgattctgaaaaggacctattagatgattcagatgatgatgatattgaaatactagaagaatgtattatttctgccatgccaacaaagtcatcacgtaaagcaaaaaagccagcccagactgcttcaaaattacctccacctgtggcaaggaaaccaagtcagctgcctgtgtacaaacttctaccatcacaaaacaggttgcaaccccaaaagcatgttagttttacaccgggggatgatatgccacgggtgtattgtgttgaagggacacctataaacttttccacagctacatctctaagtgatctaacaatcgaatcccctccaaatgagttagctgctggagaaggagttagaggaggggcacagtcaggtgaatttgaaaaacgagataccattcctacagaaggcagaagtacagatgaggctcaaggaggaaaaacctcatctgtaaccatacctgaattggatgacaataaagcagaggaaggtgatattcttgcagaatgcattaattctgctatgcccaaagggaaaagtcacaagcctttccgtgtgaaaaagataatggaccaggtccagcaagcatctgcgtcttcttctgcacccaacaaaaatcagttagatggtaagaaaaagaaaccaacttcaccagtaaaacctataccacaaaatactgaatataggacacgtgtaagaaaaaatgcagactcaaaaaataatttaaatgctgagagagttttctcagacaacaaagattcaaagaaacagaatttgaaaaataattccaaggtcttcaatgataagctcccaaataatgaagatagagtcagaggaagttttgcttttgattcacctcatcattacacgcctattgaaggaactccttactgtttttcacgaaatgattctttgagttctctagattttgatgatgatgatgttgacctttccagggaaaaggctgaattaagaaaggcaaaagaaaataaggaatcagaggctaaagttaccagccacacagaactaacctccaaccaacaatcagctaataagacacaagctattgcaaagcagccaataaatcgaggtcagcctaaacccatacttcagaaacaatccacttttccccagtcatccaaagacataccagacagaggggcagcaactgatgaaaagttacagaattttgctattgaaaatactccggtttgcttttctcataattcctctctgagttctctcagtgacattgaccaagaaaacaacaataaagaaaatgaacctatcaaagagactgagccccctgactcacagggagaaccaagtaaacctcaagcatcaggctatgctcctaaatcatttcatgttgaagataccccagtttgtttctcaagaaacagttctctcagttctcttagtattgactctgaagatgacctgttgcaggaatgtataagctccgcaatgccaaaaaagaaaaagccttcaagactcaagggtgataatgaaaaacatagtcccagaaatatgggtggcatattaggtgaagatctgacacttgatttgaaagatatacagagaccagattcagaacatggtctatcccctgattcagaaaattttgattggaaagctattcaggaaggtgcaaattccatagtaagtagtttacatcaagctgctgctgctgcatgtttatctagacaagcttcgtctgattcagattccatcctttccctgaaatcaggaatctctctgggatcaccatttcatcttacacctgatcaagaagaaaaaccctttacaagtaataaaggcccacgaattctaaaaccaggggagaaaagtacattggaaactaaaaagatagaatctgaaagtaaaggaatcaaaggaggaaaaaaagtttataaaagtttgattactggaaaagttcgatctaattcagaaatttcaggccaaatgaaacagccccttcaagcaaacatgccttcaatctctcgaggcaggacaatgattcatattccaggagttcgaaatagctcctcaagtacaagtcctgtttctaaaaaaggcccaccccttaagactccagcctccaaaagccctagtgaaggtcaaacagccaccacttctcctagaggagccaagccatctgtgaaatcagaattaagccctgttgccaggcagacatcccaaataggtgggtcaagtaaagcaccttctagatcaggatctagagattcgaccccttcaagacctgcccagcaaccattaagtagacctatacagtctcctggccgaaactcaatttcccctggtagaaatggaataagtcctcctaacaaattatctcaacttccaaggacatcatcccctagtactgcttcaactaagtcctcaggttctggaaaaatgtcatatacatctccaggtagacagatgagccaacagaaccttaccaaacaaacaggtttatccaagaatgccagtagtattccaagaagtgagtctgcctccaaaggactaaatcagatgaataatggtaatggagccaataaaaaggtagaactttctagaatgtcttcaactaaatcaagtggaagtgaatctgatagatcagaaagacctgtattagtacgccagtcaactttcatcaaagaagctccaagcccaaccttaagaagaaaattggaggaatctgcttcatttgaatctctttctccatcatctagaccagcttctcccactaggtcccaggcacaaactccagttttaagtccttcccttcctgatatgtctctatccacacattcgtctgttcaggctggtggatggcgaaaactcccacctaatctcagtcccactatagagtataatgatggaagaccagcaaagcgccatgatattgcacggtctcattctgaaagtccttctagacttccaatcaataggtcaggaacctggaaacgtgagcacagcaaacattcatcatcccttcctcgagtaagcacttggagaagaactggaagttcatcttcaattctttctgcttcatcagaatccagtgaaaaagcaaaaagtgaggatgaaaaacatgtgaactctatttcaggaaccaaacaaagtaaagaaaaccaagtatccgcaaaaggaacatggagaaaaataaaagaaaatgaattttctcccacaaatagtacttctcagaccgtttcctcaggtgctacaaatggtgctgaatcaaagactctaatttatcaaatggcacctgctgtttctaaaacagaggatgtttgggtgagaattgaggactgtcccattaacaatcctagatctggaagatctcccacaggtaatactcccccggtgattgacagtgtttcagaaaaggcaaatccaaacattaaagattcaaaagataatcaggcaaaacaaaatgtgggtaatggcagtgttcccatgcgtaccgtgggtttggaaaatcgcctgaactcctttattcaggtggatgcccctgaccaaaaaggaactgagataaaaccaggacaaaataatcctgtccctgtatcagagactaatgaaagttctatagtggaacgtaccccattcagttctagcagctcaagcaaacacagttcacctagtgggactgttgctgccagagtgactccttttaattacaacccaagccctaggaaaagcagcgcagatagcacttcagctcggccatctcagatcccaactccagtgaataacaacacaaagaagcgagattccaaaactgacagcacagaatccagtggaacccaaagtcctaagcgccattctgggtcttaccttgtgacatctgtttaaaagagaggaagaatgaaactaagaaaattctatgttaattacaactgctatatagacattttgtttcaaatgaaactttaaaagactgaaaaattttgtaaataggtttgattcttgttagagggtttttgttctggaagccatatttgatagtatactttgtcttcactggtcttattttgggaggcactcttgatggttaggaaaaaaatagtaaagccaagtatgtttgtacagtatgttttacatgtatttaaagtagcatcccatcccaacttcctttaattattgcttgtcttaaaataatgaacactacagatagaaaatatgatatattgctgttatcaatcatttctagattataaactgactaaacttacatcagggaaaaattggtatttatgcaaaaaaaaatgtttttgtccttgtgagtccatctaacatcataattaatcatgtggctgtgaaattcacagtaatatggttcccgatgaacaagtttacccagcctgctttgctttactgcatgaatgaaactgatggttcaatttcagaagtaatgattaacagttatgtggtcacatgatgtgcatagagatagctacagtgtaataatttacactattttgtgctccaaacaaaacaaaaatctgtgtaactgtaaaacattgaatgaaactattttacctgaactagattttatctgaaagtaggtagaatttttgctatgctgtaatttgttgtatattctggtatttgaggtgagatggctgctcttttattaatgagacatgaattgtgtctcaacagaaactaaatgaacatttcagaataaattattgctgtatgtaaactgttactgaaattggtatttgtttgaagggtcttgtttcacatttgtattaataattgtttaaaatgcctcttttaaaagcttatataaatttttttcttcagcttctatgcattaagagtaaaattcctcttactgtaataaaaacaattgaagaagactgttgccacttaaccattccatgcgttggcacttatctattcctgaaatttcttttatgtgattagctcatcttgatttttaatatttttccacttaaacttttttttcttactccactggagctcagtaaaagtaaattcatgtaatagcaatgcaagcagcctagcacagactaagcattgagcataataggcccacataatttcctctttcttaatattatagaattctgtacttgaaattgattcttagacattgcagtctcttcgaggctttacagtgtaaactgtcttgccccttcatcttcttgttgcaactgggtctgacatgaacactttttatcaccctgtatgttagggcaagatctcagcagtgaagtataatcagcactttgccatgctcagaaaattcaaatcacatggaactttagaggtagatttaatacgattaagatattcagaagtatattttagaatccctgcctgttaaggaaactttatttgtggtaggtacagttctggggtacatgttaagtgtccccttatacagtggagggaagtcttccttcctgaaggaaaataaactgacacttattaactaagataatttacttaatatatcttccctgatttgttttaaaagatcagagggtgactgatgatacatgcatacatatttgttgaataaatgaaaatttatttttagtgataagattcatacactctgtatttggggagggaaaacctttttaagcatggtggggcactcagataggagtgaatacacctacctggtgccttgaaaatcacatcaagtagttaattatctaccccttacctgtgtttataacttccaggtaatgagaatgattttttttaaagctaaaatgccagtaaataaaagtgctatgacttgagctaagatatttgactccaatgcctgtactgtgtctactgcaccactttgtaaacacttcaatttactatctttgaaatgattgacctttaaatttttgccaaatgttatctgaaattgtctatgaataccatctacttctgttgttttcccaggcttccataaacaatggagatacatgca

SEQ ID NO: 17 - DNA, 10444 bp, Homo sapiens
cctcgcctccgttacaacggcctacggtgctggaggatccttctgcgcacgcgcacagcctccggccggctatttccgcgagcgcgttccatcctctaccgagcgcgcgcgaagactacggaggtcgactcgggagcgcgcacgcagctccgccccgcgtccgacccgcggatcccgcggcgtccggcccgggtggtctggatcgcggagggaatgccccggagggcggagaactgggacgaggccgaggtaggcgcggaggaggcaggcgtcgaagagtacggccctgaagaagacggcggggaggagtcgggcgccgaggagtccggcccggaagagtccggcccggaggaactgggcgccgaggaggagatggaggccgggcggccgcggcccgtgctgcgctcggtgaactcgcgcgagccctcccaggtcatcttctgcaatcgcagtccgcgcgtcgtgctgcccgtatggctcaacttcgacggcgagccgcagccctacccaacgctgccgcctggcacgggccgccgcatccacagctaccgaggtacgggcccggcgcttaggcccgacccagcagggacgatagcacggtctgaagcccctctaccgccccggggtccattttgcagacggggaactgaggccccttgaggcaggacacatccagggtgacgctgctcgtaagcgtcagagcattcttttttttttttttttttttctgagacggagtctcgctctgtcgcccaggctggagtgcagtggcgcgatctcgactcactgcagcctccgcctcccgggttcaagcgattctcctgcctcagcctcctgagtagctgggattacaggcgtgcgccaccgcgcccggctgatttttatatttttagtagagacggggtttcaccatgttggtcaggctggtctcgaactgctgacctcgtgatccgcccgcctcggcctcccaaagtgctgggcttatgggcatgagcctccgcgcccggcccagagcattctttataaggccgaatagtttgcatttgaaggtggctccccccagtcccccaccccacgtgtattttcccctcaaagaaaagctgcatccttaacaccccatctgttcagtcctcatgactccagtgggccagttctgcgtagtccctgccctcgtggagaacacattcctcctggggagactgacagatgcaaagacaggaacaagccagggtcatgttggcgccggaagagccgaccgtgtgtggcgtgggaaattgacttacctgcctgctgggagatggaggggttgcggttgtgtggtttcagttaaggagcacttcccggagaaggaagagagcaggatggagtaggaactagccaaccctaggtaagaggttctagacatgcgtgcgttgagacctggagtcttgggagaggatgcttaaaaggtgattttacccctaggaatatgggggcactgaaatttttttttttttttgagacgggagtcttgctctgcaagctggagtgcagtggcccacgctagaatgcagtggcgcgattgcggctcattgcaacatctgccacctggggtcaagtggttctcttgcctcagcctcccgaggagcggggattacaggcgtgcgccaccactcctggctaattttttttttagtagagacgggggtttcgtcattttggccaggctggtctcgaactcctgacctcagatgatccacccgccttggcctcccaaagtgctgagattacaggtgtaagccactgcgcccagccctttgaaagtttttcagtatttatgtatatatatttttgagttggagtctggatctgtcgccagactggagtgctgttgcacaatcttggctcactgcaatctccgactccctggttcaagcgattctcctgcctcagcctcccaagtaactgggattacaggcacgcactaccattcccagctaattttttgtattcttagtagagacagggtttcaccatgttggccaggatggtctccatctcctgcgctcgtgatctgcctgcttcggcctcccaaagtgctgggattacaggcgtgctgggatttcggccacaacgtccgaccgaaagtttttaagcagggacatgacattgtcagatttatatactgaaaagctcacccaggttgccaagtggtttggaggggaaagactgctgtcgaggaagcagttaggtagttgtgaaaacccaggtgaggaataactaggccttacctaaggtgcaggcagtaatcttgccatggcctttaagcagagaagtagtcctagtgtcacttaatctttacaaaggatttttgcaaggatcccgatctttcttccttgagggtggtgtacttaatacacttttacaccagacttctaatgttagatgaagaacacagtatttccagggatcaacatttctgtaggctcctattttatataggaaattgtatgaattttgtattttactccaaaatttttctgtgcccgatttaatataaaaatttactgagcctgggtgcagtggctcatgcctgtgatctcagcactttgggaggctgaggcaggaggatttcttgagcccaggagctggagaccagcctgtgcaacatagtgagaccctgtctgtatttaaaaaaaaaaaaaattcttgaaaaattagcagggcacattcctgcctttagtcccagctacttgggaagctgaggcaggaagatcacccgaacccaggagttggaggctacagtgaactatgatggtgcctctgaatagttgctgtactctagtctggtaacacagcaagaccctgtctctctatcttgtcttttttttttttttttttgagacaggatgtcctgctgttgcctgggctggagtgtggaggctggagtttggtggcatgatcacggctcattgcacccttaacctgggctcaagcagtcctcccagagcttcagcttcccaaagtagctgggactataggcatgctccactatgtctggctaatttctttttttatttttatttttagtagagatgaggtcttgctatgttgcccaggctgagacctcatctcttttttatttttttaaaattttttattatactttaagttctagggtacatgtgcacaacgtgcaggtttgttacatatgtatacatgtgccatgttggtgtgctgcacccatagagacctcgtcttaaaaaaagaaaataacattacttttgaaggtacttaatgcactgaattgtacatttaaaaatggttaaaatggtaaatgtttgaggcaggtagatccacctgaggtcaggagttcaagaccagcctgaccaatatggtggaaccctgtctctgctaaaaatacaaaagttagctgcatgtggtggcatgcgcctgtttagtcccagctactcgggaggctgaggcaggagaattgcttgaacctgggaggcggaggtggcagtgagccaagatcacaccactacactccagcctgggcaacagagcaagactccatctctaaataataaataaaatggtaacttttatgtatattttaccaaaatttaaaaaattacaagtttacatttcttaaaatttcccatcaaatctgtaagtaaatttatgccccgaggaacaagtgctatatttattctaagacaacctcctccttccttaaacagaatcttagggctggaggattgcttcctgccctcttttgtttgtgatgtatgcattttgaaaattctgggccaggcgcagtggctcactcctgtaatcccagcactttgggaggccgaggcgggcggatcataagatcaggagattgagaccatcctggctaatacggtgaaaccctgtctctactgaaaataacaaaaaattagccgggcgtggtggcgggcacctgtggtcccagctatttgggaggctgtggcaggagaatggcataaacctgggaggcggagcttgcagtgagccgagatcgtgccactgcactccagcctgggcgacagagcaagactgcatctcaaaaaaaaaaaaaagaaaaagaaaagaaaattctggtataatttacatacagtaaaatgcacagatcttagggtttgatgagttttctctcgacatgtttttgcacttccttgtttttgagaagcactgatttgagaagtcagtggctttttctctttagtttgcagggtttgctgtgatttgtaatcacgtacttgacctaggcttcccttttccaccatggtagcagaaagggcatgggattgagagctttaagtacgcgctctttgcttactgtcttataccttgagcatgtcacttctctcagacttgttttctcatctgtaaatggatctgttgtgaggactgactgagataatgttactagaagggctttgtataatatttaagcagagtgagaggtaagctttttgtgtaggtcaggggaaatggagaaaataggtgccctgactcagaccagtctggctctttttttttttttttttggagacggagtcttgctctgtcacccaggctggagtgcagtggcgcgatctcggctcacggcaagctccacctcctgggttcacaccattctcctgcctcagcctcccgagtagctgggactacaggcgctcgccaccacacctggctaatttttttgtatttttagtagagacgaggtttcaccacgttagccaggacggtcttgatctcctgacctcatgatccgcctgcctcggcctcccaaagtgctgggattacaggtgtgggccaccgtgcccagccaccggtgtggctctttaacaacctttgcttgtcccgataggtcacctttggctcttcagagatgcagggacacacgatgggcttctggttaaccaaactgaattatttgtgccatctctcaatgttgacggacagcctatttttgccaatatcacactgccaggtactgacgttttactttttaaaaagataaggttgttgtggtaagtacaggatagaccacttgaaaaattaagcccagttctcaatttttgcctgatgtcaggcacgttatccaatctttttgtatcctattctctaccataaataaaatggaagtgatgtatttgtacgttatgtgttaaaggtgttatggtgtctcaaaagcactttgggctcttaagagacaagcgaaattaaagtatcatatcataggttagttttgtagaattgtagaattacgaatgccttttgtttccctggccaaattgtgccctggagttccaggagaacaatgtgtagagcatgagatattttggcttatttgttgctgacttctaattttttttatttttttgagacagaatctcgctgtgttagctaggctggagtgcagtggcgcaatctcggctcactgcaacctccgcctactgggttccagtgattctcttgtctcagcctcccgagtagctgggactacaggcgtgtgccacccactctgataattttttgtatttttagtagagacggggtttcaccgtgttagccaggatggtctccatctcctgacctcatgatctgcccgcctacgcctcccaaagtgctgggattacaggcatcagccacagcacctggcctatgtattttcaatttaacacaatcaagctcacagtgccaatcagaggtgttttttttttttttatttttatttttagagagtctcacagtgtcatccaggctggagtgcagtggtgcgatttcagctcactgcaacctctgcatcctgggttcaagtgattctcctgcctcagcctcctgggtagctggggttataggtgcctgtcaccacacctggctaatttttgtatttttagtagagatgaggtttcaccatgttggccaggctgatcttgaactcctgacctcaggtgatctgcccacctcagcctcccaaagtgctgggattacaggcgtgagccactgcgtccagcctgtttttttttttttttaaatcattgaagattggtataatacttcactatttgtttgaagctcaaatgattttatcagggtaaaccctaataaactgatgttcctgtgggtaaaaaaaacctcactaaagaccagcagtgtgtggtggctcctgcctgtaatcatgcctgtaattccagcacttagggaggctatggcgggagggtcgcttgagaccaggagttcttgaccagcctggacaacaaagtgagaccccagctccacaaaaaaatttttttttaattacctgggcatcttagcatatgcctgtggtcacagctatttgggaggcttaggtgggaggatcccttgagcccaggagtttgaggctgcagtgagccatgatcataccactgcactccagcccaggtgacagagtgagatcctgtctcaaaaaaagaaaaaaaaaactcaaaaaccccccaaatacatgggtttcataggattcaaactactatgtgtgtatagatcctgttttaaggaagtagatatataaaaatgagcattgctaagttaaatttggtaaatttgccttatagaataccctcgagtacgtttccagtgagtgtaaaataggaattgggatacccaattcagttgtactagattttctttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctagattttctaagtacacattgttttggttatgtgttttgtgactaccaccccaaaactaataaccaccttttttttttttttgagacagagtctcactgtgtcacccaggctggagtgcagtggcgtgtgatcttggctcactgcaacctctgcctctcgggttcaagcgattctcctgcttcagcagctgggactacaggtgtgcaccaccaagcctggctaattttttgcattttagtggagacgggggtttcaccatgttgaccaggctgatcttgaactcttgagctcaggcagtctgcctgcctcagcctcctaaagtgctaggattacaggcgtgagccactgcgcccagcccaccattttatttgttcataattctgtagtccaggctgggctcagctaggcagttactctgctggtggtagtcgttggtgtggctgccttttgctggcagctgggggctgggcctgtccctcttttttttttttctcttttcttttttcttttttttcaagatagggtctcactctgtcacccaggttggagtgcagtggcatgatcttagctcactgcaacctctgcctccagggctcaagtgatcctcccacctcagcctccccagtcgctgggaccacaggcatgtgccaccatgcctggctaattttttgtgtattttgtagagacggggtttcgccatgttgccaggctggtctcgaactcctgagctcaggcgatctactgacgttggcctcccaaagtgttgggatcacaggcatgaaccaccatgcctggccagggcctgttcctctttatgtggtctctctagcagggtagctcagggctttcaaaagtataaaagcagaagtcagcaggcctttttaaggcttcggcctagaattgccagtgtcgcttcatccacattcagttagttaaagcaatcacaagcccagcccatttcaaggtgaaattactacagaggcatgaacaccatgaggtgtccatagggggccatcagcataacacactgccacatacatgcactcactttttttctttaacctaaagtgagatccatcagtagtacaggtagttgttggcaaagcctcttgttcgttccttgtactgagaccctagtctgccactgaggatttggtttttgcccttccagtgtatactctgaaagagcgatgcctccaggttgtccggagcctagtcaagcctgagaattacaggagactggacatcgtcaggtcgctctacgaagatctggaagaccacccaaatgtgcagaaagacctggagcggctgacacaggagcgcattgcacatcaacggatgggagattgaagatttctgttgaaacttacactgtttcatctcagcttttgatggtactgatgagtcttgatctagatacaggactggttccttccttagtttcaaagtgtctcattctcagagtaaaataggcaccattgcttaaaagaaagttaactgacttcactaggcattgtgatgtttaggggcaaacatcacaaaatgtaatttaatgcctgcccattagagaagtatttatcaggagaaggtggtggcatttttgcttcctagtaagtcaggacagcttgtatgtaaggaggtttgtataagtaattcagtgggaattgcagcatatcgtttaattttaagaaggcattggcatctgcttttaatggatgtataatacatccattctacatccgtagcggttggtgacttgtctgcctcctgctttgggaagactgaggcatccgtgaggcagggacaagtctttctcctctttgagaccccagtgcctgcacatcatgagccttcagtcagggtttgtcagaggaacaaaccaggggacactttgttagaaagtgcttagaggttctgcctctatttttgttggggggtgggagaggggaccttaaaatgtgtacagtgaacaaatgtcttaaagggaatcatttttgtaggaagcattttttataattttctaagtcgtgcactttctcggtccactcttgttgaagtgctgttttattactgtttctaaactaggattgacattctacagttgtgataatagcatttttgtaacttgccatccgcacagaaaatacgagaaaatctgcatgtttgattatagtattaatggacaaataagtttttgctaaatgtgagtatttctgttcctttttgtaaatatgtgacattcctgattgatttgggtttttttgttgttgttgttttgttttgttttgtttttttgagatggagtctcactcttgtcacccaggctggagtgcagtggcgccatctcggctcactgcaacctctgcctcctgggttcacgtaatcctcctgagtagctgggattacaggcgcctgccaccacgctggccaatttttgtacttttagtagagacagtgtttcgtcatgttggccaggctggtttcaaactcctgacctcaggtgatccgcccacctcagcctcccaaaatggtgggattacaggtgtgtgggccaccgtgcctggctgattcagcattttttatcaggcaggaccaggtggcacttccacctccagcctctggtcctaccaatggattcatggagtagcctggactgtttcatagttttctaaatgtacaaattcttataggctagacttagattcattaactcaaattcaatgcttctatcagactcagttttttgtaactaatagatttttttttccacttttgttctactccttccctaatagctttttaaaaaaatctccccagtagagaaacatttggaaaagacagaaaactaaaaaggaagaaaaaagatccctattagatacacttcttaaatacaatcacattaacattttgagctatttccttccagcctttttagggcagattttggttggtttttacatagttgagattgtactgttcatacagttttataccctttttcatttaactttataacttaaatattgctctatgttagtataagcttttcacaaacattagtatagtctcccttttataattaatgtttgtgggtatttcttggcatgcatctttaattccttatcctagcctttgggcacaattcctgtgctcaaaaatgagagtgacggctggcatggtggctcccgcctgtaatcccagtactttggaaagccaaggtaagaggattgcttgagcccagaacttcaagatgagcctgggctcatagtgagaacccatctatacaaaaaatttttaaaaattagcatggcggcacacatctgtaatcctagctacttggcaggctgaggtgagaagatcattggagtttaggaattggaggctgcagtgagccatgagtatgccactgcactccagcctgggggacagagcaagaccctgcctcaaaaaaaaaaaaaaaaaa

SEQ ID NO: 18 - DNA, 98047 bp, Homo sapiens
gggaggcggggcgggccgtaggcaaagggaggtggggaggcggtggccggcgactccccgcgccccgctcgccccccggcccttcccgcggtgctcggcctcgttcctttcctcctccgctccctccgtcttccatacccgccccgcgcggctttcggccggcgtgcctcgcgccctaacgggcggctggaggcgccaatcagcgggcggcagggtgccagccccggggctgcgccggcgaatcggcggggcccgcggcccagggtggcaggcgggtctacccgcgcggccgcggcggcggagaagcagctcgccagccagcagcccgccagccgccgggaggtgggtgcgtggcgccgcggcggccggcggccgagggcggagggcggaagcggaggtgggctggcgggggagggcgcggccgtgcgggcggccggtagggctgcgggcgcgcgcctgaggggaggaggggcagcgcgggcgcgcgcgtcctcaccccctccttccccgcgggcggcggccaggctccctcccctccccttccctctcctcccctcccctcccctctcttcccctaccctcccgcgcgcccgggccgccggccgggcccgggcctgggggcggggcgggaagacggcggccgggagtgttttcagttccgcctccaatcgcccattcccctcttcccctcccagccccctccatcccatcggaagaggaaggaacaaaaggtcccggaccccccggatctgacggggcgggacctggcgccaccttgcaggtaaagcctgggcgcccgcgggcctccagctagggaagtgtttgcgtgcgtccgcggccggggcgatgggccgtgtcacatggccgctgcgggtgggggctggggtgtggtgagttcgggggctgtgggtgcgccggcccgggcgtgcgggttcggggccggagagccgggaagggacggggctcggttgcactgcgctgccgcccaggctgacgggggcgggggctgcctgcgtcccttcccctcgctgctctcacactccatagtttgtggttctgatttttaaagccgaagggccagagctcttgtttcaggagttgtggggaagccttgttagggacgcgtaatactttgcctccactttttttttttggtctcgtaacctttgttaacagtggtagtctcgggttttccatggcttgtgtgtactcacaaacacgcacacagctgataactctgtgatcatccttcactcacttgtgaaagttgttctgcgggtggagcctattagtttttatcacacgcctttggaaagccctcgaagtgatttctcgtatttcaaacttggtttttaaaattgcaacttactttgttctcttggagggggatattgtctttgggtcaggtacttttgtcttttacttatccttaaaatgtccttttgatcctaaacagaaaaagaatgcctgggttggttttgttattcctttctcttgaccctttaaaagcaaaataccaccagtgtgttgtcaaccatacctttaaaaaagaaatttccaggtaaaacgaatttgcaagcagcattttccatcaaagtcatgtcttgtttgttgcaatttggactatcttaaatttgggtttgtgaaacttttaaaacgacatgtgtaaaataattgttaataaataaataacttggaataattacatctttttagaaatggtctttgaaatgtgatttaatttccaaaattctttttctctcttctgacttcatatgaattgaacctgatagtttcgtatgaatgaatcgctgataggatgttttccttgagcctagtaataaatttgctcttattatgctgaaaatttgctattctactttaacaccctttaaaaagtttccatcttacagagaagttagtcaaatagttaaatggagtttcaacagttttaatacatgaattagtgaagcagatgaagcagagatgggagaagtaatttaaaatgggcttcataaatgtaccatagtttgagggtatttaaaaaatttgccttcggaaaacccatacaagatatttaaagaatttcctctgccagaaggtcatttagcaaacgtttatattaaattcaaaagtaatacttttatttttaaagttccttagccgttgccgtaaacttagctgtcgtagtaaatataaatagttcacatctttcggcatttctaaagagtgtgcccacttttactataaatattaaactctgctggatttaattgagttcaaggctgttcactggccaggtttaattaatgtaatgtgattggaaacgttcattttggggttttagtaagaaattgctcttagagcttggtttttatacttagccacaccttctaaagtgcggccacaagcattgtaggtgttcaacaaaagtttgggttttcaaggttgtaacctacgtttacttagtcataagtggtcatgtctctacacagtctgtaagtttcatgaaataatagtcttttaagaaactgtgcagggtaatttcctgttgtttgtgtcttatcaggcttggtatgtgttttaactcttgtgtaggaatattggggatggttttggtatttcaacagaactttagtaggaacaaaggttgtttctattctacttcaagatggccagaggttgttgtccccttttcattttcacattgtaaatattagaatcatgttgctataatctttacttcacatttgggggaatatatgtcaatggaaaaactcggtttagctgtgtaaaccgctggccaaagacctattgaatttttacattttgcaaatactgtcagttttaaaagtctttccttgttcttgtttggttttgattctgttggttttgtgctttagggctccaaaaacctcgttttgtagcagcttttttatacaggtgtttttgtaatgcatataaaagctgtatttagtgcagtctggcagatggagatttattcatattcttaggacaaagagtcatttttagagggtagaggggggcatgtcttttagattcttagtcttttgatgggtgtagaagagccatttttaggcccttagtttctgtgagaggtaagatgttttcccctaagtattccaaaggtatgtcagaaaatgtgaaacgtaaggaattcacaaccagttaagagaggttatgagagattatgcatttatatattttattttattttattttgagacggagttcactcttgttgcccaggctggagtgcaatggcacgatctcggctcaccgcaacctccgcctcctgggttcaagcgcttctcctgcctcagcctcctgagtagctgggattacaggcatgcgccaccatgcctggctgattttgtatttttagtagagacggggtttcaccatgttggtcaggctggtctcgaactcccgacctcaggtgatccgcccacctcggcctcccaaagtgctgggattacaggcgtgagtcaccgcgcctggccgatgcatttattttcaacaaatacatttattcatttattcaacaaacagctttttctgtgtgtcaggctctggactaggcaataaagtctcttaacagcaaacaagtacacccctgttccttaatggagttagaaaagtggaaactcatgtcccttgccctattctccagtgtttagagtaagacagttgttagtgtacaaatcaagggcacatgcattactgagccattcctaaagtgagcttgccttgcttcctgtaacatgtagcagatagcactagggaagatgtgaagtgttactcagtgtcactgggaacaatctgtgtattttggggggaccttggcaccagttttgcacagtctatacaaactgaagatacggccagtctttcagaaacatgtttattgctgaacagatgtacacttgtagagctaagcttcatctgaccttaatttgatcacttattgccctttaattacagaagctggttaaggaaagaaagcagagttgaataactcagtgaaaggatcgggaatagtgtaaaaagttagttaaaccgagacccaggattggacagcagtctcatgtagtggaaaggccttgggttttggaatcagagagccctagcctaatattttgtttctcagttacaatactgggcaatttactaccaaccccaggcccttggttttctgacacaaaatggaagtactaaccccttcctcttattcagtgatcacaattcaagtacctagaacattgcctgagatataagggtcctcccaaatgatttcttcctctcttgtagttgtgggtttgttacttgggctctttctaatccaaatgatttgcctacactgttattatggacctattgtaaaatgtatttgagaagcagacaatgaacaacaaaggcctgggatagccaaattgtcccagtccatagcttaaagcttaggagagccttggagacccttaataagaatgtgttggcatttatttaaagtgtttctaacaagcaaagttatctggcttctaaacctgcactagattagaaacaagtagattatgggtactgtgggaggcttagagggggtgtggtgggggctggggagtaggatgttagcctagtgtctcttgtcagaaaaaacagataacagctcggtgaggataatagagataatctacaagacacaaaaatagtcaaagcctgactagcatgtctggggccattgagtgcaggaccagacctgaaagcatagtaatgaatgttcatcaattagcctaaatcatgtttgggaaaatctttttaagagtgcaataatctacgtaatatactttagattgtcactcaggatgattaagaaatgttcttaaaggggttgaagattgtgctatagcttatggcttatttcatgaaagatcacagtagctgttatgaccaagatgtttttcatttgttttgccattcagacagccattcagattccaagctgaaagggtagccagcagtaaagaaaggctgtttcagtgtggtagcaccctatgtcacccctttctttggtgtaagtaatttttttgtcagtctgcaggagtatcatataaattttcacttgtgctttgacagtagtgtatgcttttcactgtgttttgagatagagtatgctcgagatttctaggataaagcaagagtggatagttggccagtctctctgttgagggtttcttgactcttgtcatgtgacttctgcccagtattagcactgataatttttttgatcccctttcttgtaaccttacctcagggttacttcttaaaccatctacaccatcagataattattggtgaccttgtaatatgtagccttggctgtttttaagaatcaggtttttttttagcagtagtacaaaagtactagcctttttggtttaaaaatgcatagttagaggcttattgcttgtcattgatcaattttgatcattttttcaggttggtgtaattgtgatgtattcagttaggacataattcaatgttgattctagatttacatctcaaagatagctcgcagcttcagttcagcaatttcatgtagggagaatataatttttccaagccaggtggatttagacactgcctttagtttggtcagatagccagaaatattagggcaattctgtgtcttctgtgcttgcctcacattgtacagtgtgagtggttctccttggctcagtgggttcctcttatttgtaactgaggcacattgataggacaggtgcttgatgtatctttaggtttgtagtcttaagaaaatagaaattctgacgtgattaattcttatcaaagtttgtgaatttactgtgaaattgtcactaattatcctaggtagccctgtcatttttcaaaatctggttttacattggcctcaaggctgtagagtagtggaaagcgaggatagactttagttgcttctgtttagtacacgtgtctaccttaatgtaaaaatttgcatttccttgaataatctacagtgtcataccttccctcattttgtggggaagggggatgtagtttcacatttaatgtattcagtaggaataatcttgggtgaaccactggtattccatctgttcattagtttgagtctcttaagtcaaaaaagactcttgatctgaggaagtagcatagtgaatctgtgatcttatagtttgcctatgtttaaaagtaaactacattttcatatgctgcttcagctacttccagaaattctgtagagacataatggttaaggtcttgtaaatatcaaggaaacgttccatcctcatcacgtctttcatttcagaatgtgaggtggtgaggccggaggcagtggctcacgcctgtaatcccagcactttgggaggctgaggcgggcggatcactttgaggtcaggagtttgagaccagcctggccaacatggtgaaaccttgtctctactaaaaatgcaaaaattagctgggtgtggtggcgggtacctgtagtcccagctgctcaagaggctgaggtaggagacttgcttgaaccggggaggccgaggttgcagttagccgagatcccgcgactgctctccagcctgggagacagagcaagactccgtctcaaaaaaaaaaaagaaaaaaaagaaaatgtggggtggcaaatcttttttgcagagcctcctatataaaatcctcataaatgatgcagtggaagctgggcccgtgagccttctgccttgacttgagtgaactattgaaactcttttgttgactagagatactttatctgtggtagtaaatgtaaattttccttattgagatccacttttaaaattctttttttttttttttttgagacggagttttgctcctgttgcccaggctggagtgcagtggtgcgatcttggctcactgcaacctccgcctcctaggttcaagcagttctcctgcctcagcctcctgagtagctaggattacaggcatgcgccaccatgtccggctaattttgtatttttaatagaaacggggtttcaccatgttggtcaggctggtctcgaactcctgacctcaggtgattcgcccaccttggcctcccaaagtgttgggattacatgcgtgagccactgcgcccggcctaaaattcttaatagacaggtagttaggttgtagttcatgttagctgatcaattaaacttttttttaaaaaatgttttagttatcaggagggtccagctttggcctgaggttgtgcattggccatttctgctcgaaaccagtagtagtcagacttaaaacatgtgcacacctgcacacacagcagcaactagaaagcctttagagagaaatatgcagaatttcgaaatgtaaaacagataaaaggagtaaagctgttttgtggaaggaagaataggcagttgttgaagtcctgcctgatcagttttcctctcatcctcaccaccaggaagcctttgaagcacagctgaagaacagtaggtcttggagaaatttttgctgtagacctgctctatcttaacaggtagctgccagccacatgtggctatttagcacttgaaatgtggctgctgtgactgagaaactgaatgttaaattttacttaatctaaatttagatagccatatgcagctgatggctactgtattagacagcacagatacccaaggacatttacatcattgtataaagttgtgttgggtggcactactctagactttgctttaattgagcttttatggcctgaggaccccactcacgtgaattgacgtggtattagttgctgcttcagaagagggtcaggatagactttgggaatttgaagagcaattagagtacttgtactttatatttgtgctgatttgagtctgggcctgtgtagtgttgtcataggtgctttttttttttttttaataatctgggaatgataaaccaatatgtaagttacgtgtttacaagttgattatagagttgtggattccacaaaactcattataggtgataggaatataactcttagttaaaaaaaaaaaaataagtagtctctttacacagcagtccctatttaatgtggacttttgctaaaataataattttcttgaattaaattcaagcttgcattaggtttgacagtccataaagttgaacacatgaatgttttctgtttgcttttgtttaaaagacatgacccatcattctccatgggggccgacctaggtttccagttggcagtgtctttccttactagcttacgctttggagagaacatagttgtagtgagaattgaaaaatctgtttttaaaaaattgggttttatgtattttaatttttttgaggttttctattatcctggttactaatgaattatttatttgactaaaacagttatacaattccaggtcattgatgctgctgtttttttctctgccttgtagtatgtttgaacatagattgctaaaaatctcggtctccacagaggattggttccgggactctcctgcaagcaccagaatatgagaacgctgaagtcccttgtataaaatggtgtagaatttgttttatgcacattttattgttattctttaaatcctctctagattacttaatatctaatacaatgtaaatagttgttattctatattgttttagaaatgatgagaaaaaagtctgtacatgttcagtacagtcacagttttttcctgaatattttttatccatggttggtttaatccatgtatttggaacccacagataaggaggattgactgcacagtgattttatattatttctagtgggaccttagatgttctagatgaggcagcaccatcatatttaaagtatttttgttgaaataattaactttggttttctttctaaataaaaattcacataggtatttggggaatattttgtattttcctgcagtttgaagatttgaaatttctcttccctccataccttttaaaagtgcaatctacttttgctttctacatttaatcactatctgttcttgacttcaactttgcaaacatattttttaaccattctttttcacatttcccttcctactggccttccggatgaactgtcaagtttagcagtcttttctcagtgatcatactttcttcagtgtttgctgttattgtttatactgtctttatctaaatttcttaaaatgacacagacacaagttaggcccattcttcttactgtaaacagatgaaaatgttggataaaatataaaagttttctcttatgtatacagttgatcttgagagagaaagtgcccaggtactagaaacttagaaaaatcagtcaactttaagggaagtgtggccttgggggatttactagagataagattcagtagttggggctgaggttataatgccattcaatgaaaggagacagaactgtgggaactgtgtgcttaaaaaaattaaaaaatgaaaagtgttctggtatcattgaaacatctggggcttcttggagaaagaagcctcagacctctctatggaggaactggaaaaacagtaggctttagatggactttaatatcacagcaaggcaaggcagggtacatgaaaacatctacagctgcatgtggaatagtgaatttttgtatacataatccatgactgcaatccaaaattcagggatacccagtgaagagtctctttactggtctgttctttgccatacagttgccttttcaaaggcaagtagctttactaggtttttgtgtggtgttccagagattttatgcatctatgaacaattttgtgtgtatattaccttttagtacaagtggtcacatatgtcacttaatagtacatcttattttgtgtcagtatgtaatgaatgcctttcttcttttttggagtagtgggttgtataatattcttttgtatgggtgtctgtaaatttttttttgagacagtgtctcactctgtcacccaggctggagtgcagtggtgtgatcacagctcactgcaaccttgactgccaggggtcaagttaatctcccacctcagctacctgagtagttgggactgcaggcgcatgcctaccatatccagctaatttttaaaattttttgtagaggtggggtttcgccatgttgcctagatttgtcttgaactcctgggctcaagcgatttgcctgccacggcccctcaaagttttgggattacaggcgtaagccactgtgcctggccgggtgtctgaatatatcatcagtcctctgttgaatgtttccagtcttgtggtattaaaaacaatgctacaacaaataacttcgtttatatagcattttgctcctttgcaggtatgtctgtaagatagatttctaggagtagttcaaagaatatctacatttgtaatttattttagagaatgtactttattcattttttcgaataacacatgcacatggtataaaagtcaaggagaacaaaatagcaaatactgaaaaaagtaagcctcctttacatctcctacctcctgctgcccagttgtgctttccagaaatgtaaccactgttactagcttttcgtttatccttctagagttgctctgtccagtatgatagccactagccaccatgtggctattgagctcttgaaattgagatggaccacaagcataaaatacacaccaattttctaacagtacaaaaacagaatgttaaatatttcaatggtttttaatacggattgcgaattgaaatagtattttggatatattgggttagattaataaaattattaaattatgatttcatcttgtaattcccgctgtgatggcatcaggaaatgggatctttgggagatattgaggtcaggagggtagagccctcatgaatgggattagtgcctttataaaagagaccgttgttagcattctgtcctccatgtgtagatacctgaaaaaagcggcagtctgcaacccagaagagggccttacttggaacctaaccatgctggtaccctgatctcggacttgcagcctccggaactgtgagaaataaatttctgttgtttataagccacctagtctgtagtactttgttataccgtcctgaactgactaaagcacaccaatttttacttttttaatgtggctgatagaaaatttaacaatatgtggtttgcatcctgtttctgttggatagcactggtctaaagaaatccatacatatataaacatgtactaacataagaattccacttaggcaaaatttttttcttttgcgttgtaatctttggaatcagaaatctgctgagatattggtaaagagtggtacaaagctgttctttatggccccatcagtcacccccatccatttatcatttggctctaatcagtgaaggttatgcttccattgacttctacagtgttcactttggagagaaggctgccgttgttttggcttcgtcttttttagcttgctccgatttgcactggttgcctctacacctagtacgccgcagtcattctgagatttccccctcactagcatattagggattgccttcattttttcttctttgttagatctcctattctttgtgtgtgtgtgtgtgtgtgtgtgtgtgtgtgtgtgtgtgtgtgtgtgtgtatttttttttttgagacaaggtcacactctgttgtctagttggagtgtagtagggtgatcatggctcactgcagccttgcactcctgggttcgagtgtagatcgtattcctttttgttttactagtatctccttttgatgagacatattcttcaggaccttcctggagagtgtgttgggggtggggcggtaaatacttggagatgttgcatgtctgaaaatgcctttgttctggctaacataagtctaggttggaaatttttttttgaaaaattatgaagcccagaattacgaagccattgctctcttgactttgtttacagtatactgttgacaaaaccaaagccattttgattgttttctatataacctattttttttcctccttggaaactttaagccctttctttgtctttggcattctggttttgctaccatgggccttcatgtaggtttgttttcatctgttttactggggtcttgatgggccctttccatctagaaactcccatctttcagttcaggggctttttcttaatttatctatttgactcccctactctgcatctctgtttggaactgttgttgggacattggacctctggaaccagtcttccaatttttttcattttctctactgtttcccatctttcttttctactttctggaagatttcttctactttatcttctagcacttctattgatttttttcccccgtttctgctgtcaagctatgcaagagctgttaagttctctgaatgctgcctttgagagcatgctgctctttcttcagggttgctcagtcttatttctctggccatgttgatgttttaaaaatgttttctttctctgtatagtcttttcctgaagctgaatttttctggttttgtttgacgtttttcctcagataaagtaattcttaagaagtggggatctaaaaagctgatcaaaaactcaacatgtgggtgaaacttgtctcctttcagtttcactggagagggatctgagcaggcaggctgtttgttggtaaactcccaatattagcatctatatgcctttcctcctgggtcggtcaggtaccctagtgaagtcttttgatctgaataactgggcggaggtctggctgctagtatttgggagccaaaacccagtggaggaaggggtttgggagtcgacatttaacacagcgtgctcatgttcattcacaccctcttttcttcctacttatacccaggccatctcctagtccagggattttgttttcccctttgcagaaagtaaacgttgaggcagaggattagttatccagagacagtaggggcggaaatctaagaactgaattcctttctacaaagctcttaacaagtgctacctattattccttcccctgcctggccctcagttcctgccgtgacttgctgttggttccttaactttttgaggtttctgtgttaatcaatggttttcagcttttcctacagctagcctagagttagtagtttctgatctgttcaattactgctcacccattttccagccattaaaattttgcttctgttttctccttacctcttctccctatcctcatgaggtttctggtttttaaaaattcccttggttaggcgtggtggctcatgcctgtaatcctagcactttgggaggctgaggcaggaggattggttgagtccaggagttcaagcctagacaacatagggagaacccatatcttaaaaaaaaaattctttatggttttcaataggctgttttcatctacaatgcaatgatgagttaaagttttccattaaaaatttttttaccaataactctccaaaagaattgaaatagaataacgtataactccaagtcagtggggatgaggggtggaaataaagagaaattgatcactccagtataaggcagggaagaagaaaaaagaaaagaaaaatgcataggtattagaaaacacaaaataagatggtagaaaataagctgaaatatctccataaacccaatatgtaatctcagattaaacttgctggctaaaggagaacaaaaatttaaaaaatccaaccaactgtattttacaagtggagatactcctaaaagtatgatgacatagtttaaaagcaaaggaatggaaaagatatactaggtgtaatttataaggtaaaattggaagaattacaggtataaatcaaatctataatcgtagtagaaaattttaatatacctctcagtaatttatgaaagggtagatttaaaaaactacaaggttatgaaggattggaagagtacaattagcaagcacccaacaattacagaagatacattctgtaaggggaatcgcttgaacccaggaggcagaggttgcagtgagccgagatcataccactgcactccaggctgggcgacagagcgagactccgtctcaacaacgacaacaaaaatagtgtcagcgagactctgtctcaacaacgacaacaacaaaaatagtgtctttgatttagtgcatgtaactaagttgaaaagagtgccaagactgatagaggagaaaaagaatgtacaaatgtattggaaatgaagggatggtataactgcagacaaactgagattttaaaactgcaagaatactgtgaacagttttatttctttaaatttggaaacaggtaaagtggacaatttctagcaaaacaaattaccaagttggcttaataagaattagaaacttcactagattatgatttaaaaacttagtcatgtttagaaatatacctataccaggcggggcatggtggctaccactttgggaggccaaggtgggcgatcacttgaagtcagcagtttgagaccagcctggccaacatggtgaagccctatctctatcaaaaatacaaaaattagccaagcatggttgcagtcgcctgtaatcccagctaatcaggtggctgaggcagagcccaggagacagaggttgcagtgagacaagatcgtgccactgcactccagcctgggcgacagagtgagactctgtctcaaaacaaaacaaaacaaaacaaaataaataaataaatatacctgtaccaatgtaaaattttaagtcctcaagcaaaacaccagactacaaatgaagaccccgtatgggcaagtgcaaccaaacgtgagggattaactctaatcttatacaaaatgttacagaaaaattattttgcaaggctactataatcttgataccccaaccagatagtgtgagaaggggatataggctgcattctcaccaaagaacatggcaataaaaattgtagtttgtaaaatgttagtatttactcaaaacaaaaataccatgactaattagggtttgtctcaggaatgtagggatgattaagcattagaaaactcgtaaatgaaattcatcatgttaacacattaaaggagaaaggccatatgataattttgatggacaacgggaaagcatatgataacatttagtacttgttcatgacaaaaattcttaggaaatgaatacaagagaactttcaaaagggtgttaaaaaacacagaagagtacatacggtataattccatctatatgaatttctggaacaggtaaaattaatagtaatagaagtcagtagttgcctgacgggggaaggtggattgactgaaaaggaacgtaagggagacatctgaggtgctggaaatgttgtttttttggggattgtggttacattagtgtaaacatttgttagaattattgatttcatgcccactcacggttcgcgaccctcagtttagagaaattgtagagtgcagcatatggtgaaatgtcttttttagcaaagtgtgtgtgtatatactaggttgcatgtaaaatgtacttttcactgtgggactttttttggttaaaaagtttgaaagtttgaaattttctgccctagaagagcttttacatggtataaaatgatatataccagcctattcatagcaggttgtgagagaggaaaattggaaacctaactagtcatccagagtgaatggacagtgaactgtgctagtcataaaatggaatgccatgtgacagctaaaatgaatgaactaggatttaggattatgtatgtatcagcatggactgaacagtatcacactttcatataaatttataaaatgtacagaactgtattgtatggatacaatatgtagcaaaactgttaaatgaccatgggggaacatcaggatagtgataatctctgagaagcaagagggagggaaatgttatcaaagaggaatacatagggggctttagctgtattcgtatcttatttcttatgtctgatcaagtactgcaaaatgctaagatatgacagctagatggaaagtacatgagtgttgagtgtaatatttttgtgtaattaaagtccccatttacaataaaaaccaagatacctggagaaataagtaaatttgacaagatgtaagattttttatggagaaaatatgcaacttatcaatagataataaataaatggaaatactcatttgcatagtcggagtacttgatatcataaatatgttctccataaactaatataaattcattgcacttccaatcaaaatcctataggatttttgtagaacatgctaaacttaaagtaaccagcaatactacacatctgaaaaataaggaaggggggtcaccctgacaaatatcaagactaactagaaagcagtagtaattaatattttcttacattgatgttaagtgtgaacaaataacagaatgcgtgtgatcagacctttagtaggaatttgttatgcgacagaagtggcattatgacttagcaaaaggtaagctttaatacacaggctgtccttatgagagatggttagatcactgtctcacctcttaaaaccaaatttctgatctttcttttagaaacttaatatgaaaagtaaactaaagcatccataagaatatctagaggggattctctgtattacgtcagggtatttatttgtgcctcacattcttcatttgtaaataatagtacctaaccccagttggttcttaggattcggaattcttgcttactggactcttaggcttaagcactcaataaatgtttcctactatatttagaggcacagcaagatttctttgaaaagcaaggttgtggcataaaagatttttaattaaaatacagctttgtgtgttccaaaagacaacataaaatgaaaagtcattctaaggatttggagatttttttgtaatacatactcagtgatagggtttatgtcagaataaaaacagtaagaaaaggaccacatagttgaggactctggaaagagtatgcactgttgtttaattaaatgtgcagagaatgctatttgtcaaactataatatagagttaataacttgaaggctttactacaagttcaggataattagacctcttaccttattgaaactttccggtgagtaatcgtagaatcctaattttactaaggtatcatttggtaagctgacttattcagctgtaaagatagtctttgtgttcttttgaaatctgcattatgtaagtatcacttattgctggaattagaaatagtgtctgaacttagatttcaattcttgcagatgttgaaaatttatttcagtagagaacttgctgccacaccattgaaggaaatctgtatattctgtaaatgactcattcacgttttgatagcaacttgattataaatctagttttcttttttgtatttcatttgtttttaacctggaacacattgttatctgttccttgtcagcctacattcagtctatttacacttcaaaaatattggctaaaaatgcttcagtttttaaaataaaagcttaactaattgaagatgtattatcagcattacttacaacaaatgttattttattacataatttaaaaattctccggagatattagacagatgtcagccaaccatggttactgagacatgcaaaggtaaggctggcaactttaagtgttcacttagttccaaaatggttttaactcctcttgtaagacatgggacactgaaatcatgtggcaataccaggtcatgtggccattcagatgacccagaataggcctaaacttaagttagtttcatttcagtgaagaaacaatattgtaaaggttttatagaaaacttttagatccccaggaatacagcttaactcataagaaacatttctcctaacgaaagtgtaacaggctgggcgctgtggctcatgcctgtaatccctgtgctttgggaggccgaggcggatggatcatctgaggtcaggagtttgagaccagcctggccaatatggtgaaaccccatctctactaaaaacacaaaaaattagccgagcgtgttgacgcgtgcctgtaatcccagctactccggaggctgaggcaggagaactgcttgaacctgggaggtggaggttgcagtgagctgaggtcacgccattgcactccaacctgggcaacaagagtgaaactcctcaaaaaaaaaaagtgttacagaaactgtttactctcattcctcctaatgctggaaatcccttttttttttttttttttttttgctgtttatacagaagtttcattttttattctttttttaggctaaattcttatgaatggaataattgaaccaaagatacagatacttgtagggagattcttttattttgctttttctatcagtttttcacaaggaacagagagattactcatgctaactcaaaaagaggttttgttctgaggatataattgtggagctggaacaggcctggacagtcctcagaaaccaagcctagagattggctgctctgcttttcttcaagacaccagttgtctctgcctagctctggcacacactcttacttgtacactgactgctagctcccctgagtctactatattttatgctgcctcctggccatgtgatgaacatagttacttacataaaggcatgtataaaactgaccctttagccttcagggttgcttctctttcctcattcctaatagtgatgaatgtaccattacatgccactcagttacattaggtagtcggtcacattagttgtgtttcaatccttttccctaaactgcacgtccagtaggtcattcaaaatgcaaattgtcactggaataaatgaagtaatactcctatcattagcagtaatttctgtcttcagctctttaatctgcactggccttattttcccctcatcttctgccacagtgcttcctgtgcaccgtattttagtgataacctaaatttttcgtctctcctaaaacgtttcctgtctttagaaaacatgctgaactttctgcctgctgtactatctctctcaatacttgtgctctggtgtcaactttagtgtcacctttcccttccaaaggttgaatcctgttctctgtgctaggataagactgtgtcacatgatactacggtgtctgtagttggctcctctagagcatactttgtggcacagagtaggaatccaacaggggccaaaggtagccaagtacactttttgctgcctgatagtcccaggttattagttggtagatgattacatgcgtttgatggagttttgtgtatttgctttattttatcaagttacatactacagtgcttatttatgtgtcgtattataggtctaccactatagacagtttaaccgggctgttaagttcactgttgctcttttatttgcattacagttccctaattctatgcaaacctcactttcccaccatttctactatattgctaaagaaagttacataatcctattattgactcctttcaaatttttagtgtttgaaccctagttggactcccaaggttgccaatgcagtattgttatgtggcattccatacatccctaaaaagggttgacatggccaaatttatgaaatttatgaaatttggcatgctgtgttgcctcttcctggagggaggccttggggccagtctcctgaattgagcttgaggatgcattgattttttttctgtttcgaggggcgtgagtatgattatattaggttatggccattattttctttttttttttttttccagatggagtctcgctctgttgcccagactagagtgcagtggcgtggttttggctcactgcaacctctgcctcccaggttcaagcgattctcctgcctcagcctcacgagtagttgggactacaggcactcgccaccacgcccagctaatttttgtatttttagtagacatggggtttcaccatgttggtcaggctagttctcgaatgcctgacctcgtgatccaaccgcctctgcctctcaaagtgctgggattacaggcgtgagccaccacgcctggcagttatggccattattttctagcaaattataccaagggctgaatatcctcagtttgaggaccttttttgagaacattcttttgataatttaaagtccttttttgagcttttatttaatgtttcttttttagtaaatatacagttgacccttgaacaatggggtggttggggtgctgtcctgcacagtgaagaatctgtgtataacttttgactctcctaaaacttacgacctactgttgactggaagccttaccaatacataaacagttgattaacccatattttgcatgtcacatgcatgataaactgtattctttaagctagagaaaagaaacctactaagaaaatcataaggaagagaaaatacatatactattcactaagtggaagtggatcatcatgaaggtcttcatcctcattgtcttcactctgagtaggctgaggagtggttggtcatgctgtctcacaggtagaagaggcagactgggagtcaggcacattcagtgtaactttatgaaaataagcaatttttgcctgactttttgcattttcatttctccaaaaatgtttctgtgtggtaccagtcctccttacaccttttgctttagtttcagtgcccatgtaatggaaggatctgtgttataaaagaagtcaaaagcagccttcaataattagaaccctatattatatatagctagattgtcctatgtcaatttgttttctggcactgcttcttctgcatcttcttcctcatcatctggagctagtttagaagcactgatctctgttacgtcgtcttctgttaattcctctgatgtgtggagtctgttagcccttgaatttctctaaaaagatccatctcttgaagcccttcactccccacttttttttttttttttccatatccacaatctcttatgatttcctcgataggctctggtgtaaatgctgtgaagtcgggcacatctggatactgttttctctagtaggaatgtatcattttggacttgatggctttcatggttttttctataacagcaatggcatcttccatggcgtaatccttccatactttgatgacactctatcagagttcttttttgtaacattgacggtcttttccatggagtactgtgtgtaatgagccttaaaggtccttatgactccctgatttagagatgttattaatgtgttcagggacaagtagatcactttgacatatttggtgttggaatcatgggattgtgggttaccagcgacattgtccaatgtcaaaagaactttaaaaggcagtcttttactggcagggtacttgacttcagggacaaagcattgatggaacgaatccagagaaaagcgttctggttgccctggcctttttgttgtggcagccggtgtttatcttttcccttcaaggattggaggtcagcagctttatagagaagggcagtgctgatcataaacctggacatatttgcacaaaacagtagagttagcctgtcctttcctacctcagatctggtgcttgtttctctttttgctaataaatgtcctttgtggcagttttttcccctagaatacagcacttgcgcctgcattaaaaacccgttcaggcagataccctttctcctcagtgattttcttaatggtgcctaggaactaactcatctactttggttgacagaagctcctttcctgttatcttgacattttttaagccagcctgtttctaaattctcaaccatcttttgatttcattaaattttccagctttagatccttcaccttaattttgctttaagttgtcatataatgactccgctttttctcaaaccatgtaatagtctataggtacgcctttctttatagcaatcctgtacctacataaaacctgcattttcaatatgagatcaaaagttgtttcacaaaaggtgcaagatcttcacacctgttggcctagctgcagtggcagcttcacaaattttcttttttttttttttttagctgtagttcttacactggattcatttatcttgaaatggtgggcaactgcagctgcagacctcagtctgtggtacataccaagcaattggagtttttcttgtaatgtcatgatttttctctgcttcttgggagcactgtcagcatcactagtggcacatcgtatggatctcatggtattagtcaaggcttatggtattgcactacacatggtgaaaattacatgagaaatgtgagagatcactttttactgtgataatttactggagagaagaactgctcatgcagagatgattagcctcacacagtggatactcgcaacacttccgctcaccgtgatagcaacaggaggtggcgatgaaattattacagtagtacagtatgtactaccgttaattttatgtagttaatgatttaatacttcatctgaatgtttacatttctcaactgtaaatggctccatgtatggtctgtgtttgtgtaagttttgataaattttaactttttatagtagatttttgtatttcatgatggtaaatgatagagtagtatctacatatcttttatgctttataacatacctttttcttagtttttttcagtgtttctaggctacctggtttatgagtttttttcagattgtctcaaatctccaagacattttgcaatgtttcttgaataaaatctgtgtataaatggacctatacagtttaaacccatgttgtccacgggtcaattatatagctctgttacaacaaccattttgtcagtgcctcatgtatgtttgtgatggctgtcatttgggctctcaatttttgtcctcaaaacaataccccttccaccctccatccacgaacatttgcctacatgtacttgcagaggctatctgcatgttgtggacggaaacttccaagcttacatctttggtcacttgcaacctcctcccttctgaaatttgtaatgtgcattggcatgttgaagcttttgagaagttcttcagtaaagaagtctatttaacttaatttaggaacttcttaatgtgtttgtccaggcaccttttaaatttttttgaattgtaatttacattgctaaaatgcacagacttcaaatgttcagttctgtgagtgtttttgagatagagtctcactctctcgcccagggtgctggagtgcagtggcacgatctcggctcactgcagcctctgcctcctgggctctagtgatcctttcaagtagctaggagtatagacatgcacatggctaacttttttctgtattttttgtagagacagggtttcgccatgttgctcatactggtcttgaactccagaaatcaagcaatctgtctgcctcagcctcccaaagtgctgggattataggtgtgagccactgggctcggccagttctgtgagttttggtaacttgtactcatgtgtgattacctctcaagatagaaaacattcaggaattcaacagtggatttacaggagcgagggaataaaacaaagatagagaacacttttgtcaccgtagaaaggtactttgtgcttctgtccaaacatttccacttctcttccttagtgcctctgagatggtcatcttgacttgtcattagattagttttgcctgttgtgggaagccatgaatgaaatcagtctatatttctttgtcttttgcccagcatgtttttgagactgatccgtgttgtggagtgtataagctcattcatatttgttcctgagcagtattcctttttatgagcacactataattatttgttttcttttgatattttggctgtttttagtttttggcgattattaacatggctactatgaacattcttatacaggtttctttttgtggacatacgtatttatttttcctgaatgtgtgatacagggtagatctatgtttaactttttggaacttgccggttttccaattgtgctatataccattttatactttcatttcagcagtttatgaatgttctagttgcttgatgtggtagactgaatcatggtctccaaagatattcaggttctaatcccaagaacctgtgaatgttgttttatatggcaagagagactttacagatgtgattaaattaaggatcttgagatggagagatgatcctggattatctgggtgggctttaaatgtaatgccaagagctcttactagaaggccatagagggagatttgaatacagaagagaaggcagtgtgacgatggaagcagagattggaatgatgtgctctgaaggtgggggagagagcacaagctaagggaagggagcacaagctaaagactacaggtaaccactagaagctgaaaaaggcaaggacgaacttcccctcagacactccaggaggaatcagtcctgccaacactgtgactgtagttcattgaaactgattttgctaaatttgtgctgtgattgcgattatttgttacagcagcagtagtatactaatacactccacatcttcatcaacatttagtagtgtcagaaaaattttaaaccattctagatggtgtgaaatggtattgcattatggttttagtttgcgttttcctgatgattggtgatactaaatacctcttcatgtgctcctgtgtcttttatgacatgtctattattcttttcctgtttaacaaaaaagctgagcttacctttttgtgtgatttttaaattttgttggtttatgttacatacacagatttgagtatcccttatccaaaatgcttgggacccgaagtggttcagattttttccaatttttagaatatttgcattatagctgtatagtacaatgaccgtttttttgggggtgtcatgttggtactcaagaagtttcagattttggagcattttagatttcagttttcggatttgtgatgctcagcctgtattttttttttctttttctatttctttttttttctttttgagacatggtcttgttctgccactcagcctggagtgcaatggagtgatcttggctcactgcagcctccgcacccctgtgctcaaatgatcctcccacctcagcctcctaactgggagcacaggaggcaccacgcccagctattttttttgtattttttgttttttagtagagatggggtcttgccatgctgtccaggctggtcttgaacactagagctcaagcagtcctcctattttggcctcccaaagtgctgggattacaggtgtgagccaccatgcgtggctcaactgtatttctcttgtggttaatgctttttatgttttaaggtcatgaatgtattctgtgttttcctctaagagcttaagattctgctttcccattgaagatggtatgcacttgtggttgaggcttgttattttccatgttgttgaaaagttgttgaaaactagattgaccttgggccttactggaaaatgagttgactgtatatgtgtgggtctatttctagacttgttctgttccactgatctttttttcttatgcctactctatactcttgattactaagtctttttagtaagccttgaaataaggtggtgtaaggcctccagttttctttttcaagaatggtttggttattctagtttttttttttgtttccatatgaattttatatcatatgaattgcttaactctgctggaagtttggtagggattacattgaatccatatatcaaattggaaagaatggacatttaagcaatatgaatcttcaagtctatgaacatgatctctctttgttcagtgtttttcatttttcttagcaatattttgtaattcttagtgttgagatcttgagtatctttctttagatatgtagaaaatatctgttgtttcaagcgtatttcttgaaatttcattttccaaatcttgaccctttatcttgaaaccttgctaaatttacttactagttccagtaagtagattacttgtagattccatgcacttttccatggagacagtcatatcactgtagaatataaagtcagttttatttatttctttccagtctatcttttctttgttgcatagttgtcctgtctacaatatccaatgcattactgaatagaaagggtaaccgtggacatctttgtcttattcccagttgtaagggagagatttaatgtttctttatgacatatgctagctctaggtttttcatagatgtccttttcagattgaagaacattcttttctagtgttgctgggagttttaaattatagatgagtgttgaattaacattttcagataccttttttctcgctcatttgagagaatcataggtgcgttttctcctttgtactataaatgaggtgcttgatttttgaatgttaaaccaattttgctccttgggataaatcctacttagtgatgatgaccttttctattatgttgctggatgtgatttgctaatattttgtttaggatttttgcatctagtagtaacagacctttgctgtgtattagtacgggatcttgggcccaagccggcttgttgtccctttttcagtatcagacagctgttgcttctcattcctcagcatctgtgtgcctttgtctgggactggtggtagcaatgtttcctcccttcccgtggcagtagaatatggtggttattgttacagagtgaaaggcatgtttgtgtgtgggagatgggcaagtaagttttgctccacaaatcccccaactcagcagcacatgtcttttgctctacccttccctttgaggcaggggatctttgcttgcccttgggtttggtagactttcctgcctctcccgtcatagttgaaggcatttgcttcatacgagatgccaccaaatgggaggaaggagctctcttccgttttctgccttttttcaagagcactcagttgaggcccttggaaaagagcttgtgaatgagtgcagattctctttctatcgaggactcccagggattttaactgttatcctagctcggcctttcatccttacttttatctttaatattcagcaggttgaccatgaatgtgttttctttccatatgtggattaatatctgtcatctcttgaaaagtttatggccattatctcttcatacatttttttgttccccattgtctttcatctttctctggcaccccaattaaacccaactgacatttggttttggatattctgagtcccccccccccccacactgttttttccctctttgtgtttcaatttgcatactttaatttggcctgtcttcaagttcactgctcatttctgttaagcccatctaatggtatccttaatttctaatactatagttttcatttctaacgttttcctgtgatcctcttttgtaactttgatatctgtgatgaagttttttcattattcatgttgctatctcttccatcagtttctttagcatttttattatagttatctgattttattcatgttttgactgtttgctactccctgtatcttgtaatttttgattgaatgctgaacatttgtataaaaacaatggagattgaagtaaataatatttacttttagaaaatggtccatcatttcttgttttgtccaagtgtgattttggatctctttttggtttatagctgagccgtcagctttctgaaccatgagaaatttctctatagctcagctgtcaattccttggtcattcttattttctttccccccaccccctctttctctagtcctgcctccaagcttttgtgcccagtgagacatctttctgctattaataccttccagaggtttcttttagcaatcctaccctgtcttcaagttcgctactcatttcagcctcggtagatcaatgtcctgagtatctgggtgaaagttttctcatctttcctgtcctaccgcagcccttggcagctcaatgtctagactctcttgggatcatctttttctcacctttcttgcctgtccctccccccatcccccattgatgagggtagattttttgcatttatgggagatcttaagctccttaggggatctccctcagctttccagtcctgttccccaagctttgacatactttttgcaagtacttagtggaaacctatggggatgagtggttggggtggatgcacacttgctctgtgggatccttgcaatttaatatgtcatgtcggtgtgcatgtaggctggtttcttctttctttcatttatggcaggattattcctcactagccgctccaccaggaaagagaccatccatgcagcctctcttctctcaaggctcaacacttggaatttagttcttcttaggctgctttgtatcctcaactctggttcagagagaccatgattttgtagcttatctggctagttttgattattagaatgaaagtgatgctctgttgtaactttctacgtcctaatcagaagtggaattccttctatggaatactttttaagtatatagtctgataatacataactgacacgttttctgttgtttcataatggttgattttctcagggctacgtttctctattttttcctgttctcaaatcttaactctccatctctgtcctcaagtggtaagtgatcttgtgtcttattttgaaattaaagtcatcaacaaattatttcaactcatagatttatagttgtggaagacttactattcaaatggaattagaacgttttgggggataggatgcagtagttcttggtagtccaagactcttaataaaacaactagaaaagccaggtaatttacaaaatttatatatttagcgatagagaacaatgggtgtaaaaatgattaaagaaagcaaaattttgcaccctgggggaatacctttcacaagtgagctgagaggtctgcagctgatcattgtttttcctgggtacagagtagaggaggcctttgggctgcagcctgagtggcagattggaaatatgaggggcctttaaacacagagaacgccctcagtatattcctaaattctgtagttcagctgggcggaagagataaaccaaaatctcagaaaaggagattgggatattttctagtcctatggtgttgagataaagattctctaggggaagcgacttgagaacaataggtgagagttgaaagcgtttgaggaagtggtgaatacacactgatgattttcaacacacccagtttcttcccccgtagacatttgccaaattctgaagctgcttaggctagagagctaaaccagaagtctcttaaaaacaaagcaattcttatagtatctaggtacctagaagataacgatctgctagcttttgaaatgaaggctctgcagagtctcatcctaggaacagggacaaaccagaggtagtctccttcatagcaaaactgctactcagcagtgttctatgattctggcattatagaggaagtagtaaaagtatatgtatgaaaattgtgttaagtgaaggatgaataagaaaatatctagggtaaccactaaaagaaaagaatgtaacaaatgaatacagaaaaaaattggatatagaatatgtgataaattcagaagaagacaagaaagaaaatataaaacaagcaggcaactaaattagtaattatgttacatggaaatgggctaaatatttcaagtaaatggcaaaaatcatcagactggacaaataataattacctaaatataagtacctagaaagattgagagaaaatgatgcgaaaaggtataccatccaaatgctaactgaaggaaataagtgtggctataccaatcaggcaaaggagactttaatacaataaacagtagtagaaaaagagaactacattttatagtgtaaggggattgatccaccagagttaccacaatcctttatgtgtacccagtaaaatagcccaaacatctataaaccaaaaattttattttgaactaaaagaaacagacaaatatgccatcacaatggatgcacatatataggacatacatacatcacaattagcaggcttgatctaattgtcatatgtagaacattgaaactattaatggtggtattaaccatcttttcccttgcacatggaaattgtactagaattgaccataagctagggccatgaacaaagcctcagcaaatatcattgattttaataattgaatatgttgtttgtattatagtaaataaaaataactagaaaattcctagctgcctagaaataaaacactatgcttttgaataacatatgacttaaaataagaatttatgatggctattagaaaatattttaaactgattgaaaatgaaggtgaactacaatgatctagattgctgctgctgaaatgctaagatgaaatttatagccttaagtctatgcattggaaaagaaagcttttttaaggaggtagaaaaggaataggaaatcaaacctaaagacagtagaagtaaagaaataatgaagacaagagcagaaattagtgaatagaaagtaatcttacatagagaaaattgacaaagctaagaaaaagttggttctttgaaaagattaatgtaattgaccacttagcaaaactgataaaaggaggatggggagggggagagagaacataaatttaaataataggaattgaaaaatgtcacatcactacggatcctacagccgttaaatagaggcatttatgaacagtttatggagaatatgggataggcagagtaggcagaaattttgagtagttagggctggatcattcaatatgggtaggcagcacctttgtgtagctattgagtacttgaaatgtggctagtcctagttgagttgtcctgtaagtgtaaagtactcaacagattttgtagacttagtatgaaaattttttttatattgattgcaggttgaaatgatggcattttggatatattgggttaaatacatcattaaaatgttgcctattttctttccctttttaaaatgtcattagagaacttaaagtacatatgtagctcatattacatttttatagaggttgttatattggctttaagataggtactgttatccttattttacagctgagaaaactggggtgtatagaggttgccatgcagctagtaagtggcatccttgggatttgaacctggccaattggcttcagaatctgttctctgaagcattacactgtttatgggttcttaaaggatattaagtcattttactgttactttttgcaaatattgaaggatttttagtagtagggtgacatgcagtatgcattttagaaagctgtttgcatcaaagaaggtagaaggtggtgactgaaagactagttaaatgatttgtagattgagaaaggagttggagctaaatgtgtcattctaatcctatctaatggactaatttgtcaggcacagatagctctgttgattgtataaagagctcagcctttaatggctctttttaggtctccagattagcttcagattgttatgtgcaacacaatgcattgacacaattaagtacttgttctctggcatcatgctgcttgatataaatcctagtgttggcacttaaaagttgtgttaccatgttgtgttgctataaattgtcctttgtattcatgacacctttctccctaatcatccactttttttccacatttgataactcctttatatgtatttcttagaatttttttttcactgaacttggcgctttctgagctctcccatataccagcattgcgtttcattaccacatgacagtttgatctctctgctaagctccaaacctttgtttctagctgcttatcgggcacctccttctggaatttcatagtcacagcaaatttagtttgactaacacaacacttatgttccccaaatacttcgtattttggcgaattgtattttcattcaactggtttttcaagcaagaacctgtaatttgtaactttttcttaatcaactctgttccttctatgtccctaatagctattcttccttttgtgtattgcaattctctgctggttgatctctctgcccttaaaaacttaccccttctccattccccactgccaataccttgctacaaaggatttcttttgtcctacccgtcccagctcaacagtgtagtttgcagatgaataacacagactggatttgagaataaacaggtaaatacaggcacaatagacaggcaaaaaaaaaaaattgttgaatgcaaaaaggaatgaataaatggcaagctgccaaggaagtgcaaatatttcctcaggaaaatctttcctgacgcctaaagcaaaatcagatggtgtttctttgtgtacctgtaatcccccttgcaatttctcttaattgtcatgtgtattttaatcatggcagtcttcttcactagtcattgaccatcctgagaagagggaatatttaaaaaaaaaaattattcttccatgtggtgcaaaccaaaataatggaattatggagaggttagagcaggaatgcagtttgtgtacattggaaatgaatcttagcatataatctatgaaaattagccatgttctttgatgggaaataaatttgcatcttgtgttaggatcttctttaacgttaagaatatgtgcaaagtgtgcttaaaaactgtttttttcctttaaaaatgttttatccagttttttgtacacacatacacaaaaacatacacaatggccatatcattcagcctttttcatcttttcacccccttttctgcatattggtatatctgcaacccatattaatatcctagatttttgtttatacacgtataatccagttactagttgtaacacgtggcacattgccagattacttagaataaagctgtcacatttgaccttttcaccagcaatgtggaatgataacaatttcttcacatcttctccagcagtaggtattttaattaattcaatttttgccagctagattgggcatgaaatgatgccttattattattttaacttgtacttcctcctctacgtttaaaaactattgtctgatcattatgataattaaggaacaaactaatgaaaatgtaagcatcattgttttcttaaagatacactttgaaaactacaatttcagtatttggggtgtgtgatgtaaagactacagacctctttactttctaaaaaggatgccttttgggaactttattaaatatggcaaattgaacacattcattttcctttttcctatatctcactaaaattgaaggcaaaggaaagaaaagcgtaagagctaagatattaagagcttctggagcgaaacaatttttaaaccccaattaaaggatcaggaataaaagttatgtgggacttaccagtatcagtagtggagtctagaaaattgaggggacagtgctttctaaattctgtgtgaactgataaggaatgacctacagggaattaagcaaaaaaataaaaataaaaaaataatttcaagatatacaaaataaggaatattatgctacttttgtacagcaataaggtgggaatgtggttagttgtatgtatacatgtttatatttgtaaaatgacgctgaatagacaaaacagcttaataaaaatgattcctatggaagagaaaagacaaggtacaattccttaaattgggaagagaaactatctgactttactcactatgcaaattgttatttagatgaaaatgaaaaaaacatgtgttaaaaaatttctctcaagagcaggtgaaaccggactacagcttttctccacggactctgtttgccatgtttatttctttattcttgattacttcacactttacgcattttcccttcttgtaactgtagattttgcctcctattagttatgaaagtttaaaacccgggggagagtgggcttacaaattttcaatgtatttttgtatagtcttttgagattagagtgaagttctaaaaagtaagagaaccttttgtgaaaatattttaattgacactactaagagtttaaaatagtattggtggtgaaaaatcgttaaaagtatctgattttacttgcaaaattactgtattttcccacaagaggagtccttacaacattcttgtttttagaagggtttgtttccatcattcatttaaattcataaagataacgttttcatgggtggagaagtctattgggaaagtcataattcgaatttctatcttgctttgcagtttgctttctatgataagttgaaattattacttgatgttcaaggtagtctctacatcatcctttcaatatttctgctaggttcgatacaagaggctgttttcctagcgtggcttgctgcctttggtaagaacatgtcgtccatcttgccattcacgccgccagttgtgaagagactgctgggatggaagaagtcagctggtgggtctggaggagcaggcggaggagagcagaatgggcaggaagaaaagtggtgtgagaaagcagtgaaaagtctggtgaagaagctaaagaaaacaggacgattagatgagcttgagaaagccatcaccactcaaaactgtaatactaaatgtgttaccataccaaggtaagttttgttagatcccaggtttgatcaaattatgtcaaggaatctgaaggaaagttactgaatttgtgttcctttcaagttgcctgtaaaaagtgatgattgaaatatgactgtttttaaccttgtataaattgtttttgctagctgacttgttttataaattattttcttgaatagtgaggtttaatcaagctaaataagatacttagatttattatcttcattgcctacatttgtatgttatcctcatttccgtgattgaatgatacttgaataaagaattgaagctttttctatcactaacatagtagcaacctacagttttctcctcctttagtcaaaactttcatcaggggtgaaaagaggctgctcactttttaatgaattttatatggtttttctttgcgttgcagcattgcttccaagaaagaatagtgtgttaggtggcttcttaattgttgtaggcattagtcagaacctgtcttaaagacctgcctcttaggttaggaggacctgttactttaaaagtctgaagttttctgaggataaatttaatcatttacagataagtaccactgtcataagtattgttttttaattaagtgacaggtgttttaaagtgtgttttactacttgtgtacattacagattttggggagattgttaaatgtaagaattctctaaaatgatagtttgcagtgtcataccgtgggctagcatatagcatgtgaaaccattctacttgactttgaactttgagaagtacacttttgatgcttatagataacagatcccaataacaccagtgcagcctgtctagttgcaaatactaacagtagaatgtttcttgccttgtttggtagaccatccatttctttcccttacttgttttatgtatatcttaaaggttgcttttttggtttgttgatttgttttacaaatgcttattgagtgtttgctatgtagaaggcactgtttctagacatatgaggataacagtgattaacaaaacacaaaactcctgccttcctaagggatagaaatacacgataaacaagtaaacaaattaattataatttgatatggtaatgagtgcaaagaagacaaccaaatgcagtgatatgatagaatgaagaattaaaaagctgctttgggtcggattgtgatgcttgcgtggagcttggagaagcagcagccaactgagggaagagtcttctaggcagagggaagagccagagtgaagacactgaggtgagcttcttgtattagaatatttaaaaggagcccagtgtagatggaggacaagacttgcccaaagcttatacagggcatcctagagtgtggtgagagtttgaatgttagtctgaatataacaggatgcaagtaagtttattctgatggattttaaagaggatcttacatatttttacaaagatttttctggctgcgggagagtggtatgtgtgtagtagggtagatggaagcaggaaaattaggaggctgtgaggaatctaaatgcaagacgatagaggctggactggcgtggtggctgtgctagcacacgaagtaaacagatttggcatgggttttagaagtggaactgaggacttcctggtgaatgggctgagaagtcaagctatatttcattcttcattgtgtagtgcttgggatttcaattaggtaaccatttatcatatgcccactatgtgcctggtgtgctcttcctcactggagttaagatacagtgtttgcttttaaactacttacttcctagtaagggagataaacttagaaaaagatggtttcatgaggcttggtagatgttataaaagaagtatgcttggggctatatccagaggaggcttgtggaaagtttccttctggaggaatactggtgattttgagttgagcggggtaaaggaggaattaggagaagcctgtttcatcacatgtagtgcggtggtgtggagattgggaggtgggggaggattggtgaagcgttccaaacaagttgggtatccttagagtataaagtaaggggtggcaaatggccatagtgtgtataggtagtaaggagtcacttcatgctgtgccagtgttcacacttaacctgagggtgacgggtgaggttggggccgtttaagtgccgtagggtctgaaggctcagaagtcagattaatttcaagtgcaacgtgggttgcagcgagaaaactccttgaggctgtcaagaatggaggccgggagactggtatcacttgattgaagggagctgtgtgatacagcagagatagagccatgtttttgcacaacttcaacaaggctcaagttgccattgcagtgaggttatccagagcagagcctgagagagtctaatcttttagggaggtacagcagtactaaaattggccattgctggtatttaacctgtggaggaggtcaccttagtcatagctcttttccttatttcccattctttttacagcctcttttggagatagagatctctgagagctcatattctggagctgcttcatcattaaaaacatttttttctgccctctcacctgattaatgaagttgaagtgataattgtccattatcttgtttttcactattgaagtttccttgaagcgtagaaatttgcctaatttggtggtttttttagatgttgcaaaaatggagatttgttattattgatcatggtctatcaaaaaaattttaactttttacacactgtagcttagtgccatatattttataaagcttgtttttagtagtagaacaattaaattgtgtcaggttattagtcatttcttaacaactaaatattcttaaatgtaagaaatttagttggaattcagggaactcatttatatgtagagtgtaaaagatgggaagtgggatggaaaagatttgttatggctaaatccaaaccttagcttaaacagaattattcaaaatgtgatacacaatggatttgtaagcacgtttactcagaatttcaagtaaaatgttagtaaagtgcctttatggttttataagccaaaaaatacaactaagttcagctgatgaagaacgggaaacaaattgcttaattttaagaaatggcaaatgttttctgttgaaatgtttactgaacagttcctcctctctactttcagccccttaatattagagtggggttaaagttagggcagaaacatagtcctggctttgtgtccctcccactcccctcatctcattactcttgttgcctctggcagtttaaaagctgtagttatagatacgtcactgtcgctcccttcccaccattttctgtggtgacacagagtaatttataggtagagcttaacctcaataaaagctgcagtgagctaaataataaaaaatttcaggaagctttttcatctcaaacatttttgagtccgagggatgggagacaacttggtcgtgaaatcagaatggcaattgatatttagataaagaatcagacataaggaaaaagctttcaatatattattatccacagtaaagcaaaattgaaattgcagtggggatggaggtctgtaaagttaaaagtaaggactatggggtctaaaatggctattttataatattgattatacataaatgtataggaatgcaaaatttattttcataagcataaattaaaaggactttcctaaggtggtactctgaccatgtaatcacatttttgatctttcatcccaaggaaataatcagaatattgtcaaagattcctgatgtttgtttcagtatcattttttccaccagtccattggaatctgtattgtttttaatatgaattagaaaaaacccagtcctaacctttagtttctttaataaagaacacttaagcttattttataccacaattaaacaagaatagcgaaagaaaagtttatgccactctttataaacatagatgcaaaagtcataaataaaatatcagaaactagaattcagtggtttattaaaaacaaaaccacaaaaacataactaggcatggtggctcacgcctgtaatcctagcactttgggaggccgaggcaggcagatcacctgaggtcaggagtttcagactagcctggccaacatagtgaaacccggtctctactgaaaatacaaaaactagctgggtgtggtggcatgtgcctgtaatcccagctactcgggaggctgaggcaggagaattgcttgaacccaggaggcacaggttgcggtgagcccagattgagccactgcactgcagcttgggcgatgagcaaaattccgtctcaaaaaaaaaaaaaaaaaaaatgtctaggtaatgtttattgtcattcaaggatgactcaactacaggaaatctattagtataagataccacataatcatatttaagaagcactttatgatcatcatggatccagaaagggctttctataaaatttgctattcatattaacaaattagaaataagagttttcttagcttgataaagcatacttctaaaaatgttaacacttaattatgaacttttagagattaattgaccaaatttttagtaatgagtatgggtgacccagaaaagtcctgtatttttttttctagtatttatatataaaagtatatcacttttatagtcagcacaattaaatgtttaaataggacttttgggcaatttaattcgtgtctatttatgacaagactattcttgtcttttttctttgaagtcagttttttctgttaaaaggcaattctattttttttagcattctgatatttgtatgtttatgactgtttttgccttcaaaaagtgtatttctagccagacgtggcagcattcacctgtagtcccagctgcttgggaggttgaggcaggagggtcacttgagcccagaaattccaggctagtgtgcagtgatcacatctgtgaacagccactgcactccataccgggcaacatagtgagagtctgtccctttaaaaaaaaaaaaagttacttaaaaacataaagtagcatgtacataactgaaaaatcaaccatgattatacggtggaaaaatcagtctccctcccacccctgttttttcatcacccagttttcctctgtagtgaacgttgtattactagttcctcatgtgtccttccaggatgtttctttttaatgctgccattaacatttggattttgttttgcctcttagaaacgagacagagttttgctcttactgcccaggctgcggtgcagtggcgggatctcggctcactgcaacttccgcctcccaggttcaagcgattcacctgcctcagcctcccaagtagctgggattataggcatgcgccaccatgcctgtctaattttgtattttttagtagagacagggtttctccatgttggtcaggctggtttcgaactcctgacctcaggtgacccgcccgcctcggcctcccaaagtgctgggattacaggcatgagccaccatgcccggccacctcttacagacttttaaacatcagagtaattagtaactttatgcagactgtcttggaatagagcagttgtcattaaaaaaactgtcatcttttatttctaacctcatgttcatacccttttgcttctctaggtaaccaggaatagctaaagagaagtctttttgaacccaaactgtagtattcttccattcttaagcaactgctttttcataataggataattctttcttctcattcatacataggcatgtgcgtgtgtctgtctgtatcgtaatatgtatgaaacactatggtggagggaactctgaatttcaagtttgataacctgtttttgtgtcagcttctttagtattgatgaatgtagatcctagggaatatgactgtactttttttactgttcacagctgtgaaaggcagtagtgctatctgagtactttcacagtatgacttttgggtccattgaaataatgtaaatgagcttcataagctataaaacattatagctaggaatatgatttattggaaatattcagatattctaggtcttcgttctctatttttgtttttcaggagaactcacattaaattgtagacattaaaatgtattgtctctgcttagaaaaagtttttgccaggcaacattgcatgatgtataatttagtttattaaatgtataaaatttgttgataaagtcagagcaataaaactttataaatatgaattagaactttgaggttatggggaatagggaccttttatcagccttatcatccagtttgtcatatacagtttataaatgtgaaagcacttgtgatgaggtcaagtatcacgtgaaacacactttggaaggcactttgctaagccctggaccttatctggtgcctacatttacagttaggtattttgagggggctcctgctccaggacctggtattcaaagtcccttgtgtatatggtatattcttgcatggggcatttttatcacttaccttatcagggaaaatacctacctgccctaggacctttgtccctttataaaaattactgaaattatacctaaattaatcaatttctgtaattttatcatgtaacacctgatgcaatgaacaatataccctcttttcttgtcctgtttaacatattagcttcaggaaagagtcaacctagctaaaataggcatttaaaaaattacagtaatcttttgttttcccaacatccttggtctgtttccagtccttttttttttttttgagatggagtctcgctctgtcacccaggctggagtgcagtggcgtgatgtcggctcactgcaagctctgcctcccggattcacgccattctcctgcctcagcctcctgagtagctgggactacaggcgcctgccaccatgcctggctaattttttgtatttttagtagagacggagtttcaccgtgttagccaggatggtctcgatctcctgacctcgtgatccgcccacctcggcctcccaaagtgctgggattacaggtgtgagccaccgcgcccgactgtttccagtcttacctggaaccattctaggctacccaggcctttttttttttaaagtatttaccatccagcccaaaatgtcatacccaggacattcttatgtgactacattctgggaaaaaccatactgtttactccttccccttcctgtcttgtagtagagtccttccaggcctgtgtggtcctcactggcaatataagtaaatgtatcactatccaaagtgcctgagatagacaatacccacacatggactatggagagaggtgagataatagtaaaacagcagtttaggatatcttgctttaaatcttctgttgtacttgggctaaaatcagaacgtctcttacagttctgttgttttcatttccttttttttctttttctctttttcaatttagatattttctgttgatctacttttgagtttactgatcctgtttttgtgctgtattcagtctgttaagcctacgtaagttcttaatttcaaatatatccttcagttatagtatgttcctttgatattatagaccccaaatctgttgaaattctccattttgtctatttccttaatatatttataatagttactttaaagtcttctgtgtggcagttctaatgtctggatcatctgttggtctgcttctgttattgtccattcttttctttctcaaattttcctgcattttcatgtcatacagcttttattgtatgccatatgttttgtacattatgtaaaattcactcataaagatcttgcaaataatgctctccccagagtatttgacctttcctacctttaccaggtagatagagagaagctccccttaatctaattagcgattgagctgggtggggctagactgccattttaatttggtttagtctgccactggattatacctttcctgcaaacagcgctccagggattttgattgaaagcttgttagactgtcacctaacccctgaaacactgggagattcacttctactttttcgaagtatgaggtgactttgaaagtatgagctctttagcctcagctttaagatctgataagcgtcttgagggggaatactcatgtgactgtcaaaagttctactgttttattcctcagagcttcttttctcagaccaagcctttagcctgcacctagaatctacacgtgactccaggggaggaagtgataggcatttgtcagttcacctagaaagctgctttgctgcagttttagttcatctggatctcattagtttgatagctctccattgtcttttgagcaagttttttttttttcccttttttcccctctagtaagaacattggactgctgtgacctgcttatattttacctggagttggaactatagcagaatgttataataggaaatgttctggtatttaccaaatctggtatttaccccaaatctgagaacagtagattgccagtaacctgcattcaaaattgaggtgctatagtgttcatgcagaacatgcagaaaagacaccctgagtcaagcattgctacagttaaaacctgttactcacctgtaggctgtataaagatcgtgagttcaagagaaggaccccatagtgaaaagatttttggcgagagtagtatatgttaaggtatttctcccttttgttaatccaatttgaaggacttgacgagaacttctcagtttgacatgtgtctgctgaggtttgagagataaatagactggtacttgacttctatctgaaaaagcctaaaaagtgagataaaggctggagctgcccctgtatcggtagaatgaagaaagggcacaatgggagtgggccagcactttgtcagagtttgatgggtcaaaggtggaagaattacccccatggacaaagtagacgttagtaagacataatagttgaagttggcttaccttgaaaggatcaagaggccatacttggttgaagggtcacagtgatccaagcagacaagcctgagaagttcctgcatcaggaactaactataggtgagagtctgcatttggacttccaacctccacaggactccatcacacattactgtcacatcagattacagtccagccagccacttaagatcgtgccccttttctctcagactccctcttcctgctatttcagaaccgggaggggccttaaaaataatagctggagagtactggaagaggtagcgtgaaaagaattaatgagatagtaagattttggctttgctgtggctggattttaatttctgaagacatttattgttaatacaaatatctggatatgactaggaagtgttgaaatctttttgggattttgtgcagacaggataaaagcagcttgggaagagcttgttggagagcaatgactagagtggtggtggaagggagctcactaagtctagtttgtttcatgagctgtctgtatcctctttttgaaaattgagaattccaaatttagtggttgctggggacaggaagaatatgtggggagaaaagagggatgttacgtgtgtctacgtgaaatacatgccattttaacaaaagccttttctttttttttttttttgcatataatcatgatactggttaaattagccagtgatgctttattttcaaagaaatgttacaactacagttttcttctattatcatcatcgttttccttgaagcggtaggttagtctttactctcaaaatccaacttttaactctgactttgggttatgatgggaagcgctatgaaatggtcttggtgctcttatgaaactgtgatcactaataatacttaaattagaactgaaatatataaggagacttctcactaactccttcaccccagccttttgtcttttagaactttgcttatctttatggttagatagatagatagatagatagatagatagatagatagatagatggatagatatagatatagtttctctgaaatttgctaggacaacggggtttgggggcaatgaaagaaggttttatatttatgtttaggatgatagggacattgagagatactgaacacaaatttataatgaagttaagtaatttaaaagggttttcctgtaatttttatatgatgccttatataatttgcatccacaggtataaaacattaatctatgtgcttaaacatttgcctaaacattttaacatgttatctaaacataacctctatgcataaaagcagtttatcacattcagagtgctatacagatttgagttgatttttattttgtgggatgctaattgtcaaaaattgtcagattataaaaacttttacaatcaaagtcaagcattataaaactgtataacttaaaaagttgaatttcatggaatcacattctgtattgtaatcattgttttatggttgatgtaaagtcatcccttggtatccttgggataccccatatctccaaaatttggagacgctcaagtctcttatataaaatggcatagtattcgcatataacctatgtacatcccccaccatatactttgttttggaggcagtggggagacagcgtctggctctgtcgtccaggctggagtgcagtagtgcagtgttggcttactgcaacctctgcttcctgggctccggtgatcctcccacctcagcctcttgaatacctgggattacaattgtgtgccaccatgctaggctaatttttgtatttttggtagagacagggtttcatcatgttgcctagtctgatctcgaactcctgggctcaagcgatctgcctgcctcagcctcccaaagtgctgggattacaagcgtgagtcaccatgcccagcctgtattcttcattgttgtattgttattttatctagtttttcctctagtattttctgtccatggatgtggagcccacatatacagagaccaaccatgtattccagattttatgcacttattttaagattagaataacatgtacttatattttatatttattttgtcatttatgttactatttttctttttaattgttaaaaacagtatatattggccagacacggtggctcatgcctttaatcccagcactttgggaggctgaggcaggtgggtcacttgaggtcatgagttcgagaccagcctggccaacatagtgaaatcctgtgtctattaaacatataaaaattagctgggccaagtgtcataattccagctatctgagaggctgaggcatgagaattgcttgaacccaggaggcggaggttgcagtgagccaagattgtgccactgcactccagcctgggtgacagagactgtcttggggggggagggtatatgtgtgtgtgtgtgtgtgtgtgtgtgtgtgtgtgtgtgtgtgtgtgtgtgtatatgactaaatctagaaaatcgataagctatgttattaaagtaaatgtacctgaaccctttcagtgttagcttttgttttctttaagtaaaaagtttgtatttggaagggcttgaaatacttcaaccatttttagaattgatatttaaatcttttcagtagtagagactattttgtgtgtgggagatactttgttttttcaggggcagcagaaatatcaaacggtatctcagagtagagtttttaataacagcatttggaggtggaggtggaaaatattgagaaagtttttttcaatcatcacctggtccttcttctaagaaaggctatactatatcaaagatgagtagaagtgtcaattttattcttataggactgtgtgacttacaggagtgtgattatggaagttctgttgtctccgcctattttttatttagttattaatatttggaaacctaagctgcttattttaatttggaaggggctttctcaatttacttgtccaaagaaattttctttcctgagaaaatgtctcttacagtgaaatcttcagtttttataattaaacatgttgtgtaaatgttttacatacctgggatattataccagttttattgttttagctttgatttgctatgtttatattacttgtttctttttagtaactatatatggggcggaataatgttaataattaaaaatgtggcctctgtctcttccacttgctggctgtaggaccttagacgtgttactttgtgtttccattacctcatttgtcaaatggggacaacagtgcctgattcatggcactgttgaaggattaagcggtttaatatgtgtaagagcttggtacatagttggtgcttaataagtgtgaactatatgtgggatgggattttatatataaaatttgattttgaagtgaaactgatgatgtcacctatattacatgcaccaagagggcatgaaaaggtttattactcacataatgatgctgtctgagtagagcatggcaggcttccaagttggtccaaaaatgacttgagagagcagtgataggagactggcttggggttttatggtgattagggaatggggctgtgggctggtttttacactgtacatatgctgagacttgcctggtttgaaatttctctaatatcaacaggtggagcacctgggctttcttaccagcttgcccagattcgaggcagaaggggaagaggaaatggtggggcttgaaacctatcagcagtcaagtatcagaaatggagttggatttcttattcaacacaaacaggataaataaaaagaaaaccacacttagatatatcatggtcaaactcatgaaagagggaatcttaaagcagctggtgaaaaatggcacgcagcatacaaatgacaggtgatcagcaacagagaagattgtaaagtgatatatctaaatcaccaacatcagggagtcataacaataaattgtatctgcttaataaaggaacttaaaaatacatgcagcaaaactgggtagaattaatgggacagaatcacaaatccacaattggagagttcaattagaacaaaaaaatcagtaaagacatagaagttttaagttacattattaagttacattattaactacctacgtgatatttatagaatactaaacccaacatgagtagaaatacaagcgtttcaagtgttcatggtaacttcaccaggaaagactgtttacagggcacaagtctcaatcaattttaaaagattgaaatccaaagtatgttctctgccaccaatagaataagaaattaataccaataagacatctgttaagaattggaaattaaaccttaaaattctgacttatgggttattcaggggaaaaatgaggtaaaatatatttcaaaccaaattataatgaaaatacagcatatcacatatgtgggatgtagctgaaagagtgcctaatggaaaattttatagttttaaataatctgctaggaaagaaagttacctaaaaagataaaatagaaagtaagtagaaagaagaaataataaaattaagagtagaaatcagaaagccaaaagcgagttctttggagagataaacgcttgttagactgatcaagaaaaagacagagagcccacaatcacaaatgacctatattggtactgaaagagggattgtcatggtaggtcctacagacagtaaaaagattataagcaaatattataaacaattttatgccattaaatttgatgactaactgtaatgatgaaatttaggttacccccagctgatgcatgaagaaatacaagatctgggtagccctataacaatgaaagaatttgacttcataatcaaaagctttcctgcaaaggaaacttcaggcccacatggttttactggtaaatttaagcatttgtgcaacaaatatcaccaatcttatagacaataaactcagaaaaatgttgttttatgaggctcacataaccctgaaaccaaaacctgacaaagatgcaactaaaagaaaagttaaagattaatatatcactaacatacatgagaaaagaatacatcataattgagttctattccaacaaggttagtttataactttcaaaaagtaatcagtgtaagccagccgcagcggctcatacctgtaatcccagcactttgggaggccaaggcaggaggattgcttaagcctaggagttcaagaccagcctggtcaacaaagcaagaccccatttctatagacagataaaattacccacccaggcatggtggcatgcccctgtggtttcagctactcagaggctgaggcaggaggatcactcgagcccaggggttcaaggctgaagtgagctatgattgcaccagtgcactccagcctgcatgagacattgggaccttgtcccccacccccgaaaaaagaaaaattaatcaggtcagatgcgatggcttatgcctctaatcccagcactttgggaggccaacgcagtaggattgcttgagagttaaggagtttgaaaccagcctaggcaacataagactctgtctccacaaaaaaaaaaaaaaaaaaaaaaaaaagccaagcgtggtagtacattcctgtggtttcagttatttggaaggctgaggtgggagggttacttggacccaggaagttgaacctgcagtgagcagtgatcacgccaccacactccagtttgggtgacagagcaagaccctgtcgggcaaaacaaacaaacaaacaaaaaaactatgtaatttactgcattaaccaaggagggaaactataagatcacctcacttggtcaaaagcatttgacaaaattcatcatccattcatgataagcattcccagcaaatgagaaacaaagagactttctcagtctgataaaaggtatttaagaaacactaacagctaaggatttacttaatcatgaaatactgtgttttccctcaagaacaagacagggatgtctactcttgtgtccttattattttaatagaagacctagcaagcgcaatgagtcaggaaaacaaaatataaaaggtttaaagatctgaaggaatgtttcaaaattctgtttgtagatgacatgcttatttatgtaggaaatcctaaagaatctataaatatagccactaaaacaaatgagtaaatttagcaaggctgcactttatagattcagtgtctaaaaatcaattgtatttttgtaaatactagcagcagacaaataggggtgttaagaaaattcatgaatagtagcatcagtactaaatacttaggaatacattaaacacacacacacaatgacctctgcttaaaatgctgaaaccttgctgagagaagttaaacaaatgaagagggagttgtgattctcatatggccaggtatgctcttaccagactgacactccctcaataacaaactgcacaaaattctaaaaataacatgaagtactggagaataaacaaaaataggcatgttttagaggggattgacactcggaagaaggaaatggcgtaggcgaattttctgttttacagcttttgtccatgcaaagtgtgcagggtaggtaaaattccaacacaaaaccaagtctttctggccttgaagcaccataggtaagacttgggagaatcacaactattggagagtgaggagtgaatatcagcaaggagagtttcagaaagagagccctggattctgcctacaaactttgccaaaatcacctgctgatcccacatgtgtacggtagacagtacagccagataatcagcctgatttgaattgctccaggacagagtttgtggtttgaatgcaaccaggttagttgtctggtgaaacaaaaatgaagacttttggaagattgtaacagaacctctaactaccatcagataaaattcacaatgtctagcatacaatcctaaattacctaacatacaaagaacaaagaaaatgtgaccctttataatgaggagaccaaccctagaagacctacatgttggaattaccatgcagtaaactgatggatacacttgtgaattggaaaactcagtaataagttagagtacttaaattaccctgacttcaagactcaccttgaagccatagtaatctgtatagtgtgatactgacataaaaacagataagatagccccacatagataaacactgtgtgcctatatgattttcaacaaagttgccaaagcaacccagtagggaaaggaaagtctttcaacaaatggtgctggaacagctgaatatccatgtggaagaatgaacatgactccaccttacaccagtgaaaacaaaatatttctggataaattgtagtctaattaaagctaaaactataaagcttttataagaaaatataggagaatatttatgacttgggggtaaacagagaattgttcaaagtatatagaaagcagtgaccatgaaagctgctaagttagactccattggtatacaaaacatattattaaaatacattgttaaaaaataagtcagagtgggagaaaatatttgcaaaacatttctgaaaggattgaatctagaatttataaagatttctataactcagtaatgtaaagatagcctaattttaaaatggacagtagttggctacttcactgaagataaaggtccagtaaagaaatggaaaaatgtgtaatatcggtaggcttcaggaaaatgacaattgaaaccacaatgaaataccactgcacaatcatcagactacctataatttaaagactgaccacaccaaatgttgatgaggctttggaataaccaggagctctctctcatacattgaaagagggaggactgtaaaatcgtactctggaaaatgatctggcaatttattgaaaagctaaacatgcatctatccactgactcaagattttcacttctaggtgtttacccgagaaaaaaagaaatcatatttctatataatgatatgtactttcttgaatgttcatgacaactttattcacaataattaaaacctggcaacaggtcaggtgtctatcagtataagaatgactaaataaatcatgcttgttcaagtaatggaaaacgactccacacacacacacacacacacacacacacacacgtcatatacattaacatggatgaatctcaaaatcatgctgagtcaaaaaagacccaaaagaatatgtaccatattccattcatacatagactttccagaagacacgacacctatggtgaaaagatcagattagtggttgcctctggggatgagcgcatggatgccagacattgagaaatggacatgggtgatgatcttgacagggttgagaagtgtacaatgtatgcatctgagaaaactcaaatggtaccattaagatgtgtgtttcatgctgtgtaaatttaacctaaagaaaaaaagaacagcgaactctagttatgtgcattcttaagtgtctagatttgtgttatctgcagcttttatttttctctctgagacagggtctagctctgtcattcaagatggagtgagtgcagtggtgcagtctcactgcagcctccacctactgggctcaagtctcggcctcctgaatactaggagcataggtgtgcaccagcacacccagctaatattttgtatttttgatagagacggggtttcaccatgttgcccaggctgcccacatacacccttatttttaatgttccaaaaagtaagggatggatagagaggttaagtagatacatgagagagcaaaagaaaacaaatccaaattacagaatttagctgatcaatgtgtagggtgcttactcgtaactttaatggatgtttgaaattttttatcatacagaactcaggagaagatggaaagcttgttcatggaagtatctgagaagttggaataaatacttagaaactgttgagtttttcttttctgagatattcctctccaaaagtttgcttgattctttcgttttgttttgttttttaagatgggatctcacggttacccaggctggagtgcagtagtgcgtcatagctcactgtggcctgaaactcctgaactcaaactatcctcctgcctcagcctcccaaatagctgggactgcaggcacatgccaccatgcctggctaattttttaattattttgtagagatggggtctcactttgttgcacaggctgtttgcttgattcttaagaacgtatagggatccagctgtacagagctttctgcagtcttttgtaatagaattagttgttaaaattgtacttattacatgagcatcaaagaccttggaataaagctattcctcacatatctggacattatttggacttactatgttaccgattaggaagacttggtattagtttattttttaaaattctgtttcatgtgtgttcttataaaattatacaaataacagtaccacaccattgtgtggtgagctctacttagagctctgtacagcttgggtatctggaatgtagacatgctctgttctgatttgaaacttagaatgaaaccctgacataccggaatgcacatttggtgactgtttgtttttgaatggttactatttcattgctacaagataaaatcgaaaaacattttctacacagagtgaaggtttaagccagttaaggaccctgttaaactgtctccagatttaattactgcccaattatgccttaattatgaaggaatgtgagcacttattagctattgttgatgattcaacctttttgaaataaatttcttaatatatttcttttatattttcaatttttattcaggaatatctcaaattttcaagagatacagttttttgcatctgtaatgcagcaacttaaaaaatcatttgcacctacttatttctcaatcaggattgtctacattttgcaaataaaatatggggaagagactggattctgaggcaaataaaaggctatcattcttaatcattgattaaaaatttaagtttaatcaaagtagtcacattgttttcagtgatgtgataaatgacatttaaacatttgtaattgaatactacaatctattttgtgtctttcaattatatttgtagtcaagataaaatatacagccacacatagtacttgtaattatggagacttaaaaaaattattacagtgattaactcttcattcctgagctgtttaaatctaaacttttagtcttaagtcacatataaaaatgaaaggattattttaagtagaaataattatggatgcatagttacagattactcccctagaagtctgtattaaatgagtagatcagtaatcaagagctggagccttaggaaagttccttttgttgataatattctgctaattgactaattttactgagtgttcagcatgcttttaatcttaccaaggtggcaacttaggttgttatcccttttgatttgttaaaaaaaaaaaaaaatacactgtttaggcaagaagatcatgaaaaataataaattagtaaaacaatggggtttattacttttgttattggttgtctaactgcagcagtaaatcttgcagatatggtaggaacagtaaaactggtttaaagggttaccagattctgtgatgcgagccaccttttgcccaaagttggtagtgttttcttcaacttaattttcactgcttctcttttctttctccataacaaagatgtgaataaatatctatatccttaacgcaaaaaaagtagtaaattgaccaaacataatatctggataattggaacaaagtgcaaaatgttaatttagatgtgtatatatgtaggcgagtgtatactttgtaaattgtacactagatattaaattttaatttcagttttcaaaagtcagcttattcttagatgaagaaaatctttgatgtgttttactgaaatacttattgtaaaagttattactagggaaatttgataaggatttctattaggtttattaccaagtcatcctgttagtttagtgattaatatactgtatgccaacaaaggtagttgctatattagtatgtttatgactttaatagctgttttgcctctcctccccacctctttttaatttaagctagatatataagcaagaacattacacagttgatgggggataatctgtctttaagaaactgttccatgcaaagaactttgggactttgcgtgagataacatacgtatgcttgttcatctgtatattgatgcagggacatcattgtagttagttaatggtctgctacatcttatttcaacatattgtaatatttcacattaatttgttagtaaacagtatcaaatttgttcaggcagaatttatgagaccaatttttgctgatatttttcaatacatgagagttttaagaatatcctgaagttagatggtcaaataaatttaggaaatgttgagccaatgtgtttgggatattgctatcattgttataataacttaataatctctttaggatatgttgattttacatagcaagtagtcttagtttaacattttcagacctattttctatccttagtactttgtaaacagcttgatgttgtacaggtttctgtttttcacatttgagtaatgtacagacatttcttgtggacttcctttaatattatttaaatgtatagaaacatacttaagtgcaaacttaacgctaaccaaaagacaaatttatactcagttatataacccacaaaattccaattaacatcaatttaataggtgatggatactatttttacataacttgcaggttactttgaggtccctaatccatttagtcttacacagtgcttgatataaagtagctagcttatgaagacaattgtcattaaatatttgtttgtaagatgcacatttttttcactttgagatgccccttataaataaaattgaaagaggattttcaagtgttacacaaataatgttgcattttaaagtagataatcttagattagtgaaatttattgaatgtgtaaaaagctttttatatagttgttataatcagtgctacttctctaaaatttttcctgcatttgtttcttttaatattttttagaaactggccatacctagaagttataacttacactttttattaacaaaatgaaaacctgggagatacagtttttccccagtgttatttaggatgttatgatttaatgtgataaggaatattataatccacttttgtactatgaaaataccagttgggtcaccaaatatgttgtttgctgggtggtacacaaagggctttgggagctcagggtgttgttgggaaatacattgtggttagacagaatctttaaggaagagtgggtgattaaaactgcctcattaaaacctaccaaaggcatcttaaaaattgacctcgtttgttagacttattaaagaattagtagtaaagttaaaaggtggctaggaaggggcagttaacataaattgcacatggaagaaaattggtaccaaaggttcatgtgagacagaaaggacattgtgtgagaaaagaatgatcagggctcaggctggcatgttattatttgtctcttatagtaatgcccaaactgcgctttaaatgatgcagtataggaagtaatgtgcctctaatgttttagaaccatatctttttatagaagtgtcaagatgacattgacttgcattttattctctggcaatattttcttctgttttatttttacaattttggtgaaaggcaatatacattcacatggctcaaaaatacgtatgtttatgtatgtatacacatacaagcatgcatatacacatacattggaacctctcccttcccactctgcacctcaagtaactactgtccatgatgtatgtgtgtctttatgcatatattagtgagtaattacagatctttttacctgtccttttttaatacagggagtagcatattttagacctttccatatcagttcatagggtgccttcatcatatgctaaattgttctatgaattttttgttgggactttttctgttttggtttttacttttctttgcattcttttgtgtttttccttttttcaggtaaattttttataggtgaagtgcacaaatcatatattcagtttagttagattcaacaaatgcatataccagtgttttaagataaagaaatttcaatcatccagaaagttctttcatactctttcctagcggttcttctggaaacaattactgttgtttttcactttgaatttgttctgccacttctagagcttcgtataagtggagtcattcagtgtagatactttagtgttcagcttctcttgatcagaatattcccaagattcatccatgggtcagtaattctttttcaagattgttttgctattcaagatccttagtatttccatatacattttatatcagcttgtcagttgctacaaaaatatttttgctgaaatggtcactgtaatagatataaaacaaataggcaacaatcattagggaattaggtcagatggacatcttaatattgactcatctgtgaatatgctgtatctctatatacttagcttttaaaaaatatctttgagcaaagttgagtttgggcagagttcacagtcacattgttgatgtttttcccttgtgcctctttctttacagggtatcttccttcttttttcaaactctctggcagccccaaatgtgtcctctgattctaggtcagtaaaactgcagttttctaaaaacaacccccctgcagtgttctgtttgaattctagttgccctgcctagctgtggctggggagtgcccttgggtacacagccacagaaatgcagctctcatccagtacagtttgcagctttgacagttggacctcccttcagcttttgtctgtttttgatctgtgtctgctattttcaaatagttgattattttgttcagagtttatcattgttatatgaaggaaagttagcctaattgaggctgctctgccattactggaattagaacctccattctgttttgtgtattcttttactaattgcatactgttttaattattgagaatttattatgtgcttcagaatctggtaggacaggtctttactatttgttagaattttctggtcatacttatttgttttggcttattacagtatttggactaatacctggatttttaaaacatttatttttattgagattgcatcaaatatataaatttggtagagttaatacctctatgatggtatcttcctgtgtagggacgtatgtttttcttttttgctcagtgcacttttgtgttctttagttatgtttaaaatgtttctttgtatagtttgacacagttttaattacatttatctagatgctgcttatacaactctcactatctaagggggattggttctaggatttcccactcataccagaattagtggatgctcaagttctgataaaaaatggcattgtaagcctgggcacgttgacttacttctgtaatcccagcattttgggaggctgaggtgagaggatcacttgagtccaggactcaagagactttgtctctacaaaaagtgttaaaattagccaatcgtggtgacacacgcctatagtcccagctactcaggaggctgaggctggagaactacttgaggctgggaggtcaaggccgcagtaagccttattttaaaaataaaatggcattgtatttgcatataacctatgcacattttctcatactttaaatcggctgttcccaaccgttttggcaccaggagacagagtcatgaaaggcaagttttccactgaccgtggtggtgcggcaatggttttgggataaagacgttccacctcagtcatcaggcattagttagattctcttaaggagtgcccagcctaaagccctcgcatgtgcagttcacaatagggttcttgctcctatgagaatctaatgccactgctgatcttccaggaggcagagctcaggtggtaatggtctctcccctgctgctcaccttctgctgtgtgtcctggttcctaacaggccgtggaccggtatcagtctgtggcctctgagactcctgctttaagtcatctctatattatgcataatatgtaatacattgtaaatgctgtgtaaatagttgttataccatattgtttttaaattttgtatttttcaattgttgtattttttagttttaaaaatttacttattttttctactttttgatccacggttggttgaatccaaggatgtggaacccttggatacagagggctctatgttttattataaattggcttattttaaaaaatattttttattatgtaaacaggcaatgattttactagctagaagcaaatttaatgttttaaaataaaccttccaattttgttaggcatgataatgatggaactgaggcttaaatataccctatggcagcagttggaaagtggccgaattagggttggggtctagatctgtctgcctctagattgattgcaagttcttaacaattactgtttattcttctctgattcctttcaaggattaaataaagtacaatgtaaacttcatgctctattttagattctggttctcatgtgagtcccagaataacttgagtgaaatgttctgatacagagcagaatagcctcttgtgctacacttttgttaattattttcaaagaatagtctcctgtataccatttctttaatagactcagaagtctgtagaattgaggtgattctgttgtgatttaaactacatcatgctatatgtttccaatagatatttgaaaatatcttttaaataaaccattaatgtcatggtttttaaatcagtatatctttggaaaaaagggaaaggtctaagccttaatttacctggctttttctggcttttatagtctggtaaattttgcagcctgaaaaagcaagagaatctataaaatacttgaatgagatgctggaaaatttcagaacaggttttgttttgaactgtcgggtcactgtagcccccaaagcagggcatgatgtgttcctgcagcctgatagctatgtgacagcacctgtagtactaaagccaaggatgccaggtggttctgttgcctggccacaggaagccagcgcttctcaccattgccctttgaactgttgatccagttaagctcactaacaatgtgtaaatatgaaatttaatcaattgcttgattcattttcaaaagatgttttgaaatactcctttatccgcattgaagttttgatgattttgtaatatgtaagaaatggacttttcagaaaagtacaacttagtacttgagacattggctgtcaaagttccattccaaaacttccttttaagctctctttcccttctctcactgaccagaagttactatgaaatgaaataaaggtagggaaaaagggagaattatctctgagctgcccatattctggagagaaatgtgggagaaaatttttaaggtggtatactaaattagaatgacttcaaagtctatttctttatttattctagagatgagaacaaaataattttcagtaaaacttaaaaatatcatgaccagataacctgaaaatcttaactgtggatgcatgtctatttttattgggatttttttctatattaaaaatcagttgacatctgtttttagataattttttaaaaaactggattataaaatgaagcacttagtaaagctgatggcagaggttttagatcttttgaatacaggaaagtggtaagggcattataggtatgattcattgagctagagggcgttggtgttcacattttaaaaacataatcatgacttatctggagtcacatgttccattttattggcttccttcatatagaaaatatagtaaccagcactacatgcctgtgaaaaagtgaagcaattgtatattttctgggtgaaggaagtattctgtacattctccatgttttacatcatggtattttgaataaccatgcttccatgttcacatcaattttttgtttttcaatttatgcacagcacttgctctgaaatttggggactgagtacaccaaatacgatagatcagtgggatacaacaggcctttacagcttctctgaacaaaccaggtgaatattctgccctctgtcgaatcttagagatcttgtgggaggggggtatattttgaaagacctatatggggttgcttagtataattttgcctaggatgtttccttaatgtaaaataaggcatagcatttaaaatatctgcttgccagtataaaaaatatattaaatgtttcagctgatgttttaatcaatgcaattctagtttgaatcttctttaaattactgtatcccctaaagaataataattttgataactatatatttattttagcttgagatcagattataatctgttgttggcctaatttttaagtagatacatgatgagttttgctaaatttcttgttatcagaatctcatctttatactaataaatacatacttaatgaaccccttatatcacaattaacagtaggttaactcatttttatgttactttttttaatcacttcattttcttttttgcgtatatggtatttgttcatttcatctcatcatattcatcaccatccacatttatttgtgaactacataaatatacctcagttctcaaaacagtcacaactgggtaaagagttgcagtagtctgaggaagttactatcacatcattgttggtatttatcattcttcacactagttccttttctgactcttcagtcacctccagaattaatatccttagaagcatctctaaaatgagtttgatttactaaacatagaagttgacaaagtttttcaagtataactgcataaactctcttttttaaaaaatcagtttttcccaagttgttagcctttcattggcatttgagtcatttatgtgacatatttataagaaacatctgctagtgctgctgcatacttttatcagatccattaaatagtacatttttgttcttgattctcactaaaactaactaaatggctgtcattcttttctttatgcttttattgtactaatttagcccatttgactgcacttttttttttttttttttaaagttccctcctttcttttccccttgcttcccaacaggtctcttgatggtcgtctccaggtatcccatcgaaaaggattgccacatgttatatattgccgattatggcgctggcctgatcttcacagtcatcatgaactcaaggcaattgaaaactgcgaatatgcttttaatcttaaaaaggatgaagtatgtgtaaacccttaccactatcagagagttgagacaccaggtaggaatattgcaagtttttttcttggttttgaattaaatgcctgaacttcagtatatttaagtactcttgtgacccaggaaaattttagtgtaaattctaataaattaccttaaattgtgcatattatttggtggtaattaaaatttttttatttttaaaaatttttaatgagaaaacatatctgtttcttggaatagcatatgatttggcatgaaagtgcatatccaggaaatcctgtagattggcagtctgctcagcgctatgctgatgtgcttctacatgtccctgctgcagtaacattttcaagcattttgcacttggagtgcttttagaagtactttaatgacatcatttgtatgtacaccgtttagtaaagcttgtaacaagacttttcatttagttagctgtctacctgaaactattaaaaaatatagcagtagctgcgtttttggaaaatttcctatatctgattttacagataaagacaatgttaagttttccaatggggatttatgaacttttatggtaatataatattaccaggatcacattgttcccaaaagtttgagataaattagaacttggaaatttggataatagactacctaagttagagccataatcagatttgtcattttctcagtaactagtatatatcgagtaggtggaccctagctttaaaaattaagctacaacttctcttcttgttgaaaactttaaaaaaggttcccccactcccctttgctctttgccattaacttggatttcttgaactttttcagttttgcctccagtattagtgccccgacacaccgagatcctaacagaacttccgcctctggatgactatactcactccattccagaaaacactaacttcccagcaggaattgagccacagagtaattatattccaggtatttttgccttctgaatctcctaaaacttggatagatacaaattttgttcataagcattcaagttttagtaaattgtggtttcacttttttaaaaatgcttttgagtttttaatagaaaaattggattcgttgggtgattattttgtgaaatgtataagcctagtacattaaacagttttgtttggagaagagttttactttatatttcattttcttttgcagtgactttaatcaaagtactgtgagaagcagaaaagaaaagatcttagtaagtttgtcttagttgttgaagctaagcgagatgcagaatgtaagcaaaacaaatggtgtaggagaaaagtaccccccaaacacatgtaactgaatatccacccaatgatcactttttcttagataacttggtaatatttaacagaaatataacatttctataagaaatataatacttagttctatagacatagcaacacttacatattataacacgaacgtcagaaaacctcctttaattatgtttcgtctgcatctcagtaatttctgatgaaaattgaattcagctacatggttctcaaattttgttctgatgtattatgtgatccagtaatactccacgatatgatatctggccttttcgttttttatggtttcttttttttttttttggagaacaactaatactttgttacttttcttgtatgttttcctttttgtttggttgatttttctccctagcagaaacagcatgatgttaggatgaggattaagctgtagtgtctcgatttctttcttccttttgtaatattcttttattccactcttattttatacactaaaaatatgtaaggaacttaagagcatttacaaaattcttaaaatacagttttagtacatttaaacaattatttctttcatgtatccatcatggaaataatgcttattcattgaagataattttttaaatgtaaggaagaaaaaaaagaaaagataactaagaaagataagttttttttttaaatagctggttttacaaatgggaagtggtttttgattgttttaatgtatatttctttgattactgttttattccagaagaggatttaaagctgctttatgggttgctaggaaatacaaacttactgaagttaagagagggagagggtgggatgtagtatgataacactaggaggagggaaaacccgggactatgaaacagggcaattgctaggtagaaaagggagtggagttgtgtgaacgttggtgtggggaaggggaggcattttaagtcgttagtgtgggaattactgttattcagccagcaatactaaccttaggtataaacatgcagtcttagggacaacacgcatatccagtaattatttggaaggctattcaccagaatgtttagtggctttcacttgtgaagatgtttgggctcatttttcctttcttttttattcctttaattattgagatttgagtattttataaagtagaaaatcagaagtggattatacccatttgcttttctggacagtggggctttatccggtttcaagcaacagcaaaaccaaagggttcacattttattccacttaaaagaaattttaacattttctcaaaaatgctaatagctttattatttattacaataatggaaaaaataaacacagtaagataacgtattttaaggttcagcatttctttctgattagatctttgaaatacaggttaaactcaaaaagcttagcgccgtttaactttattagctttaacttttaaaatatgcataatatgtacccttatttttatgttctttgagtatatgaagataatttattcttagaatttttgttttaaaaatttgggggtactgacacttaaatgaaaagtttgatacttaaagtttgtggttagtttattgaatagatattgtaaaaggttattgaaggagacccttaacctgtatcttctcttcctctttttttttttttttttttttttttgagacggtgttttgctcttgttgcccaggctggagtacaatggtgtgatctcggctcaccgcagcctccacctcctgggttcaaatgattctcctgcctcagcctccctagtaactggaattatagggatgcaccaccatgcccggctaattttgtgtttttagtagagatggggtttctccatgtttgtcaggctggtctcgaactccccacctcaggtgatctgcctgcctcggcctcccaaagtgctgggattacaggcataagccaccgcgcctggcctcgttcttttgataattttaaaattgtttggatatgtgtctttgttatcttgaatcgctcaaaactgttcagtgtaaatgtaaaactgatgaaagtcttctgaacttatttttcctccctggaattacagttgattaaattgtatacatgtttttattttacatgcagtttattcagctattcagatacctttctgaacataagtgttttattcagacaacatgttggaaataatatattagaatcctaatggttattttcagggagcattttacctctttatacagtagtctatatttgaattgaattttctgcttcaaacacttagactttaccagttaggaatccttggagaaacacactttttagatagaattcagcctggaccaatccggaaccatactctaccatattttaccctatagaacttagtgtaagttgtaagcctgtattatttaatacttttataatccaaaatcttgtgtgttttttaattttctaagtactcataaaataacgatgttcattagattaaacaacaacaacaaaaaattgtagttactgatggttttgcagcctactgattcagatctgaggcatttttaaagttacgtttttggctcttgccccagaatatgtacatataggaatgagcaagatacgtacataatgtgtatgtccagagagtaggattttattaaaagtggatgttaaggattcactgcaaaatttggacaagatcctgaattatacaccctcagtatgcaatattactttttataatattatataacattattatttgttatttggagtgattcattggttatctctggtagctgagagaaaaggtagtgagattatgttgcagctgtgcttgatttgttttaaacttttgtagaaacgccacctcctggatatatcagtgaagatggagaaacaagtgaccaacagttgaatcaaagtatggacacaggtaaaaaaaatgtctttgaaaattcctcagttattagatatacatttcttgtattgtttgaaattcacaaaagatgttactcttaaatttagagaagttgagacgcataccaaaaaagatgatcttctatcttgatttaacatatctgaactaccaaagaggtccatgttgtcactgaaaaattataacgtatgctactctgcagaataattgttattttttattagagtaaatgaaaatttgaaaacatgcacatacttttatttctttttaagtatttgcttctgttgaaaattttagtaaccctatgactaagtatctctctgtgataaaaaaccataattactcaaataacagattttcagaggaatttgggggtgaaggatggggatcagcttttcactgcttttttaacctaatagtgagttttgaattatagtagattaatttcttatgcttagctatcaactccaaaaagtgatgaagaaaaaaattaaagctttaaatcacgtcttacgtaataaaatgtataactcagcagaactaataaactaccagtgaaatcactttgatgtcattgtaattgtccagtttgattcattttacctgtctgtatcttaactgttggacaccttaatatcacaacctgacaaattataccatcagtctttctccacatcttaacactaatgcattcttggttatgataatctaaattatttttaagtggattaacattggtgggggagggaggggttacaataattctcttgtttaaatccgtttttttggactcccaggtaaagaagtttctgctgtagctaatcatacatttgggtgtttaggagtaccagataactaagaaaggtagataatctaatgaacgttggaaataacgtgttatacatcttaatgcaaataatatttgactttccacatatgttttactaaaattagatgacactcttcttgaagcaataatattcttttttgcctgtgatggacagctgttactgtgacatttaaaagtgaatgatgggaaaagatactgaacgtcataaaccacagtgagatactacctcacacctactagatgctataatcaaaaaaggacaataacaaatgttggtgaggatgtggagaaattggagtcctcatatatcgctagtaggaatgttaaatggttcaacactttggaaaagtttcctgttcctcaaaaagttaaatacagagttaacatattgtggccagctatgtatccaagtgaactgaaaacatgtctactcaaaaacttgtacatgaccatttatgcaggcattattcttaatattcaaagttagaaacaactcagatgtccatcaaatgatgaatggatgaataaaatgaggtatgtttctgcaatggaattattcaaccatgtaaaggaatgacagtatagcatgacgtgtggcaacatggatggaccttgaaagcagtatgttaagtgaaataagccagaaaaaaaaggctgcagggattctaatttagtgcacagacacctattcagcaatataactgaaacacaggaggagcaataatacaagtattcgttatgtatgataaatgaatcaaagtacaaaagtggagaataagctgaatcagccagctaaaataattgcagtgttggggctaactttgaacccaacctaatatttctgtttcagtggagcagtgttactggctttctgaatgacaggtttaaaaattactgtatggcaatgggaatatgtgattcatgagatgccaacagttagtttggctgccagcctcttacccaatatcagtttctctcttggggccatggcaagaaacaattctgactgatgcagggctccaatttagaacaaagttggccacctctctaactctggttcataccttccagaaggaaggacataattaaattcatctttcataacctgctgttaaaaataatgaattgaaattttttaaaagggcaaccagaggataaattaggcataataagtaagtgtacgaacaagcacttgttacttttttctttttttttttgatttagattttgctggtcaagactttattcttcctttatagtggatattagagatcaggctggacatcgtaagaaatttataagttcgattaacctttgtagtattgtataatcagtcccttttcaagtcatgatttttatgaacatatttgttcaaacaggtatatagagaaatagaatataatagatcataagatgtggatttcataactcacaattcagttttgtatcttctacatacactgtgcttggtccaagatacacaaagagacttaaagggttttttaatctgcctgtgtcccagaagataaaatgaggtgctaacctccaatacctcagaatgtggccttgtttgggagtagcatctttgtaaatgtagttgtttaagatgaagtcatactgaagtacgatgggccctaattctatatgactggtgtctttataagatagggaggaatgtgctatatgaagatggaggcaggtaactggagttagcacctgcaagctgagcaattcctaggattgttgggaaacccaaaagcttaagagaaaggcatggaacagattctccccttgagcctttgagagagcatggctttgctgacaccttgtcttgggacttaggtccttcaaagctctgaaaaaataaatttctgttgttttaagccacccagtttgtggtattttgttagagcaagccctaggaagctaatacagtgagtattaagattttgagagtatcctactaatatgtacacttaattatttgtaagttatatacaggtacttcaagtacatttaaaaatatatacaaaaattagaaattgaaggatgagattaaataaatagaaaatacattttaattttttcttcttgtaaactactagttttttgtactcctagacagttttcccatacactccacttacaagacttactcctcttaactaaatgcatataatcaaaatagcatagtgagactctgagctagactatctgagtttgaaatgttcctcttacatatgctagctaggtaacctagtttttaaatctgtaaaatagggacaataatagcatttaactcatagagtattaataggactgatatttataaggcatctatgtgttctaacctgtaataagcactgtatgaaggtagttaaaatgttaagaggagttaaccattaagaaaaaggaagatagtggattgcacaaagatgtgaaggaaagtgaagaattgagatccagacacagaagcacttgatttttgtggtttaggatcagctctataaaataggaaagtaagatttttgtcaaaaatgaggggtcaggtttgacaacttcaggataatagtcttataacaatgccttttctctgccatgtgttaaacagtttttgatgtagatgtatagcatgtctttcattagataaattttttagtattttatacttttagtgctgttatacgtttttgtttttacattttattttccagttgttcctaggatatgggaaatacttgatttttgtatattcttttctcctgcattcttgttaaattgactttttggttctagaattctgtagattcttgaggttttctgcatacacagccatgtcatctgttgataaggacagtttttttttgtttgattgttttttgagaaggagtttcactcttgttgcccaggctagagtgcaatggcatgatctcagctcactgtaacctgaacctcctgagtagctgggtttacaggcatgcactaccacgcccagcttatttttcgtattttagtagagacggagtttctccacgttggtcaggctggtctcgaactcccaacctcaggtgatccacccgcctcggcctcccaaagtgctgggattacagccgtgagccactgtgcccggctgacagtttttctttttttccccagtcttcatgcttttttctttttctgtcctaactaagacctacaataaactgttgaagctataagaatggacatttttgcattgttctgattataggaagaacacatttcacaattccccctttaagtatgatgttaattgtggatattttggagattgtatctgattgaggaagttctttttcctttttgttcttaatgttctaattgtgttttataaatggctgttgaattttgtcaaattttttttctgcgtttataaagaggatcatatagtttcatggatttgaattgttttatttttgagaatttttccatctatgtttatgagagattggtctgtagggttttttcccttgtaatgtgtttattagttttaatatcataaaatgtgttggaaagggctttctcctgttttctcgaagagtttctttaaggttggcattatttctttcttaaatttttgatagggctgggcatggtagttcttgcctgtaatcctagcattttaggaggccaatgctggagaattgcttgagcacaggaggtcaagaccaacctaggcaacaaagcaagaccccgtctctacaaaaaaaaatttttttttttttaaattagccaggggtagtggcattcacctgtggtcccagctacttaagaggctaaggtgggagggtcacttgagcccaggaggtggaggttgcattgagccatgtttgcgccgctgcactccagcctgggcaacagcgagaccttgtattcaaaacaaagtttgatttttccagagaaaccatctcttgtaggaaaaggttttttaaattgagaattatttacatttttaattttgtgtatgtgtttgataaacttggattttgttagaaatgtgttcatttcatttaagtcataggattgattaattgagacaggatctcacttcgttgcccaggctggagtgcagtggcctggttggctcacggcagcctcaacctcccaggctcaggcaatcttccccactttagcctctcgagaagctgggaccacaggtacatgctactgcacctggctaatttttgtgttttatttagagataggatttcaccaggttgccaaggctggagaatgtattgatataaagttatttctgatatttgttattcctttcatatatgtgagatccattttaaaatttataatgttagtaatttgactttttaattttttattagaatgtcttgtaatggattaatcagtagtctttgttgtctttgtctcttttctgttttgtttgtattcatctttttgtctgcttacttttcatttaatctggtcttttctagcctcctgtggtgtacatttagatcattgatttgtttataatgtacacatttaaagctataaatttccctctaagctttatgttagctctatattacaaattttatgttgtttttaaattatcacttattttctaattcttcttgattcatgagttatttagaagtttgggtttttcttaggagtgtgaggattttctagatacttcatcaatttctaatttaattctgttaacagtccagcatatagtgtgtgtgactttagtccttggaaatttatgaaaattattttatgctataacttgtaacttatcttgataagagttccatatatagttggaaagaatgtatatactatagtgttccaaatgtcatttaggtcagggtggttgatagtgtttacatcttcttaattctttatgattttttaaaatctccttattttgtcagttatgataagtgttaaaattttcagctctgattttagagtcatctgtttgtgcctttagtcctgtcagtttttgcttcgtgtgtctttaacctctgttattagatgatacacatttggaattatacatcttccaaattaatttgccctaattataaaatgcatttcatattaacatcaccatatcttctttcttacctctggttacatgatatatttttaattgtttcagtctatccgaatctttatatttatggtgtgtttcttgtggacagcatatttttggttttatttaatctaacaatttttgtcttttagttggaaaatttagtccgcttatatttagagggattattgatactggctttaggctaccattttgcaattgtttgtctatttgttctctctggtttttatctgtttgttttcctgccttttagactaatcaaataatttttgtttcattctgtttactctcttggccttttaccagtaacacttagtattattttctcagttggcattctcgtgattacattgtacttatgttatacctagaagtttatttaagttgtaatattttacaacgtcatgtaaaatttaagaactttacaccactctagtttcattcatctacttctgttgtttgtactattattgacatgtattttacttaataaaaatatataaaccccaaagttcagtgttattttttgcttttgatatcaagttgatttttaaaggaaattagaagggataaaaagaagtattttatattcacctacatatttaccagtttggctcctttttgctgctttttattcctttactacagacatttctttcagttgttttagcaccattttgcagagacattcctttctccattgatttacattggctcctttgttgaaaatcaagtgataatatgtatgtgaccctgactttgagtctgctcttaatccaattaaatgaatttttcatttcagatcctttattttttagctatataatttccattttaaagtcttcgataatttgtgtccagttaatatgtaacatggcctgcttttgttgactgttttatctcttgattatggggtcatttttttccccctccatctttgaatatctcttgttttttaattggatagtgggtgttgtatatataataatattagagattaaaatagataacactttctttggaaagaccaactcttttctctatttgccaagttgaggagctgatcctttccctgcccttaggatttgagttggaaaggtgataatttggtgctttaatgtcacatcactcaggtttcagggagggtcagttccctaccttatcagaactttcagatacaaatatggcaagactgcatattcttatttctttccagccttgcccaggacttcctatgctaacatgtactcagctaaagacatgtattaaaactgactggtgaagaggagctctgtgcttgcagcttcttcgattcctgtcgtctgtgcatggccattgaaattttagttggcttctcctttggcaagctcagtcctttgtctgtgtcctgacttggcagatgctgtcagtagtgaaagtgattaccactctctgttaactggggaggagctcatccctctctgtaaattagttcctatggacttatttggatctatatctgtgtgataactttaaagaaaaatagaatttttctttgtttatccactgttttcttactgctatttcagaagcaaaggttttccccaatcttctacatactaactataaggggaactctgtaggagtttctaataaaaacaaaagcagccttttttctcattatgaacagaattatgctctcatagaaaaattggaaatatgtaaaacctaagatgctatcgcactggggattaagttttttaaaacaagaaatgaaaaaatgatcattcatgcattatatatttcataagctgaatttgatgattataatgttgtatcactttggcagggaagcttaatctcttatttctaccattattctgtgtcagataaaagttaaacagtgttctacacataagattatgatacagcatttcaaattatacaacaaatggatgttcattataaaaaattagcatagtcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggtgtgaacccgggaggcggagcttgcagtgagccgagatcccgccactgcactccagcctgggcgacagagcgagactccgtctcaaaaaaaaaaaaaaaaaaaaattagcatagttaggcaaaataggaaaacttaagcattatatgtaattgcatctagcaaaaaattaaaattttaaaaggttcaacttttaccagaaattaaaaaacaatgctgtaatgaacctcattaaaaaatagctagaaaatgacagagaaattcagtaggatgtcagattctagagttcctgttcttgtttattacactatatgtctggctggttttaggtgacatgggggagaagtgggtgcttttgatacatattgctgaggcttagaatatgactagtgatcatatttgggttaaggttgaagaagcaacccaggatgattcccagttttctggaaggtttgtgaacactttagtctgtattcagtaaattagactttttaaagcatacatttttattgtatatgtttaaggtatataacatgatatttggtgtatgtagtgaaatggttgctgtagtcaactaaatccatcatctcacatagtcacctttttatgtgtgtgataagagcacctaaaattgacttactaaatttccagtatacaacacaatattgtaactgtagtcctcaggttgtacattagatctctgggcatatcttacatatctgcaactttataccctttgacctataatctccctattttccccccaacctgtaatcaccattttattatgtttctatgtatttggcttaaaaaaaaaaaaccccacatatgagattatgccatgtgtctttctatgtccacctaatttccttggcataatgtcttccagattcatccatgccaaaagtggtaggatctccctttttaaggcaggataacattcaattgtgtgtataaccctccatttctttatttattcatctgttgatgggacacttgggttgtcttctgtatctttgctattgtgaataaaagcagcaagagtaaaagcaacgtgccacataacaagggagtcttcattagacaatcagctttttcagcagaaagtttgcaggccaggagagatgggtggtgtatttaaagtgctgaaagaattaaaaaacaaaactgaaattagccgggtgtgttggtacacacctgtggtcccagctactcaggaggccaaggtgagaaaattgcttgagcctaggaggtggaggttgtagtgagccaagattgtgacactgccctccaacctgggtgacagagtgagaccccatctgaaaaaaagaaaaaagtacccctgccaaccaagaatactataaccagtaaagctgtccttcagaaatgaaggagaaataaaaaatttttcagacaaaagctgagggagttcatcagtgctggtgtggtgaggatggggagcaacaggcacactcatttattactggtcagaatgaaaaatggtatagccactttggaagacagtttggtgatttctcacaaaactaactatattcttaccatatggtttagcagtcttgcttctccttggtatttacccaaatgaattgaaaacttaggtctacacaaaaacctgcagattgatgttcatagcagctttatttataatttccaaaacttggaagcaaccaagatgttttaataggtgactagataaataaactgatatatccaattaatgtacaacaggtcctcaagtaataatgtcatttcgttacagtgttgatgattggggaatgttggttttgttgtacaattattttgcttaagtcagtttccaaaaacctatggaagatgttaaatgaagacttactatatatgacattctggagaaggcagaactatggaagcagtagaaagataagtggttactgaggctttgtgggaggtaaagaggactaggtggagcacagggcatttttagggcagtgaaactactctgtttgaaactgtaaatggatacacgtcattatacatttgtcaaaacccagagaatgtataacatagccctaatgtaaattatggactttcagtgataatgatgtatcagtgtaggttcattattataacaaatggaccattgtggtttgcggatgttatagggaatttggggaagcagggcaggggtcatatgggagctttttgtactttctgttcagttttgctgtgatcttgaaactactctaaaaaaaaagtcttttttaaattaaaacaatttaatgtcaccttaaaagatataacagattttttttaaaaaaaaacctgggtgaatatttgcaaatagatgacaagtctaagaactgatttttaagtttaaaaacttacaaatcaagaagaaaaagatagttaatagaattggctaaaagaacagaaatacactgtttacaacaaaaacaagaaattaaaaaattgctccttttaaacctatcatattggcagatgtcaacatgtagtgacacggtgtgaagaaacactagcttataaattcttagtgagatgaaacatttttgagagggtattttggcacttataaaagtttaacacattttatttgacatttgttaatttgtcaaaggtttgacgaatgtatcctacaaatatatgtgaatttgtatgcgaagatacatgcacagggatttctgtagatggtttagctgtaagtagacactgctaattcacactggatctcaaataggatatttataatattctaagtggaagacctgtggtaggtgagactccaatagcagcatttatgtatgaataattcataggctaatcatcagttcgttgcctctggtttttttttttttaaaggcttctattaattgttagcttattttaagtttttaaaatttgtcttttttgtaatctgtaattctaacctgtcacatctgactgaacgcctgttaatttaaatgatcctactggtcatttctaagtatttaatagaggagtaaacagttaaaagatatgaatagttgggcagtttcctccatttctaatagtggctttgtttattttatgttggtttcaggaaacagcagtgaattttagctcattgttccaaatatgttttgacctatcttagttgtacctgttgtgacttgccagcagatttgtgacttgccagcagatttgtgacttgccagcagatttttcaaactgagaaaaaaggaacataacttaattatgttgtggaagaccgtactgtcttctaaaaactaagcatcccttctctgattcatttatttatctaggggctaccatttcacctttattgcctggtattttatgtcatggttataatagtgtgtggtagggaggaggtgtgtaagatggtctgacctatcttactcttttttttttttccctctcgagacagagtcttgctctgtcgcccaggctggagtgcagtgggatgccctcagctcactgcaacctccgcctcctggattcaagcgaggcgacctgcgactccttgactttgacaatcgagtagtactcccggttgaagcccccattcgtataataattacatcacaagacgtcttacactcatgagctgtccccacattaggcttaaaaacagatgcaattcccggacgtctaaaccaaaccactttcactgctacacgaccaggggtatactacggccattcttctgccttagccttccgagtagctgggattacaggtgtatgccaccatgcccgactaagttttgtgttttcagtagagatggggtttcactatgttggccaggctggtctctaactcctgacctcgtgatccacccacctcagtctcccaaagtgctgggattacaggcatgagccaccatgcccagcctgacctatcttattctacaattatgctcttggtatacatttgaagcttgggtcatgctcttttaggtaactgtgcctaaacgtgtagagaatgatgatcataaaagaaaatatattttatatttttaataagattatttaacaatgtttatagcaaatgtgttttaaaattgagttgcatggaactgagcagactagttgcgccatgatttttcatatgttgtctgtggtggttcttattttgtatgtttgtgcccccttattttcttgattagatttagcctgtttacccaaaagaagaaacagatcattttctaagaaagtgtaatttaccagaactgactccagaaaatagagctatctgaacaagtcacccttcatagaataatgtctcgtagtaaaccctagaaagttactaactataatttcacagaagaattctaccaaacttttaaagaatatgctgttataatactatttaaacctttgcagaggataaagctgctagattgtcataacattgaccacagagccttacaaacatagcactcatgtaaatcttcaggcttgtattgcttgagactattgatgcaaaaatcctaaataaatattttattactgttagcctgaaagccaatgccatgcttaatgggaaaatggtagaaacattaccctaaaagtcaagagtaagatatccaccgtcatcactgttttatcccaaagtgtgacgctaacccaaagatgattgataaatcttgtagaagggcttttattttagtgctacatgatcaaaattaggattaagagtcaaaagaccaatgattaaatatttgtagctcataccataagaagacttacatccctaatacacataaagagctttcaaacaatcagtaagaaaatgatcaacatcgcaaaagaaaagaacagactatcacaggaaggaaatataatataaacatgtgtaaagctactcaaaattaaaactgtacttgtgaccatgttttcatctagaagcaataacacctcaagcatccctttactatgttgtgactgggaatgtaaactggtacaaccttgatgaatgataattttacccaaatctatcaaaattgcaaatacacaaacctttcgacctggcagtttcttgaagaatgtatctttcagatgtgattggaagcgtgcaaaacggtcaagattagttattgcaatctcaaagcattggttcttatagcaaaagattgaaaatagcttgaatatccatcaatgtgggatcgcgatgttatgtgactaattgatatgtagatagacaaataaggaaacacattgtgaacaatctgatagaataatatagaagatgaaaaacggttaccacttgtatatgaaaagaaaggacacagaacaaaaatgtatttgcttatgtggttcatagagtattttggaaagatacccaaggaaccgtcaatattagatatctttgggaagatgaactgttgggctagaagccaaaactgttgcaccttttatactggaacccccccttctcttcccccgaccccccacaaattaaactaaatttaagcacttacatattctgaattcttggtatttaaattatctttgtattattgttgataattataaccagataaagctagttttatgattacttgatcagaagttctggaaatacttcatttatttttaaatccttttgttttaggctctccagcagaactatctcctactactctttcccctgttaatcatagcttgggtaagttgcacatatgttcccctcatcatttttatactgtatcacctacttaataataaaaatcatctctaggagttattttttatatatccgagaaagggatcctaatgaatagccaaataattatgtatgtggttaaagtagtgctttttaaaaagaatattgacaccatccctcaaaattattaagtcttttctgctggcacatataagaaataggtataatctatttattattgaaatcatattcctcatagaaaattatataacctgttatggctagatttttatggttatgtttattttatgatgtaattaataaaaggtatgtgtattacatatatacacattgacataaatatgtatacatgtatacgtagtatggggatttatatatattatacataatatatataatatatataatatataatatacataatatatataatatataatatattatacataatatatataatatataatatatattatacataatgtatataatatatatataatatataatatatattatacataatatatataatatatatatagtatataatatatattatacattatatatataatatatatatagtatataatatatattatacataatatatataatatatatataatatataatatatattatacataatatatataatatatatataatatataatatatattatacataatatatattatatatataacatatattatacataatatatattatatatataacatatattatacataatatataatatataatatatattatgtataatatataatatatattatacataatatatataatatattatatatattatacataatatataatatatattatataatatatataatatatattatacatattatgtataatatatataacatatattatacataatatgtatataacatacataatatatattatacataatatatataatatataatatatattatacataatatatataatatataatatataatatatattatacatatatataataatatatatatactatatataatatatatatgagagtgtgcacatatatgtacaaatgtgtatgtgtatggtcccttcataaccatgagttcagcatctgcagattcaaccaactgcagattgaaaataatcgggaaaaaatgaaaataacaatacgacagtaaaaactaatacaaattgtatttatttttatttattttttgagacagagtcttgctctgtcgcccaggctagagtgcagtggcgcaatctcggctcactgcaacctctgcctcctgggttcaagcaattctctgcctcagcctcctgagtagctgggactacaggtgcatgccaccacacccagctaatttttgtatttttagtagagatggggtttcactatgttgcccaggctggtctcaaactcctggcctcaaacgaatcacccaccttgacctcctaaagtgctgggattacaggcgtgagccatcgtgctgggcccaaattttaaaatacagtataacaaatatttgtatagcatttatattattaggtattataagtaatctagagattatttaaagtatacaggatgacgtgaatttaagttacatggaaatactacacccttttatgtcagggacttgaacatctaagggtttttagttagggggagccggtcctagaaccaatcccctgtaaatgccaagggatgactatatatatatatatatatatacatacatttctgtattactattattatttttgccctcattttaccctatttcacaatttctcttcggttgttacatgtttggaatttattctacaaaattgtgaggtttttttcttttgcagtattccttatgatatgttttagtcaaactgcagaagctaaatatatagttttccagtgaaataagtagtcttttgactctatggtctgtttctacttgcatgatctttgtgtgttactgctttctggttcttatgtatgagtgggttttctctttttgtagctagggtatctcaccaagagtttgatgttaaaatagacaaatgtcaaaaatatgtcatattttgtatccttttattattactgtttttctttgtgtggcttttgactcattaatctttgctctggctttatcttaccccactttagcttttttatgtgctttagaaatgcaccaagtatggcaagttgactgactttgcctatgattgttttgtatttgaacaggagctagactaaaactactggtaaaacaaagaatccaacataaagtgatttaatgacatgggagaaatttgaaaaaatctggtatgatctatgaaactggagttttgtgtgaaaaatactgaaaatctggtatcatctgtggaaaccgatacagatactatgtctacttcctgagcttttgccagtgcaggctggcatagagcatgtaaagatgattatattaaatctatttttggcttgaattgttcacgcatttcttccttttattatttttttatttttttctttttcagatttacagccagttacttactcagaacctgcattttggtgttcgatagcatattatgaattaaatcagagggttggagaaaccttccatgcatcacagccctcactcactgtagatggctttacagacccatcaaattcagagaggttctgcttaggtttactctccaatgttaaccgaaatgccacggtagaaatgacaagaaggcatataggtatgttttattttccttgttgtgaaaaataaatgctgtatactcataatgtaggcattgcatggtgtgccacatcaagagcttgtgtgcagtaaaaccagctttctctctggtggtttaagtgccgacacatttaagtgcacaggcttcactgcttctaatagatcctggtgatgcttcagctgcaaactcttcaacttttatttggcacccttggtactggaaagttcttcaataaatatgtgttaagataagtttaatttgctgagtctctaccagtcataaaattgccatgttcagatttgggggttaatacttttttataaatcatgtttttttgttttgttttgtttttgttttttttcagtttctttatatagctcccaggttttttccccctttggtgagtttatatattaaatgaaatctgcttgctgttcatctgaaatgagatatctaaaacaagaactgcatttaatatagttcaaaatataattcagggacatctcaaaatgtggtctggggacttctggtagtcccagaaaccctttcagctagtttgtgaggtcaaagctattttcatagtagtactgagatgctgtttgccatttctactctcatactctcatgactgtacagtggagtattccagagcctacatgcatatgattttgcaagagatgaaatgtagatttgataatgagactccaattctgttacactagacatgaatgttgaaatgttgccactctatttttttttttttttttttttgctttggaaatatagttgtttttcatagacaaaaatggtgaaatgttgccactctattttttttttttttgctttggaaatacagttgttttttataaacattgttaatatgtaatggatttgatttttaaatgaattttttaaatctcagtttttatatctaatatggtcattttccataatattcacataaacaaaagctctttggggtcctcagtatttccttaacgatgaagtgaaaaagtgtgagaaccattcataattgaacatcattctcatcaccttaaagtaacttcttttaacagtagtttgcttctgttttttttctaattaaccattacctcctgtgagaagtaatgctggttatcaaagtgtgattttgatactgcaaaatgatagtgactagaagatctattacttggttccaagtggaagttctcaaatcttgcttgatgtataaatttggataatcttattaagatacccagtgtcgctgtaggtgctttaactaaaatagttttttgtttttgtgacttaattggggttctgcaaaaaaatttaatgggttttctctgccttattctcttctccctccaaagttttagattgctgtcgttattggatttttttaaattttttatttctagttttataggtgatattgatcagggaatatagcctgaaaaatctctactttttggacttagtgttttcccaatgaccacgtgcatgactgttttacagatattccatagtcttaacagaaccaccgtaccaggttctgtattaaatctggagtgttagttgtttgattagttttcttttgctgtgtaacaaattaccacaaactcagtggcctaaaacatcagttttttacctcacggtttctgtgggtcaggagtccagacatgggttaggcggtcttttcagggtttaacaaggccaaaattgaggtatcagctggcttgtgttcttatctggagcttgaggtcctcttctaaacccacatggttgtggcagaattcagctcctagatgcctcctgaattccttgtcacatggtgccatccatcttcaaagtcagcaatggagaatgtctcttgtgttgaatacctttcatgctttgaatcacttagcctatgacagtctagtcccttttaaaggattgcctgattaaggttaactgatttgctgccttaattacatctgaaaaaatccttaacagcagcacctagtgtttgattaacagagaatgtatgtgcacctcagggctgagactcttaggtgtcatgttagaactctgcttctcacaattttttttttaattcttatatctcatattattttgcatctgtgatctctcagattctgaaagaagtatattaaaaatctcccagtagaattttttctcacctaatcatgcttatacatctagaggttgggtttccaccataatatatagtttttaaaatggcaaatgactttttgatgtttttacatcttttttcttaacattaagtgggatctctaagaaactacagttgtaatgaagatatatttctccaaacattagtgaattccttcaaaattaactcaatcttttacttatcttaatatatatcatttgtatgaaactattttactatgtgtactttttctacattgtttaaatactttcagtcagtacacatgtattttaaaatcaataaaattattgttagaaaatacttgggagaaatatacagtagtatatttaaagttagacttcagaaagacattatctgtgaaaaagatcctggaaataccttatatcattttagaatttttccaagaaaatgcttccaaagtcacactgaaatagtaaatgttacaaaactaatctcatttgtattttgtttcaggaagaggagtgcgcttatactacataggtggggaagtttttgctgagtgcctaagtgatagtgcaatctttgtgcagagccccaattgtaatcagagatatggctggcaccctgcaacagtgtgtaaaattccaccaggtatggattcaataatgtacataaacctatcatgtcaacttgcttagtttttcttgttgctaattttaggaatcagtagatgattgcatgctcatattctaaaacttgtaacccttttaaaattactttttaataatgatactcttttgacaatttcttttaccttttttaatcataggctgtaatctgaagatcttcaacaaccaggaatttgctgctcttctggctcagtctgttaatcagggttttgaagccgtctatcagctaactagaatgtgcaccataagaatgagttttgtgaaagggtggggagcagaataccggtatgaaatacatatttggttcttaaatttccacagtgtaattatgtttcattgcattcttgcatattctggagttcatttgtatctattttcaatgaggttatagagtcagctgatctttatgtaaaataaagttggaggcctccaaattcaaaactgttgcaaattactgagctgccattatggaagatattaaaacatgcacaggcgtgcattttaacgtaattcagagtgttaaatatcataaaaggggtgtatatgaagggttatgtcagtttatggaaggagagatgtttgcacacggtgctcaaggaaaacttgatggcacatgatctagttgtaaaaggtgcattggatttcaatagtcataaatggggtgggcagagttgggaagtgataatcttgacaatagcatagcaattcagtttggagaatagaaaaataaggctggacaattaaattgagacaaactagatgtaggttaagaggaggaacttcattcagaagtagaaggaatacttgctaatgtgccaggcactgtgctgttttaagtgtagtatctaaaaattattatttctgttgtcaattcattctttgtaaggttgaaatatatgaaattgccatcgttgcaggtaacacatggttcaaactaatacatatttggaaatagacatagaaagctgataatttgcccaaggttacattataagtggttgagatgggactggaagatagttctcctggactctttacctcttttataaggatagtagtaacaattatgtttaagttttacaaaaactaatttgtcatcagtggataagatagtctagattattgatgaattaaacaatagattggatttcacatcaaagagagagaagacttcttgaccatatttaagagtaggaattaagtaaaatacttagtctttcttcaattcgtattgcttactccatatgcctgcttaagaaatattcatgtaatatagtgattgtattcctgcttcttccagcaatttagtcccttccaaatttatttgttttggacttgcttgtctatcttaagttttgtcagaaatctgatttgagattgtgcaatgtgaggtctacttgttgaatacatttaaaaatatatggtatatatttgtatcagagaatgaagacttgtcactatttttttctgagttatattggtagaataattcattttgtgattttgctgtagttctgttttgattattacccttttgagatgttgttacctgttaagaatgctgaatgccgttttttaaaattagacttgacctgagttgatagcaaaattagatttaaattatattgtctaataagatttcaggtcagacttttttttgttcttcagaaggttagaataatgcaaaatatggtaggaatttagtggaagtaagagtgaattacagagagaattccatgtgtatctatagatctgctaagaacagttttacttggtaaagatactgcccttcttcattcactgtggactctgctgttctttaactcacagataaagtaaaatctgtaattacagaagcagtaatatgcagtatgtttttatgagtattgggagtcaggtacatctgactttggaaaatcaagtagtttcctgtaacatttacaaatcaaaatggcaaatatccatctatctgtggatatgtgggtagctaccaggaacttactgtctgtaatcattctggagctgaggaaatagacctaatgtttaggtttctaaaactattttttttaaatttccttaatgtcatcttggttgttagcacaaaaatgaggaaatgtagtaaacaggaaatttagatgtatgaagaatttgtatttaatcgagtggcagccttcttaaacctactccccttgggtgacctggattatggattattctagaaagggaagtgggacaggggagaacagggcagccaggaccattgttaagccatctaccagagtgggtgggtcactagaactgacacccttggggaaactctaggaaacagtaaacagtctacagaattatcctacccaggggaacagaagtgctgggcatgtaaatgtcaatttctgtttccttggttgagggctgctcctggggatgcttctttcctggcacctctagcctttttgggtatatcagagaagttcctgggcacagaaatgcagatacctgcagttggaagttgtctagagcacactgaaaaatccaaagggtacagtggggcactgataccatctgcctcagaaagtgacatccttggaagtacagttttaaattacattgaacatgtgttgcttggagatgaagagttgataatgggcttttctcatatttgaagggctgttagtttgtagaagcaagtggatttattgactttattctgtatagcaaataagatggaactaaaatcagcgcatggaagtgacaggatgtcattgaataatttgtaattctcttagagttgccccttttgttgaagcactattaaaagcccgaatggtgttgctaagagggatgttcattggctttggcagggaaagttgaattccagcttttaacactctctgtggtgtgggtttagcttgggccaaaattttgtttttgctttggtatacttttacttagattctgtttgatatttgagtatctactattctgtggttgatttggtaagtacagttactttatgtcttggtttgcttggacaatcctgattcacgtgtctccttttggcctgatttttttctgccccccaccccgagacagagtctcactctgtcgccaggctagagtgcagtggcatgatctcggctcactgcagcctctgcctcttgggttcaagtgactctcctgtctcagcctcccgagtagctgggactacaggcacacgccaccacgcccagctaatttttatatttttagtagagacggggtttcaccatgttggccaggatggtctcaatctcttgaccttgtgatccgcctgcctcggcctcccaaagtgctgggcttacaggtgtgagccaccacgcctggccctggcctgatattaatagtatctacattctctctcaggtgttccattttggatgatggtgaataataagatcaccttattaattttagtgcgatgagaaaaagatgttcttgtaaatcacttctaaaacaaggtcatcagaagtactttgactttgaggatcaaccattttgcggaataatcgtgtccaaaattatatacacaaccttttaatttctgtaaatttttaatgcagtgtacctaaacatagccattttccctgcctgtggacttgaatttcataatcattttcctgtattcttttaaacagaaggcagacggtaacaagtactccttgctggattgaacttcatctgaatggacctctacagtggttggacaaagtattaactcagatgggatccccttcagtgcgttgctcaagcatgtcataaagcttcaccaatcaagtcccatgaaaagacttaatgtaacaactcttctgtcatagcattgtgtgtggtccctatggactgtttactatccaaaagttcaagagagaaaacagcacttgaggtctcatcaattaaagcaccttgtggaatctgtttcctatatttgaatattagatgggaaaattagtgtctagaaatactctcccattaaagaggaagagaagattttaaagacttaatgatgtcttattgggcataaaactgagtgtcccaaaggtttattaataacagtagtagttatgtgtacaggtaatgtatcatgatccagtatcacagtattgtgctgtttatatacatttttagtttgcatagatgaggtgtgtgtgtgcgctgcttcttgatctaggcaaacctttataaagttgcagtacctaatctgttattcccacttctctgttatttttgtgtgtcttttttaatatataatatatatcaagattttcaaattatttagaagcagattttcctgtagaaaaactaatttttctgccttttaccaaaaataaactcttgggggaagaaaagtggattaacttttgaaatccttgaccttaatgtgttcagtggggcttaaacagtcattctttttgtggttttttgtttttttttgtttttttttttaactgctaaatcttattataaggaaaccatactgaaaacctttccaagcctcttttttccattcccatttttgtcctcataatcaaaacagcataacatgacatcatcaccagtaatagttgcattgatactgctggcaccagttaattctgggatacagtaagaattcatatggagaaagtccctttgtcttatgcccaaatttcaacaggaataattggcttgtataatctagcagtctgttgatttatccttccacctcataaaaaatgcataggtggcagtataattattttcagggatatgctagaattacttccacatatttatccctttttaaaaaagctaatctataaataccgtttttccaaaggtattttacaatatttcaacagcagaccttctgctcttcgagtagtttgatttggtttagtaaccagattgcattatgaaatgggccttttgtaaatgtaattgtttctgcaaaatacctagaaaagtgatgctgaggtaggatcagcagatatgggccatctgtttttaaagtatgttgtattcagtttataaattgattgttattctacacataattatgaattcagaattttaaaaattgggggaaaagccatttatttagcaagttttttagcttataagttacctgcagtctgagctgttcttaactgatcctggttttgtgattgacaatatttcatgctctgtagtgagaggagatttccgaaactctgttgctagttcattctgcagcaaataattattatgtctgatgttgactcattgcagtttaaacatttcttcttgtttgcatcttagtagaaatggaaaataaccactcctggtcgtcttttcataaattttcatatttttgaagctgtctttggtacttgttctttgaaatcatatccacctgtctctataggtatcattttcaatactttcaacatttggtggttttctattgggtactccccattttcctatatttgtgtgtatatgtatgtgttcatgtaaatttggtatagtaattttttattcattcaacaaatatttattgttcacctgtttgtaccaggaacttttcttagtctttgggtaaaggtgaacaagacaactacagttcctgcctttgctgagacagcagttacactaacccttaattatcttacttgtctatgaaggagataaacagggtactgtactggagaataacagatgggatgcttcaggtaggacatcaaggaaagcctctaaggaaaggatgcatgagctaacacctgacattaaagaagcaagccaagtgaggagccaggggagataagcattcctggcaaagagaatagcatcaaatgcaaaaaggttcacactaaaggaaactcctgattaggtattaatgctttatacagaaacctctatacaaatccaaacttgaagatcagaatggttctacagttcataacattttgaaggtggccttattttgtgatagtctgcttcatgtgattctcactaacatatctccttcctcaacctttgctgtaaaaatttcatttgcaccacatcagtactacttaatttaacaagcttttgttgtgtaagctctcactgttttagtgccctgctgcttgcttccagactttgtgctgtccagtaattatgtcttccactacccatcttgtgagcagagtaaatgtcctaggtaataccactatcaggcctgtaggagatactcagtggagcctctgcccttctttttcttacttgagaacttgtaatggtgttagggaacagttgtaggggcagaaaacaactctgaaagtggtagaaggtcctgatcttggtggttactcttgcattactgtgttaggtcaagcagtgcctactatgctgtttcagtagtggagcgcatctctacagttctgatgcgatttttctgtacagtatgaaattgggactcaactctttgaaaacacctattgagcagttatacctgttgagcagtttacttcctggttgtaattacatttgtgtgaatgtgtttgatgctttttaacgagatgatgttttttgtattttatctactgtggcctgattttttttttgttttctgcccctccccccatttataggtgtggttttcatttttctaagtgatagaatcccctctttgttgaatttttgtctttatttaaattagcaacattacttaggatttattcttcacaatactgttaattttctaggaatgatgacctgagaaccgaatggccatgctttctatcacatttctaagatgagtaatattttttccagtaggttccacagagacaccttgggggctggcttaggggaggctgttggagttctcactgacttagtggcatatttattctgtactgaagaactgcatggggtttcttttggaaagagtttcattgctttaaaaagaagctcagaaagtctttataaccactggtcaacgattagaaaaatataactggatttaggcctaccttctggaataccgctgattgtgctctttttatcctactttaaagaagctttcatgattagatttgagctatatcagttataccgattataccttataatacacattcagttagtaaacatttattgatgcctgttgtttgcccagccactgtgatggatattgaataataaaaagatgactaggacggggccctgacccttgagctgtgcttggtcttgtagaggttgtgttttttttcctcaggacctgtcactttggcagaaggaaatctgcctaatttttcttgaaagctaaattttctttgtaagtttttacaaattgtttaatacctagttgtattttttaccttaagccacattgagttttgcttgatttgtctgtcttttaaacactgtcaaatgctttcccttttgttaaaattattttaatttcactttttttgtgcccttgtcaatttaagactaagactttgaaggtaaaacaaacaaacaaacatcagtcttagtctcttgctagttgaaatcaaataaaagaaaatatatacccagttggtttctctacctcttaaaagcttcccatatatacctttaagatccttctcttttttctttaactactaaataggttcagcatttattcagtgttagataccctcttcgtctgagggtggcgtaggtttatgttgggatataaagtaacacaagacaatcttcactgtacataaaatatgtcttcatgtacagtctttactttaaaagctgaacattccaatttgcgccttccctcccaagcccctgcccaccaagtatctctttagatatctagtctgtggacatgaacaatgaatacttttttcttactctgatcgaaggcattgatacttagacatatcaaacatttcttcctttcatatgctttactttgctaaatctattatattcattgcctgaattttattcttcctttctacctgacaacacacatccaggtggtacttgctggttatcctctttcttgttagccttgttttttgttttttttttttttttttgagagggagtctcgctctgttgcccaacctggagtgcagtggtgcgatcttggttcactgcaagctccgcctcccgggttcacgccatgcttctgcctcagcctcccaagtagctgggactacaggcgcccaccaccacactcggctaattttttgtatttttagtagagacggggtttcaccgtgttggccaggatggtctcgatctcctgacctcgtgatctgtccacctcggcttcccaaagtgctgggattacaggcatgagccaccgcgcccagcctagccatatttttatctgcatatatcagaatgtttctctcctttgaacttattaacaaaaaaggaacatgcttttcatacctagagtcctaatttcttcatcatgaaggttgctattcaaattgatcaatcattttaattttacaaatggctcaaaaattctgttcagtaaatgtctttgtgactggcaaatggcataaattatgtttaagattatgaacttttctgacagttgcagccaatgttttccctacgataccagatttccatcttggggcatattggattgttgtatttaagacagtcagaataatgatagtgtgtggtctccagaggtagtcagaatcctgctattgagttctttttatatcttccttttcaattttttattaccattttgtttgtttagactacactttgtagggattgaggggcaaattatctcttggagtggaattcctgtgttttgagccttacaaccaggaaatatgagctatactagatagcctcatgatagcatttacgataagaacttatctcgtgtgttcatgtaattttttgagtaggaactgttttatcttgaatattgtagctaactatatatagcagaactgcctcagtctttttaagaaggaaataaataatatatgtgtatgaatttatatatacatatacactcatagacaaacttaacagttggggtcattctaacagttaaaacaattgttccattgtttaaatctcagatcctggtaaaatgttcttaatttgtctgtgtacattttcctttcatggacagaccattggagtacattaattttcttaatctgccatttggcagttcatttaatataccattttttggcaacttggtaactaagaatcacagccaaaatttgttaacatcaaagaaagctctgccatataccccgttactaaattattatacatccagcagattctgggatgtactaacttagggttaactttgttgttgttgataatactagattgctccctctttaattcttcttctggtgcaaggttgctgcttaagttaccctgggaaatactactacaaggtcaaattttctagtatcttacagcctgattgaaggtgattcagatctttgctcaatataaatggattttccaagattctctgggccatccttgacccacaggtgatctcgctggagtatattaacttaacttcagtgccagttggtttggtgccatgagatccataatgaatccagaacttcaccattgcttagatataagagtcccttggaagaataatgccactgatgatgggggtcagaaggtgtattaactcaacatagagggcttttagatttttcttcaaaaaaatttcgagaaaagtattcttttaccctccaaacagttaacagctcttagtttctccaaatatgctctttgatttacttatttttaattaaagatggtaatttattgaacaatgaaatccgtaatatattgatttaaggacaaaagtgaagttttagaattataaaagtacttaaatattatatattttccatttcataattgttttcctttctctgtggctttaaagtttttgactattttacaatgttaatcactaggtaacttgccatatttctggttctatattaagttctatcctttataatgctgttattataaagctggtttttagcatttgtctgtagcaatagaaattttactaagtctctgttctcccagtaagttttttcttttctcagtaagtccctaagaaaacatttgtttgccactcttactattcccaatcttggattgttcgagctgaaaaaaaatttgatgagaaacaggaggatccttttctggtgaatataggttcctgctttaagaatgtggaaatccattgctttatataactaatatacacacagattaattaaaattgtgagaaataattcacacatgacaagtaggtaacatgcatgagttttgaatttttttaaaaacccaactgtttgacaaaatatagaacccaaattggtactttcttagaccagtgtaacctcacacctcagttttgcttttccaaccctgacttgaaaggcatatttgtatctttttattagtgatagtgaagctgtgacactaaccttttatacaaaagagtaaagaaagaaaaactacagcgattaagatgagaacagttctgcagttgttgaactagatcacagcattgtaggcagaataaaaaatgttcatatctgagaatattcctttcgccatcttttcccaaggccagacctcctggtggagcacagttaaaagtaacattctgggcctttgtaatcggagggctgtgtctccagctggcagcctttgttttaatatataatgcaggactgtggaaaacagttggcatagaatattttcacctaaaaaagaaagaaaagacatacaaaactggattaattgcaaaaagagaatacagtaaaataccatataactggacaaagctagaagaacctttagaagatttgtctgaaaacagatttcaagagtgagcttttatacactgctcactaatttgcttgattactaccaactcttcttaaagttaacacgtttaaggtatttctggacttcctagccttttagcaagcttagaggaactagccattagctagtgatgtaaaaatattttggggactgatgcccttaaaggttatgcccttgaaagttcttaccttttctctagtgatattaaggaacgagtgggtagtgttctcagggtgaccagctgccctaaagtgcctgggattgagggtttccctggatgcgggactttccctggatacaaaacttttagcagagttttgtatatatgtggatttttctgataagtagcacatcagaggccttaaccactgcccaaaagcgattctccattgagagtacatatcttgaacttaagaaattcatttgctctgatttttaatcttgtaaagtttttgctaaactcaaaacaagtcccaggcacaccagaaggagctgaccaccttaggtgttcttgtgatttatccttacttccctatgttgtcatagttgcttctaaactcagctgcactatggctgtcaacatttctgatacttattgggatatgtgccatccagtcatttagtactttgaatggaacatgagatttataacacaggtaatagctgaaggtaccagtatggtggtgagactcacacttagtgatccagctaaggtaactgatgttataatggaacagagaagaggccaactagatagctaagttcttctgaacctatgtgtatatgtaagtacaaatcatgcgtccttatggggttaaacttaatctgaaatttacatttttcatagtaaaaggaaaccaattgttgcagatttcttttcttgtgaggaaatacatggcctttgatgctctggcgtctactgcatttcccagtctgttctgctcgagaagccagaatgtgttgttaacatttttccgtgaatgttgtgttaaaatgattaaatgcatcagccaatggcaagtgaaggaattgggtgtcctgatgcagactgagcagtttctctcaattgtagcctcatactcataaggtgcttaccagctagaacattgagcacgtgaggtgagattttttttctctgatggcattaactttgtaatgcaatatgatggatgcagaccctgttcttgtttccctctggaagtccttagtggctgcatccttggtgcactgtgatggagatattaaatgtgttctttgtgagctttcgttctatgattgtcaaaagtacgatgtggttccttttttatttttattaaacaatgagctgaggctttattacagctggttttcaagttaaaattgttgaatactgatgtctttctcccacctacaccaaatattttagtctatttaaagtacaaaaaaagttctgcttaagaaaacattgcttacatgtcctgtgatttctggtcaatttttatatatatttgtgtgcatcatctgtatgtgctttcactttttaccttgtttgctcttacctgtgttaacagccctgtcaccgttgaaaggtggacagttttcctagcattaaaagaaagccatttgagttgtttaccatgtta

SEQ ID NO: 19 - DNA, 49535 bp, Homo sapiens
caacaacacggccctggtcgtcgtcgccgctgcggtaacggagcggtttgggtggcggagcctgcgttcgcgccttcccgctctcctcgggaggcccttcctgctctcccctaggctccgcggccgcccagggggtgggagcgggtgaggggagccaggcgcccagcgagagaggccccccgccgcagggcggcccgggagctcgaggcggtccggcccgcgcgggcagcggcgcggcgctgaggaggggcggcctggccgggacgcctcggggcgggggccgaggagctctccgggccgccggggaaagctacgggcccggtgcgtccgcggaccagcagcgcgggagagcggactcccctcgccaccgcccgagcccaggtaaccgcgccatgtcccctccccttcccccggccgggcccgcgcaccccgcctgtggcttccccgccccggggcgggctcccgacgacggcggcggcggcggcggcggctgggagcgcgcggaatcctctgggagggcgaccgcggcggcctgacgagccgggccgggcgggccggctgaatgccgggcggcggtgcctcgcgtccctcgggcccccagctccgcttgcagctcgtgggagaatcaagttaaactcggacgggactcctgccgcggccgccgctcctctttgttgttctcagtagtttcacggtcgccccggctgagcgcgttgggtcggctggaatgtgttgccttagggtctaagtgaaagttgtaaattgtttgtctaaatttattttctccagccaatttctgttttgtctttgtcccctactttctcttcctagtcttgtcatgccagtttacgcttctggctttgatatgtttactttttgagtactgagagtgacagcggtatgcaggacacattcttagcacctaactgaacccctccttgcccccaataaaacatgcttcctaataaaagacacagctgatcttactgttagcactgcatgtactgacagtgaaattggtgtagggtggagggcggtggctccatcacttgtcccaaactgctgttaggatttctcaaactagattttcaaagacacaagtgtgtttagttaacctgaaaggtttatttgctggtgcagaggctttaaaaagccctgttgaagattgatagctgtttcccttcaaaaacctaagtacgtttgtttttatttaaaaaaacacatttatttcccaattagtttcttaatgcatttagtttttgcaccgtagtttaaggtggaattgccagttatttaggaataataaacacaacaggataatagcggaattaccctgaattgactttctgcaaacatataatcttagctaatttttgttagtaacctttgacttttgccagaattagcatccttctagtcttagtagcagcttggttactcgggtgttttaagaagtaggttcactcctttttgctggcaaaaaccatttagtatcaaaaaaaaaaaaatgcgtaatttcgtaattagatttagaacaaggcatttgaataatttttatggtggatttcataaattacttttgccataccctgcagagactagataatatatatttcagttgaaatctaggaagttctaaaatgtaacttttttttaatgctaaggacttactctctctatattggaaagttctgatatgattagtacataatattccaaactgtaaaatgattaacatttaaaaatacggtttttaaaattagtgtttcttccataatgctgtcatgattttgtttacttaaatgggtttgttacagaacaaatgtaatagagatggaccaagcatttgtaattcggagtagctttaggtctaaagacgatggtgaattatgtaggtttaagttgttggaattaaaactaaaagcttcttttgataaaagtcgttataacattttgtgactctattaatagaagtggctttttctttgctttccaggtttttgggcgagttttaaagaagtattgcatcttcgttttttttatttttgaagtgggagtgtatgtttctgtttaggtcactgccttcattgtaaatcttgagtttagaaaaaaccaaactgcaaatctgtttttcagacttaatgaaaatttgtgccgagaaagtcactttgaaatattttggaataagttttacatgaatgattgatcttttatgatagctttgctgtttgaagcaattctccctctactaggaagcagcaaatcttacttttaaaaacctctgcttcactttcttaagctacattttagtcgagcgattgtgtgtgaattctttttctgtattccccttcagtttttctttctccccgcaaattaaggagcgagaattaacctaatttatgctgcccagtcacactccagctctcccacttggaagcagtttttttctgattgagccagtgttatagtaacatcattagacactattctaattgaggtgtgagttactgaggcctctgctagggaggttaaccctacagaatctgtagggttcattatatttaaactgcatatttcggcttgtctaaatttttgcctattttggtgaaaacatgttgttttgtcgatgtttaaacttagttcattttgtccctctctagttcatgactaaccatttttttcatttttaatccagcgatttttttagagtggttctttaagcatcttgtattagccatttcaatggtcattatatatgtttggatttctcttattttgttgaactagaagactgtgtggttacgccccaaaatttttttttgtcttaaagccatgatgaatggggtgactctgaggtgaccattaatcgcgtataaaagtaacctgactaaaatgttttcattgttttctacagttaaaggacttacaccagcataacacagcatttttttttttttttttttttgagatggaggctcgctctgttgtccaggctggagtgcagaggcgcgatctccactcactgcaaaccccgccttccgggttcaagcgattctcctgcgtcagcctcctgagtagctgggattacaggcatgtgccaccacgcttggctaatttttgtgtttttagtagagacgaggtttcgccatgttggccagactggtcttgaacaactgacctcaggtgatccgcccgccttggcctcccaaagtgctgggattacaggcgtgagccactgcgcctgtcctataacagcatttaatacagttttgtaaaattatcacattttgggctttttgttcaacagttgatgaagtctcaattgttttaaaatgagaaattcaaacagttcacaaatatatctagatatattcatttgagctacttgtagaatgatgctgtttgcatatatcaagcatatgcttgatcataagtcagatttagaatttttggattttgttttctctttctaaaatgtgtaattttggtaatgggaaatttgactgaattccagtttctcaggaacaaggtattttaggttgtgtcaccttaacactattacctggtgtaattggcatccgggaacatttgtttttaactatgagagtgaatgaaaactagggtagtgcttacatatgtaaaactaagatggtaggtagtcggattcttacaatttataaggttctcataatctaagccttgatgagttgctactgcaaattatattatagatcagataagtaccaaagaccagttgtaaagagggtctgttaacattttaatcagtttaaaattggcggtaacagtaaagaccgttcagcccaaagactgtatttcattatttatattccaaatgagaattttttgcagtttggaaaacttgtaaatgtgttgaattcatctttttattgcttttttactcccaatgtttagggcaacggtcttttcttctctcctgtctccctccctccctccctttctccctttttcttctttttcttctttttctttttttttttctgagacggagtttcgctcttgtcacccaggctagagtgcaatggtacgatttcggctcactgcaacctccacttgctgggttcaagcgattcccctgcctcagcctcccgagtagctgagattacaggcgtgcgccaccatgccaagctaatttttttgtattattagtagaggacggggtttcaccattttgggcaaggctagtcttgaactcctgacctcaggtgatccacccgcctcagcctcccaaggtgctgggattataggcatgagccaccgcgcccagcctttttttcctttttctttccatcttgctcagtgccccagcctggagtacagtgctgcaatcatagctcactgcagcctctaccacccaggctcaagcaatcccacttcagctgctgcggtagctgggactacaggcacacaccatcacacctgtctaattttttgaaaaatttttgtagagatgggggtctctctctgttgcccaggctggtcttgaactcttgggttcaagtgatcgtcccacctcgacctcccaaagtgctgggattaaaggcatgagccaccacgcctggcaagtagttttcaatcttggctgtacttttagatcccttgaggagctttacaaaatactgatacctgaattctagccccagaaattatgatttggttggtctagggtgcagccaggttagccctccgcagtgattgagtcattagggtcctctgactttttcttttgaactgtttcacttgtgttagctttacattctttaatacagtgttacacacatgtacagtgtagccatctcacacatctaacttaacgggtcttttgaaagtattgccacatttgctttgcttctgtgtctgtctctttcttttctctcccccttcctgtcacctattcctttctcctctgtttctttcttcactttcagtttatttgaactgtctggtagtaagttttaggaagctgtatttcccatgatgagaagttagtatatcatcactattttaaataggaagttgattttcttttaaagtatattctcaaatgcttacttgtactccttttggagactaattactttaagtccccaagttagcatctgaactccctgtgggcttggtctggtggctcacatctataatctcagcacttcaggaggctaaggcaagaggatcacttgagcccaggatttcaaggccagcctgggcaacaaagtgagacctcatctctaaaataaataaataaataaataaatataactcccaatgcaaattgtcttcttagggcgttaatctacttggtaaaccttacattttcaagcccccaattaactagtcacttaactggtttctgagaggcaggttgcattgggctttttctgtcagggcttaattaatacactgtgagacatttgctcagctaggccagctagctagtacttctgtagagatcatctagggcatgttcagctctccatttacatcacctgaagtagttcccaagtgctgggctatggagtagtttcatctctgtctctggaagagctatttaaaaaaataaaaatattttttcccatctgattgcaacacacatgctgcttcagaatgggaatggagtggaggaggcatgggaatctgtgttatttttaaaaagtgcctcttgattctaaaggttttgtttattttggtatgcttatccttactgctttatttatctattttttagagacaggttgcccaggatggagtgcagtaacatcatcatagccctctataaccttcaacttctgggttcaagagatcttgcctcagcctccagagtagctaggactacaggccggcaccaccacgcctggctgatttttttaaaactgttttgtagaaatgggggggcgggggtcttgctttgttgcccaggctagccaaatcttatttatgatttaaaactaggaatgctaccgaatatatatttttatagtaaggtattatttctgtatgttaatatggatgaatgtatgctactcaggtcttttcaagtcaaaatgtatttctaaatataagatgaattaaggatatttgtcagtgatattcactagtgaattctagagcatatgttatcagtagatgggcagtccttgtaaaaattgaataatctagtgaaaggatgaccggaaataatatttaatggggtaagctaagccaggaatcattgtacataaacacattaggtgtgtcttacatcataaatatgcctactaaaactagttgaaggaagaatgtgtatagatgctgaaataatgaaggggctggctaattgtaaggaaaaatgatacaacttctatataattagtctttttaatcagttgcatatactcatgatacttaatttgtaaagtaaagattgtagactagatcaatgctttgtaaaactaacagtacctcagacttccagagtgttttttaaaggtacagccccacccttgattctagttagtggagctggcctaacctgcgggggattttgatacatccccctttgaaggaataagctagatgacttgaaactctgcttcagttaaaagttttatgaaatgaggccgggtgcggtgactcacgcctgtaatctcagcactttgggaggccaaggggggtgcggattacctgaggtcaggagtttgagaccagcctgaccaacatggtgaaaccccgtctctactaaaaatacaaaaattcattgggcatggtggcacatgcctgtaatcccagctactcacatgcctgtaatcccagcttcttgggaggctgaggcaagagaattgcttgagcctgggagacagaggttgcagtgagctgagattgtgccactgcactccagcctagctgacagagcgagactgtctcaaaaaaacaaaaaaagttttataaaatgtatttttcagttatcagttattaaaattcagtttggtttccaccatcttttaaaacagtggttcccaaagtatggtccacagactcctggagatccctaggatccttatatttaaggggttcacaaaatcaaaattattttcataatgaaactgagacgttatttgccctttcactgtgaggacatttgtatgggtggtgaaggagcagtggtgggtaaactgctggcactttaaaatgactctaggcagttataccaaacatatgagtcctcattgtgttctttatagtcaaacacacataagcatttgaaaaaatgccggtttcacttaataatccccttgctgcagcagtaaaaaggtttaattttaaaaaaatctctaccttggagtatgtctttttaatagtgtgattaaatgggaagtatgcataaagcatttctgcacattgaagtacagtgttcttttctaggaaaagcacttgtgttattgagctgcaagctgaactagctgctttttagtgggacaccatttttatttttatttaacaggatgacagataagctcagatagctatttagatttgagtatttggcaggtaattccttggaaatgaataaagtgagctggccacttcgaggagaacatttatagccagtgctaaaatctgatgtttcaagtgaaaatcagatttttgggaaactcctgtcactatgacttgccagtttcttaatacttaaagacttttctgatgagatgggtggtgatattaaggaatgtgattaaaaaaaatatgttgggctgggcacgatgatgcacacccatatttctagcactgtgggaggcggaggtgggagaattgcttttggccaagagttcgagaccctgtttctacaataacatataaaaattaggtgtagtggcatgtagttctagctgctcaggagggtgaggtgagaagattgcttcagccagggagttcaaggctggattaagctaggatcgcaccactgcactcgggcctaggctacagagcgagactgtgggggggggggcagtatgaggaagtgtgtcaacactgggaagatctgtgtaactcattgaaccaatattttcccaaatgaccaattcatgttacaaaatcgtgcatgggtaggcgatccgttcaaagtacaacatagacaaatggatttttatatacaccagagccaaaaagttcactgatacagtgaattccacattgcaactaacctttcagaattgccacttgagttttggtgttgaataaaagatgaatatccattgttttctgagaaggctgttaaaatactcctctcttccaattagctgtccatgtgagacacgttttcttcatgtactttaaacaaaacaacatatcatagcagattgaatgcagaagcagatatgggaatccagctgtctcctattaagctaggcattaagagaaatttgtgaagatgtaaaacagtgttactctgattcctgactttgttttagaaaattctgtttttcataagatgtttatattaacgtaatgggtttattattttaaatgaattaataaagcaaataccaaaaattttagtagttttatttatttataatatgataaatatcaatgtatatagcccgcataaaagctatttggtgtctttaataatgaagagtataaataaaggtccaacttggccaacatgacgaaaccctttctctactaaacatacaaaaattagctgggcatggtggtacatgtctgtaatcccagctacttgggaggctgaggcacgagaatcacttgaacctgggaggcggaggttgcagagagctgagaacatgcctctgcagtccagcctgggcaacagactgagactatgtctcagaaaaagaatatgaataaagggatcctgagatcagagagtttgacagctgctgttttaaagtaactatttctatgcattatcgactaaattactgattgattgaattgtttttatggtttgtactatattgctgttatttctaaggacgttagtcattcagtttctgttcagttatcagggaacatgtaagagtcagacttaagtaaaaaggggaattcattggcttggtctggagatagagctgacctcagattgctatatccagggtttcaagcagcatcaccaggactcttgactttgctttctttctgtttctcaggtagtttgcaggctaactatccccagcttcaaggaagcatgaagagggccttcccccccccacccccccacccccccaccccccgtagttccatcggaagtgctagagctatgtcacttgcctgccttgcgttctttttcatcagaaacaacactgtggccagggggtggctctggttagtctgggaattgtcccacctggccagatggggagattctccttggaaaatcagactgctgttttacaaatggagaaatacatgctggtacacaaaaactgatgtccacctatagtactttgttatttcttcttttaacagcctttaatttattaatccaaaaagggtaatttttaaataagatcatttaaactgaaggtggcataccaaaatgacatttaagacacataggtaaacaagaagcatacatctcgatttgtcctttgtcattcatcttaaaagttaaaaaaaaactttttgttgcttttattgctgtataaatgtgctcttggaagttcgccaactgccctcagtttgaagaacctcaacttgctgtctaggatttagtctttagcttgtgctgcagacagttgcactaaccgtgaacacctttttttcctgttggtaaacctaagtttagagtttattcctagtaataacattgatatattaccaggcccagcttttttctcctcccctagttaaatttaagcacttttgcgccgggcatggtggctcatacctgtaatccagcactttgggaggccaaggcgggcagatcatgaggtcaggagatcgagaccatcctggccaacgtggtgaaacttgtctctgctaataatacaaaaattagctgggcatggtgatgcgcccctgtagtcccagctactggggaggctgaggcaggagaatcgcttgaacccaggaggcagaagtggcagtgagccaagatggcaccactgcactccagcctgggccacagtgaaactctgtctcaaaaaaaaaaaaaaattttaagcacttttctcaaatattcccatagtaagtagtttattgatcactgatcaaaacacttacaacttctagaaaatacatgtttgacacatataatacagttaattcaaaagtaaactaacatctgagaaaaaatgtcaacactccttacctaaaatacatgaatttacatgagaacctctctctggccagtattcagcctgtttaattttagagagtatcttaattagtttggttatttggctttctcgtccatttattagtatacctatggtcaacgtcaggtgacagcttacaattaatagcaaggctagaggaaaaacaacaggcagataacaagaatcagctgtctcttcttgctaactctttacctctcataactcttgactgcatctaatacctgtatatgttagtgcctttcagataggcctaacttctcatctcttcaaactcaagatatctaaagctgaatttgttacatacctgcttttaaattttttaatcattgagttatctagaaatgggtcgtcttttatttgtcccccctttttcacccttcatatttcagttggttaaagactccagtcttttctacctagaaatagctcactgatttccccctcccctccttggcccattgcccatgccccagtctaggatcttaccgcttttctggtaattgtttcctaactggttttctatttccttttccaaagctgttctccaggctctcactgaagttttctaatacaaatctaatgctgttttttctcctctttctaccatgaacctactctagacaaagctcttatccgtctctgcttttcctcatcattttccttcagcctggcaaattcttattcgtatgtggtaatccattaatactattctaccaatattctgatggctgtcccctggcacatggtagtattgtgcttctttgtctccctcatccctaccttgaaattaggcatggcccagagtttcttgcattggcactgttgacattttaggctggataatttattttgcgtgttgtccagtgcattgcagggtatttagcagcaaccatggcctttagccaccagatgcccagtagtatccagttgtgaccatatattgcctccagatgttgccaagtgtcccctgagggacaaagttgcccctggttgagaactcctggcatggccttatgactttggccagtcaaacatgagcagaagtggtagcctttaaaagaagatatatgagctgtcctatcccttctcctgccatttaaggacatatgtagaaatggagcctttgtcagtctaatttctgagcgatgacagcagtgcccccagttgatctgtgatgaatgtgtattatatcctaagcagaaaataagcttttgttttaagctactgatcttttgggggttggttgtcactgcagcatagactagccaatcctgactgatacgttgtgccaagacctaggttacctatgaactttccatgctccctcatttatagtcccaaatcactttatacctacttcttttagcatttattacttatgtaataatatgtttgggtcttccagattagtagttctcagtggagtaagtactgctctttaagggatgttgtagaaatttgtggatgggtttggtggattggtggccagggatgccatcctgcaatgtgagagacagcgaataattatcttgcatcccacaagactttcagatgccccagaaattcatgtaggaggaaaatataattagcccagaacctaactctataatatatattcactttgccaggagttaaatttcttttaattcatttttttcttgcctgcctgcctccctccctccttccctccctccctccctccctccctccctctctccctctctctttctctctgttttctttctttttccttcctccctccctgcctccctcccttacttcaggctctgttacccaggctggagtgcagtggcgtgatcttggctcactgcaacctctgcctcccaggctcaagccgtcctcccacctcagccttctgagtagctgggactataggcatgtgccaccatgccccactaattttttgtattttttgtagagaggaggtctcactttgttgccaggctggtcctggcaaccgtgcctttgttgccaggctggtcctgagcttaagtgatccaaccatgtcggcctcttaaagtgctgggattacaggcatgagccactgtacccggacttggttgttttgttttttatttttgagaccaaatcttactctgtcacttgggctggagtgcagtggctcagtcatagctcaccgtagccttggtctcctgggctcaagcagtcctcctgccccagcctcttgttaattcattttcttagttcaagttgtttaagagttcaccatttgggaaaatccatgttactgactgcagtgccattgtgctatttgagttgccagtataacacgtttgtcttggaaggtctgaatttgtagctgtcacatttgtaatgattctgtatataagtgctagcatctaacttctttattatacattctaacttagttggcatgcctgagtatttataggtggaagtacacattatatattaagcttttcctcctttttgttatagttagggcattgttaaattttcaaaatatgtttaagtagtttagaattttgtttcagtaaagctaaggtggtgatataaattatttgttggaaaaaaaatgggatgttggtctgagagagtccagacccactttcttactatgggcttcctgtttttgtatctgtagtgctttgtatatacagtgtttgttgaattggtcaatttatgtttcccacatttcttttatgtacgttgttgcatctaattaccacaataaatttgtgaagttgtcagggcaggtgtttccattttatagatgagagaattgagagagatgttaacattcagtcatgcggctagacctttaattagaatatataattttatttatatcgatattatgctcttgcctaccatacttccataatctagaaccatttaatgtaggaatacatctctttattcctgctagtattattttttatatgcataacttttaattatgtttcaggcacttgtggtcataggaatacaataaagagagagatgagaaagctgtttgtttaagaaagcgaggtcattatcatttgtattcaaagcaacttggtattaaaacaaactttgagataccgttaaggccccagcatagcataaattttagaaatgatgacatttgatggtgagattgtggtgaaatagttaacacttaaacattttaattgcattgtagattcatacacatcttttggaatataatatcagaaaatgacttcaaaagtgtctgcactcttctaatttgttgtaagacaattccacagaataaaaagctatggtcagtccagaaacacttgcctggtatatgtcaggaactgtgcatggtgctgggaatttctaaaatgagagtgttgttgctgttttcttggatttctaatttgtggcaacaatgtgagacagatatgtaatcaaataactaatgtgttacattgtaatttacacatgtaatttacaattaaattgtaatcgtaattgttaaattgtaatttaacgtatctttccttttccctctttcccgattcctttcctttctactgagtctcactctgttgcccaggctggggtgcagtggcacaatcataactcacagcagccttcaactcctgagctcaagcagtcctcctgcctcagcctcctgaggagctgggactacaagcccacactaccatgcctggcgaacctcctacatttttttagacagattttaatagaaaatgcagaaaaatgcgtaatgcattttaggaaaaatcttcttgtaaaactattattatttttttgagatagggtctcactgtgtcacccaggctgtagtgcagtggcacaatcacagctcaccaaggccttgacctcccaaggctcaggtgatcttccagtctcagctccccgcgtagctaggacaacaggcgtgtgccaccacacccagttaatttttttattttgagtaaagatcaggttttgccgtgttgcccaggctggtctcaaactcctgggctcaagcgatccacctgcgtcggcctcccaaagtgctgggattacaggtgtgagccaccgtgcctggccacaattaagcatgttaatatttcaacagtagcttttttactgaacactatgtatcagacacgttatgcagaatttttcctttgagcttctgtataccctccttttaatccagattcagagtaacttcattttctgactactatgaaaactggaattctaattcaaatctcttgactccaaaatctcccatgcaggttatctttggttatttggaaagtgtaccttcagcatgtgtattaatgtgggcaagtgctctaagacatatgaaaaactgcttctctgcatggggtttatgagttgagacagacatttatgtgaaagagataacaacagagggaggagcaagtcttcaatatcaggtgattgatgtacattctgaagaggctcaaaactacaacagtggcagggagaatgggaggagagatagaaaagactgaggtaaagaatcttgtaactgtaacggaatgtagggatagtgaaggaaagaggcacgtcagagatcttttgcaaagcttcccaaggctaggtaattgagtggaattgatactttaacaaaggtcttcagaagaggaagagattttggtagaatgatgagttttattaatcttgtgggaggatactttaaggattcaagtatgcagtaaaagaaaatgaaagcaagataagtctggaatgcaacttcagtgaacaaataaaatacaaacaagcacacaaagtacaggctccagtcctgctttatcttctttattcttaagctaatggccttttcctattctctgtggggtcttgggatcagataagttagttttctacctgttgaatggattctttattaatcttcagtttttgttattttaatttttttgaaaataatttaccctgctgcttttacaggtaaaatcttttgaggaatttagtgatctctttaaagaacagctgtattgagatataatttccataccataaaattcactatttgaaagtgtacaattcagtggtttttactatagtcagagttgtgcaaccatcaccattatcaatttttaggactttttcattataacaaagaaacaccatacccattagcagtcattcctcattccccttcctcccaggccctggcaaccactgatttactttctgtctctgtggatttgcctattctgtatatttcatataaatgggattatataatgtgtgaccttttgtcactgacttctttcacttagcatgtgttttcgaggcttatccatgttataatttgttagtactttattcttttttatggttgaataatatttcgttgtatggaattttatctatgcattcatcagttgatggacatttgagttgtatccattatgaacaacgctgctatgaacattcatgtacaggtttgtgtggacatgggttttcatttccctcaagtagaagtgtgaagagtagaattgctgggtcatatttactctgtttaacattttgtattaataccagactgttttccaaagtacctgtgccattttgtaatcccagcaccaaggagtgagggtccaatttctcggcttcttcaatacttactattgtctttttgatatatccatctcagtaggtatgaagtagcagctcattgtggttttgattttcatttccataatgtctaatgtcgagcatctttcatgtgcttattggccatcgtctttggagaagtgtcctttagaatccttttgttcatttctaaattggggtttttttttttttttaattggtctcttttaacaaaggtgagtgttaactgctaggtagaatttcataccaggcgatggtaaatttttcataaatattagtaatagacttttaggtttaactagtgctgatcctcataagtaatcctttaaaaaagtgctggtaagattttcctttagggtgactagtaaagtcagtaagacttgattgagcatgccactatcataatgagaagacctaactttaatatttttggaatgtcaaaaacagtgacattttaattaagtaattttatttttaaaaattatttttaatggctaatattttgtaagaattttaagtaattttcaactctgagcatcaaattttaattatgtgcattgaatctctgacttaaccagagcaatttcatcttttcccaagtagtcagatctacttcgtaaaatgtgttctgatgtgtgtcttttttttttttcttttttaggttatcctgaatacatgtctaacaattttccttgcaacgttagctgttgtttttcactgtttccaaaggatcaaaattgcttcagaaattggagacatatttgatttaaaaggaaaaacttgaacaaatggacaatatgtctattacgaatacaccaacaagtaatgatgcctgtctgagcattgtgcatagtttgatgtgccatagacaaggtggagagagtgaaacatttgcaaaaagagcaattgaaagtttggtaaagaagctgaaggagaaaaaagatgaattggattctttaataacagctataactacaaatggagctcatcctagtaaatgtgttaccatacagagaacattggatgggaggcttcaggttagtcttataagagtttttctataccctctatggtggcagatttaaaaacttgctacgtttcctttcaagctactacagggtaatttaatttgtgctccatctcttcagatactgtgcatcctgtacaaatatgcattatgggaatttctggaagaatatgcaaaagataaaatcttaaagttttttaatgttctactcagaaaaatgttcaatggagaaaatttggaaaataaaaataaaaagcagaaaacccacacttcgcaagaactacctttagcactttggtattcatttttgtagcctgttgttttcttttttttttttttcctagacggagtcttgctctgtcacccaggctggagtacagtggcgtgatcttggcccactgcaacctccacctcttgggttcaagcaatcctcctgcctcagcctcctaagtagctgggactacaggcaagtgcaaccatgcctggctaatttttgtatttttagtagagatggggtttcaccatgttggtcaggctggtcttgaaccgctgacctcaggtgatccacccgcctcagccttccagaattctggcattacaggcgtgagccactgtgcccagtcgtgttgttttcttttttgatattgtatgtacatttaaacaaccggattacacttagtccttttataatttagaaatctgatatgtttcactgttagcaaatgtttcattggtcacatttttcaggtagaacttcataatacagctcccttgcttaaataaatcttacagaaattttgtcgtagattttaaagttttatttcaagactttacacatagtttctgcaacacagtctttttgcatatttatttattttattttatttttttgagacatggtcttacttttgcccaagctggagtgcagtggtgcaaaacatggctcactgcagccttgacctactgggcttatgcagttctcctgccttagcctcctgagtagctaggactacaggcacataccaccatgcctgggtaattttttattatttgtggagacaagggtcttgccatgttgtccaggctggtcttgaactcctgggctcaagcgatcctcctgccttggcctcccaaagtgataggattacaggtgtgagccaccatgcccagtcactttttacatttttaaaacctgagcacaggccttgaaattataccaaggtttaaattctaggtctgatgtatgacatggccaagttagttattgtgaattttagttttcttatttatgaaatggggattgtaatactgagttggtaggattgtgaggattaaatcagaatatataaaagtgtcttgcataatgtgacacatgaataaatggtcgtttatttttctaggtggctggtcggaaaggatttcctcatgtgatctatgcccgtctctggaggtggcctgatcttcacaaaaatgaactaaaacatgttaaatattgtcagtatgcgtttgacttaaaatgtgatagtgtctgtgtgaatccatatcactacgaacgagttgtatcacctggaattggtaagtagactttgctttcatcctaagaaacataaagggaaaaggatctcaatagtgtttcaatttttgtaagttaaattataaatttggaagatagcccgcgactttaaataaggttaaagaatcagacatttttaatatacgtatttaaatttgaatttaggaacaaacttatattttgactgctaaaaccgagtattgtagttgatattttgcccctttagaacattgtttttgagaaataagatggaaagcattataaatttgaatacttagttatgtattgttagatagcgtttatgctacttctgaattgaaatggttcatgaacttttgtaatctttggtttaaatttacattctctgtttttaaatggaaaatactttcattgtaatgattaatgtttcatttgttttcccctttaaacaattaagatctctcaggattaacactgcagagtaatggtaggtaatctgtttcttactactttctctttgttttgtcctatcctctctgtttttttgttgacctagaattagtttgtgtgagcggcaggcagtaacattaacaagaaaataacttactgctttggaaatgtagattttgaggttaggggcatttaaaactggatttaaaactggatttaaattggctattgctctttgtatttgaactgcaatttatgaactaaagtactgtaaaaaaatatgatagaggaatgcaccaaaaacaaatataaagaatattttttgagttaagacctatttttgaagaaaatctcacagagccagtttaaatggatgttaaatacccagaatatttggtaatttggaatcacatataacatatcctttaaaaataccagtattctaattttccttcatttcagcctaacatttttatgaatgataatgttgagaatggtttaaaattgcactcttttgtattttttcagtcttgttacattttgagtaaataaatcaaggctactttaaagcatatgcccatcacagcttacctaattgtatttttaaaaagaaaaagtgttttaaggtgagaaaatgaaatgtgaatgggggtgtttttgttttttattgtaatatttgagaatggagttttattaaatctttagctctgttacttagaacttaataaactaaaatttctgtaagaactaattaatttgcagagaaactcttataaagaaccactgtcagccaggcacggtggttcacacctgtaatcccagtactttgggaggcttaagcgggtggatcacctgaggtcaggagtttgacaccagcctggccaacatggtgaaaccctgtctttactaaaaatataaaaaattagccaggcatggtggcgggtgcctgtaatcccagctactcaggaggctgaggcaggagaatcgcttgaacccgggaggtggaggttgcagtgagctgagatcacgccattgcactccagcctgggcaacgagcgaaactgtctcaaaaaaaaaaaaagtggggggaggctgggcacggtggctcactcctgtaatcgcagcactttgggaggccgaggagggcggatcacgaggtcaggagatcgagaccatcctggctaacacagtgaaaccccgtctctactaaaaacatacaaaattagccggacgtggtggtgggtgcctgtagtcccagctacttgggaagctgaggcaggagaatggtgtgaacccgggaggcagaggttgcagtgagccgagatagtggcactgcactccagcctggttgacaaagcgagactctgtctcaaaaaaaaaaaaaaaaggaaccactgtcatcttagaaaggtgtgctcttgttctggagggcagttagtagtagtttagcaccttttttgtttgtagaattttagaggtgggtcagaaatactaggtgaccttaaccaaaatttaggaagagtatgcaattctacttgtttttttttttccacctttctcccatatcactggtaatggaggaagactcactgccttgtggtgcttgttagtgattagtaggtttctgacaagtgtgggtttattattaggagctgttgtggtggtctgggaagggttgctttaagattggtgaaaactctgcttctttgctacgcagacattgatattgtatcacttctttttttttttgaaagtaaacacgtttcatatcttcaccattttccatccatgtttttggagaaaacgtttgtctcagtgggtattaaaggttgggagactgcaatgataagtgtgtctgaatctctctatggggctgtttgtgagggggttcaaattctgagtgctcatcacacacctcccctattctaaaattattgatgcactgttattgatgggattgtacgggttgatagcctttctatagtgactgtagggctgtattcagccttgtagatccccctagtggtggttttgtaaaggctgtcttcagtgtcttatttcctcagaaaacaactggtatttctcacagctccttctagatttggacaaaggaatgatacaagagcaggtaactaaaagttaagaaaatgggacagttccttcatttttgagttaaagtcttgtggtaatcatttccagcctatcttttacctttcatgaaactttctatgaccacgttgacctgtgtattcattttaacaagtatttaataagcatgtattgcctggtactgtgttaggttccagggatgcttagataataaggtatgttttgtctactcaagtgagcttatactctagtggaggagagaaaaagtaaataagagagtgataataccatgagataggtgctgtgtcctggttgctggtgatgataaagaacacagacctaaggtgggcccagtggtttcagcttttttgtcacctatagagaatatattctttgaccctcttagaacattttttttttcttttttgagacggagtttcgctcttgttgcccaggctggagtacaatggtgcgatttcggctcactgcaacctccgcctcccgagttcaagcgattctcctgcctcagcctcctgagtagctgggattacaggtgcccgccaccatgcccagcatttttttttgtttgtatttttagtagagatggggtttcaccatgttggccggctggtctcgaactcctgacctcaggcgatccacccgtctcagcctcccaaagtgctgggattacaggcatgagccactgcacccagccctcttagaacattttataatcactatatatatgtataactactctaaaaatatggttaaataataatagctaacactgggtactcgtgtgtcaggtcagactgagctaaatgatttctgagtattgtgtcatcattctcatgatacttctacatgggaggtgggattatttatactttaacagatgaagggactgctacctggagaggtgaaggaacttgcccaagaataggcaactaggaggagccggagtaatgtgtgcttgctattagatatttaaacaatggaaaaatattacaaaagactgcaaactccatgacagcagggatatttgttttgtttatggatatatcccaagtactagaacagtacctggaacagaagtgctcaagaaatattttttcagtgaatgaatttgttgaatgctagcccataaagagaaatatttaacagtttggtatctgtttttctggactttaaaaaatatatactatatgtttttttaattttatttttttgaataggcaatacatggtccataaatcaaaatactataaaaaggtatacagtgaaaagaagtgctcccacccctgcccccattcccccctacctcaggtaatcactttttttagtttctggtgtttccttccagggtttctatatgcaaaaaatacatacctcctttcttacacaaaacgtatactatgcatactgttctggaccttggttttttacttacagtatatgattttttaaacatgcatatgatcatagtgtacaatagtgctttgtaacttgctttgattctcttggcaaaaatatattgcagacttctatccttgttgatacctttagttttacctgagaaacatttattatggattatctggggttaaagagatctgtagaccagtagaagtttcaaacttacatttgggaagtttagccagcatatttagggcaagaaagatttatgggtcataactgtttaaaagcagaatacagttggtacataaagatgttatgattgctgattaaactgaagagtcatctgaaaagcaaaagcagtgagtaccaagttgaccagttgtatcctcaaatcagctagcaaaaccagtaagttggtaaaaagatcccagtcattataacaacaaaaaaaacctaagatgtccaggaattaattagagatgtcaggatttatatgaagaaaatcattgaactttgttgaagggtgtaatataaggctgaataagtgtagacataccaattttgtgccccaaacaatttttttctttttattatttttataacttggccaatgttgatgagtggttgtgttcagttttttttattgatacataatttgttacgcatccttttgattatctttttgtttccataaaatttctaaagaggaactttggaatgggatttataggtcttcagaatatcatcttcatgacttttgatgcatgaacatacttcttaagaggtttttaagaggttgtacatagaaacttgcacaatggatgattattactgccttaaactagtctcaatttaataaaaagtacccatgtaacttaactgatatttacatgtagtagattttttttcaaaggttgacatagggaaagataagggaaatgatatgctggttcttaatgaaaaagggaatgtctttttgtggtctactaattgactgctttaagaagagaacctactgttagttcagtggattgttaagttctggagtagtgttagtttagaagcaataaaggattggttgctaaaggtaaaaagcaaaccttaaaacaataacctaaaaacaaatgggaaggttctgggcagagaattaacattgttaatgcagttcagtttcagttttctttttgtcatacagcagagctaactatttcctggttggttaatggaaagatgttatgctgtatcagctggaatctagctttgcttatgaaggtgtaatcacataggtgaaagatgttgattactgagttttctcacaccatatattaatcaaatactcttatttgggttgggtttctagagggaaatttcagtttgacttttcatttataatttttccgtttggttctaaacctataggggacattacattcagtacacttcatttttaaagaatatgttgcttaacaataattctagatcctgggattggatatctatcagatcccactcatatctccacagtgtgaaattaacaaaaagatatagttaaatactcagtctctatttagaccgaataattgtttttctcagctggacacattttccagccattcggtttttgcctgccttatgtatttaggtgattattcttctaggtttatcaagaaactgaggagtacctttttaggattgttgctggaggctgttgaaacatagactagcttcaaatttgagagtcagattgattgataaaatatatctcatgctgttaccgctgaataaatgacttttgctggtaaagtagtatgcttttaaaataatatgaaaaaattctgaattaaggttagtaatttacactgtaattgattttaggtgttattatattacttgctaataagatttttttttctgggaatagaagcttataaaaatttaaaatatgtttaattttctatatagctccatcaagtatgatggtgaaggatgaatatgtgcatgactttgagggacagccatcgttgtccactgaaggacattcaattcaaaccatccagcatccaccaagtaatcgtgcatcgacagagacatacagcaccccagctctgttagccccatctgagtctaatgctaccagcactgccaactttcccaacattcctgtggcttccacaagtgagttctagaatcagatgtagtcagcaagttgagttttcctaatcattgcttatttatgtgtagtcacttggggggaaactccaagtaagtaaacattaaaagtaactgtagtatctttcataggtaaacaggtattaaacaggtatgcacaatcacttggaatttaagtaatggctttgattataatattgatttaaattaatgatctgatttatactttactattacatgtagcagtaagtagcctcttaagctcccagatatattttggagaaatatttaaataattaacaagtagttttgatccaagatgtttatgaaggtctgtgttaatggaattgcaacctttcttttaatgcggtgttcttattttggtttttctgggacaatattaccttatagtagttgtctgattttctcactgtgcaaagggatcttgacaaatttgttatatattgctcaagatagacattaattaagtcaattttgatataagctaacttctatatctctttttaaaatatatgtgtaattaaaaaaaaaaagtgtttcagaaagatccttcttttctgccatgtcataggagggagaggggctgctaggttcaggtttttgggggcatgatcatatgacctggttctgttacttattttcacagtaaccaaaggtttgatagtttgctgcttggcaaatgaagtagcttttttttcattttttttttttcaattaatcatagagcattgtcttggcatgtgtatggtgttagttgcatgcagttgctaaaggaatttatgtaaacccacatcagaatagatttttgacagctctgggctaatactgtgttagttgctaccgaaagtaccattattgtatttgctttactatcagattagattcaacatagaaattttgatctttggaataaatgggggactgatttctgtaattgtgagttttcaagtgaagtataccagaatttcccctttaattcattacaccacttcaaagcaacatgtttttggtttgctatctaagagatgacagtctcactataggcagcatattctaaatgggtcatataggttaagcacttgagaacccagttccttaatcacttggtgcttctattatctgtctactttttatttaccaaattaggaatatggttgacaaacagtgggtagtgatagaaaataaaagaaggtacattatagccacttgaacgtagattagtgctagagcacagctacctacttctgtttatattatctggagattgaatttctgtgcctttgtcaatgcttactaaagtgacttcattttgactgtgttgtttcctgaggttgaatcctattcaaagattagaaaaagtgatagaaatgaaatgcagctaattttatcctggtatttattgggtagattttaataatcgaataccgtaaatactgtaagttttagaacttgtgtcaaaatgttcccttatgtggtggcatgcgcctgtagtcccagctgctccgggggctgaggcaggagaaatggcgtgaacccgggaggcggagcttgcagtgagcagagagcgagtcactgcactccagcctgggcgacacagcgagactccatctccaaaaaaaaaaaaaaaaaaaaaaaagagggttcccttaggtctcaaaaagtatattgatgaaaagaagttgaactaaaatagaagatttgaaaggctattttacgtgagctgatttagtcgtattgtttaactttattttacatacttagaattgtataagggaagtattcagtatggataactacagtgagtcactttacaatttatgttcttttgacacctgaatattttaagaatttccttttaaatacctgtaaattaaaataatttatcctgtgtagttaatgacaatttttgtaagttagctaagagtattgcctgtagaattgttaaaaatatgaacaaaaccataattaacctttaaagataacttgcagaatctgggggatgagtaggaagggaggttgctaaaatgtcatttttacagataaataatttggggagtattgaaatattctctttagcttttggttttgtaattcttagctttaaggaaatgtgatatgtaaagaaaagaaaaatattccttttctttgatactttgagcaatggtgacatgttactctcttccatctgattatactcccatttagaaaagaatgaggtgatgccagttataaataattataactttagtgctttccaaataggattaacagtcgagttaattaatgctctttaagaaaccaaatttccactttaaaaaaaaagccttaaaaatgtaggacagtaagcaatatcataggatggtttttgaatagaatacaagccaagagaagcttgattctcttggtatattacatacagagagggcaattaatttcttgtacatctgggaatatgatggtgttcttgaaaagaaatgattcttggtttataaaagctcttgaaaaaatttgaaagtagactgatagtttttttgtttgtttttaaccagtaaatggtatattgattggacagcagagctagatctttttaacttcctcatcttcactatcacatcctatttaaaataattttctgctctgcttttctctgtcaaaccctagcattctgccattactagtatcagtgctgatagtgattaatttttcagttttcaacattttcttgagcctggatttttggggtcctaatcagaaaggtccagagagagaggtggatggagtggccaggatgaactgacatacctctgaagaagttaatatgataggccagacgtacagtggtgttttgctggcatttgaaatatgtttgtgaagaaataagccactacaattagttagacattacctaaaatggaataattttgagcttcctcaagttaaagtttgcctttatagatgactgtaggttttttacctgataggccatgggtgagttacactttttgcccatctttatagttgtgcattatcagataaaattggtccttcatttagtatatgaaatcataagatgacatctatgaatgtaccatgttaatgtcttcttgttcctctaggtcagcctgccagtatactggggggcagccatagtgaaggactgttgcagatagcatcagggcctcagccaggacagcagcagaatggatttactggtcagccagctacttaccatcatagtatgtacatactttaaaaaatcttttaaatagttgagaaaaaagtaggcagcctttataaaagcaaattaacccatgtgggccttaatttttagacagcactaccacctggactggaagtaggactgcaccatacacacctaatttgcctcaccaccaaaacggccatcttcagcaccacccgcctatgccgccccatcccggacattactgtaagctcttgtttttgttgtaagggctattttttttttttttttggtagggctttgttttctgttttttaaaaatgtttttacatcttttattcatcctgtgattttgtttcattaaatagtgcttttcagtattttttgtaaacagtattatttttcatagttatcctacctttttattttagaggagtgatgtttgctaaatacatttatttctctgttgctaatgtttcattaacatcacattgatttccattcatttgtttgtttgctttgtatatgttcttagatctcatctgtgtcttgtatatccacgcataatggattgaaaccctttgagtgctaagttctcaaggtttccctcagcgtagtattcagtgtactttggataatgttgaatctatagataactctgtgctggcatgattgggaggaataccctacagataacatgtagtttcaggtagaataggagcattgttcatatggcttagtaaaatcgagagtataactcttatatacattaaatccctttcttctcattataatattaatagtaccaaagaaaacttagaaaatatagaaaagtataaataagaaaagcaaaattaccctgaatcctgctactcaaaaacagccacttctaatattttgttattttccttccagtcatataaacaggtatatgtaaattgacaggggctcctactctatgtgtattgtatatatcttgcttcttttcagttatgttactattttttccatttcttaagagaatgtaatttttaatggctgcctaggccgtcatagtgttgaagggtgctgggtttggacctttaacaggctgtgtgaccattgacaagttatttcacctcattaagcctcaagagtaataatagtagtatctacctcaaggggtgttcgtaagaagtaaacgtaataatttatgtgaggtgtttagcacagtgttttaacacattaccagttttcaattatgttagctatgattccattaaataaacatccttaattaacataagcacttgtttttagaatagacctaacagtttattattatacattgcattataaattgtactgtattggacgttacatgaataattcatttatgatctgtattaaatgttggatataaaattatgtgtaaattgtgtaataatagcacttggcagatagcactgaaatgttagttattaaatatccacaaaagtattaatagtttaagactatttgcttattgtaaacttttaagttcttagacattgcataagcttgttttaaacaattcctaacctataatagttatatttaagtaagatttactgaaagttttagcattagacaacttttagtaaataaaaatggaatttttgttgtcttttctttagggcctgttcacaatgagcttgcattccagcctcccatttccaatcatcctggtaagtgtatttcaaaattgatttcctgtatttagattgatttagtggtgattgaaacgcacaaacacaggctttaatggaattatggggtcacttctcagatgagtacaatactcatcatgacatgagttaatcaacagtttgagtagtcaatatagtcacacatagactgtctatattttattcagtttaactgtccccaaaagaaaagaactatcttttcagctaaaatgagaattacagaaatgctgacttcagcattgaatacataaatatgcagcagaataaaactaggtttcaaaatagaacagctgtaaaactatagcttaaaaagccaggaaagaatcttaagtacatgccgaaaagaaaaataattcactctattcaggatctctggttaactggaatttagaaactatttgattaaattgtatgcaaaagagtaaatcgctaagtagctttcttcagttcaaagtttgtgtataatttttgaaactgtagaggtaataaaacagaaaacacttgaaaataaaatactgaaagtcccttgtaacacaaacatagattttgaatttttttctcatcctttcgtatctgtttttcttagcataaaaagatgcaaatatattacttcagctaatcaccttaattttttggaaactataaactcaattttcctcctaattaaaagaaaattatgaagaattatatttttatttttacttgtttatttttgagagagggcctggctctgttgcccaaactggagtgcagtggcatgatctcagattactacagccttgacctcctagtctcaagcgatcctctcacctcagcttctagagtagctgggactataggcaagggccaccatgcctggctaatgtttgtattttagtagataacagggtctcaccatgttgcccaggctggtctcgaactcctgggctaaagcagtcctcctgctaataattttatttatttatttatttatttatttttttccgagatgggatctcgctatgttgtccaggctggtttcgaactcctagcctcaagtgatcctcctgtcttagcctcccaaagtgctgggattatagacgtgagccaccacaccaagcttgaaaaattaaaaaaatatatttttaaatgattttatttttgatctttgtgggtacataggagatgtatatatttatggggcacatgagatgttttgatacaggcatataatgcatgataatcacatcatggaagatggggtatacatcccttcaagcatttatcttttgtgttacaatctatactctgttagttattttaaagtgtacaattaaattattggctacagtcaccctgttgtgctgtaaaatattagaccttattcattctaactactttttgtactattaaccatcctcaccttcccccaatcccccactacctttcccagcctctggtaaccatccttctactctctgtctctatgggttcaattgttttgatttttagatcccacagataagaacatgtgatgtttgtctttctttgcctgggttctttcacttaacataatacctccagttctatccatgttgtctcaagtgactgaatcgcattttttttatggctgaatagtactccactgtgtataagtcaagcataaagaattttaagcataccggaataatacaggaagttcccccattgtactcattcctcagtttcagccattatcaagtaatgaccaatcttgtttcattcatactcactctctttcttcattctatattattttgaagcaaatcctatattagttttatatgtaaatatcttagtatatatttccagtaaaggtttttaaaacataaacacagcgcccataatgattaattcaaagggtcttaaattcttaaataggtctacataattttctttgtgtaaatgttctgttattgattatgttggtttaatttttcttctagctgtttaaaaaaatagaagggaacatctttgtgtttataacttttctcatattttagtttaagaaatttgtagaatttctagatcaaaaggccatattacagtgacaccagagtgtgagaaccagggttactgtgctggctagcagtagatgtcatagtttaataaactttttgctgatttaagaggcaaatacttgttctggttagggaaaaggtgatattagtggggcagaagcattcttttaacgatatatatttattatcttctgtaacggattttctgtgttacattgtgtgttgtgattttaaacatttttgtaggtcaaggggtctagccttttcataaactttctttttttgagaaatgtaatatacagaaaagtatgtaacacaagtaagtatatagtctaacatcactaaaaccaatactcatgtaaccactacacagattgagaactaaaacattatggcatcccagaaaccctcctaccccatgaattttgtctctgtcaaaacctctttccttctccccagaggtagctactgtcctgctttttatggatatcactttttttttgctcttttatttattttttaaatttttatttatttattttgagatgaactcttgttctgtcacccaggctagagtgcagtcatgcaattcggctcactgcaacctccacctccaggttcaagccattctcctgcctcagcctcccgagtagctgggattataggcacccgccaccatgcctggctaatttttgtattgttagtagagatagggtttcaccatgttatccaggctggtcttgaactcttggcctcaagtgatctctgccccatcggctcccaaaatgctgggattacaggcatgagccaccatgcctggcccttttaaagtgatgaatacatccctaaacagtctagtaatctggctttacttgttttttttttttttttttttttttgagacggagtctcgctctgtcacccaggctggagtgcagtggcgcgacttggctcactgcaacctctgcctcccgggttcacaccattctgcctcagcctcccaagtagctgggactataggcgcccgccaccacgcccggctaatttttgtatttttagtagagacggggtttcactatgttggtcaggctggtctcgaactcctgacctcttgatctgcccgcctcggcctcccaaagtgctgggattacaggcgtgatctaccgtgcctggccctcattttctttttacctagctttataaatacttgtttaaaacaatttaacatttggactgattgtgtaaagaccacttttaagtgttgttactgttttttgttgtgttttttttggccaccaaaacattgggtaattgttgtcttagacaatctctgtagttttggtttaaccagtgtacctatcagttgtttgctgaagcttcttgtccatagcataatgtgataccttcacattacattttctatagacaatatatatatatttttttaaatttttgagacggggtctcactctgtggcctgggctggagtgcagtggcactctcatggcccactgcagccctgacctcccagacttaggtgattctcccatctcagcctcccgtgtagctgggactacaggtggacacaaccacgcccagccaatttttctatttttcgtagagacgcggtttcaccatgttgcccaggctggccttgacctcctgggctcaagtgatctgcccatcttggcctcccaaagtgctgggattataggcatgagccaccatgcccggctgaaaataatttcataaatacttcaaaactggctttttaagaagacactcagtgaagacacttagtgtatcactggtttttatgttctaagcataatgaaatatatgtaaacaaatatttatctttgtgacaagttcattagagtgacatggcaaaacatttgagtttttaagtttttgaattatccaatcttcatgtgatctgttttgataactcctcattgcattggaaagtattttattgcttggcagcattttgaaaagtaattagggtacatagcttttacaagttgttttcttttaaaaaaattttaagcatcaatcatacttcattttaggttattttttttttttccgtaagatctgggtttcttttttgtcattctaagtaactttgttgaaagtaagattgttgaaagttttattgcttcaaattctagtttaaagttcataaacagcttattgagatacagataaatctttcttttaaatatgtcgaacctatttccaccctggggtctttgctttcgcttcctctttgaaatctgttcagtcttcacatagataaaaggttattcaggtcccatcttttcagatgggatgtcccctaccatccagtctgaagtgttcttcccaatcatctgctgttccataccctgttttattttcttcacagtgttcattgttatctgagttatttcatttgtttgcttatttgtctgcccctgcacctctgtgagaacagggactgtagctgttttgttttctactgtgtatgcagtgcctagaaagatccctagatactctgtagatatctgttaaatgagttaaaacaggaaagccaaataatttttatgtatttgggcttgatgtaataattgttgtttacaaataaaaattagaaatacttgatcagttgtctttgtaaaccagagtagcacctcttttttcccagtgatttaaaattatatattattgttcaaatgagtacactaaatacatctccaaagttaaaattgtggtagttaacatgacctgacttcactaaaaataccttttgctatggcataggtgggacaaatgaccttctacccaagagacagttgagaatctgtgtgtacaacaactgtgtgattagagtataattaaccttaactcagggatgggatagctgacttgcttatgcactttctctcaattagggaatctataaaaatatgtcatgagtcgatgttattcaaggacagttccctggaatacatcttagggtcagtgtgtttttaaaaaataaaagttgagactacatagagaatatgtgtagtcaaatgaaataccatggtaaaataatttattttagattctgattatttctgttctttaaattctcagttgacctggtcctttgaggtaagaaccaaattccagattttaaaaaatgacttttagaacttgaggataagtggtaattggaaattaaaaaaaaaaattagtgttttaagaacagtgctaagtactgagctagaaaatagaagacatggaaattcctaccttttaatgcattatgttattttaatccagttgttttgggtgcattacatttccatctcccctccctttaccctttcttttaggaaaaactgtgttgtggagtgcaagtgaaagccttatatctttctcatgggaggatgttctttcccatttatttcctatagctcctgagtattggtgttccattgcttactttgaaatggatgttcaggtaggagagacatttaaggttccttcaagctgccctattgttactgttgatggatacgtggacccttctggaggagatcgcttttgtttgggtcaactctccaatgtccacaggacagaagccattgagagagcaaggtattgattgtatagtcagatagttactttaaaaaattgagcatagtacattgtcttttattcaaggttatgttttcccatgtacattatatgtgttcttaaatataaataaaggaataaaggtcatgttgaaaactcagaatttgtaagcactccatcttaattgtcggtgtttttgttgtttaacatataatgataaaagatagccttttttatgttagtaggtttctatgtttcgaatagtaagtataccttttgaaattcagtttgaaaattttattttctgtgatcatacatttctacaaattactgaaaggaagtaatattaaatgagaacatgtttctgaaagttttacttataatgttaaaaaaattggtaataaaagggaaatggttaagtaaattatgataaatttttccttttttatacagtcattaaaatgtttaaaagtttatataatgaggctgggtgcggtggctcacacctataatcccagcactttgggaggcggagtcaggcagatcacttgaggtcaggagttcgagaccagcctggccaacatggtgaaaccctgtctctaccaaaaattagccatatgtggtggtgtccacctgtaatcccagctactcaggaggctgagacaggagaattgcttgaacccaggaggtggaggttgcagtgagctgagatcgtgccactgcaccccagcctgggtgacagagtgagactccatttcaaaaaaaaaaaaaaaaaaagtttatataatgaaatggaaatgcttacagtgaaatattacaggaacattccattttagctactgtatgatctcggcttttaaggatgtgtgtgctaaagaacataatcttggctctatcacttgctgtcatgtgactttggcaaattacctaacctctaagccattctgcctaatagaattttctgtgatgaagaaaatgatttatatttgcactgtccagttcggtagccactagccacatgtaactattgagcacttaaattatagctcacttgattgactaatcggatttctaattagttttaatttaatttaaatagtcacatgtggctagtggctatcaatttggacagtatgccttagtttctttatctaaaaaaattagaataatagtacttgttgagttgtaagggtttaatgagaattcatactacatgctcctgacacatagtaagtgttgtaaatatgtgcatcattattagatatgaacaggaaaagaaaaaaggaaatatacaaaaatgttaatagctatcttttggttttatgtgatctttatttttaatttttcaatattaagcatgctatacaatctgaactaaaatttaatttaaaatacttatcaagataaaatgtaatttcttttttcttcctaaggttgcacataggcaaaggtgtgcagttggaatgtaaaggtgaaggtgatgtttgggtcaggtgccttagtgaccacgcggtctttgtacagagttactacttagacagagaagctgggcgtgcacctggagatgctgttcataagatctacccaagtgcatatataaaggttagttacaattttatttgaatattttagacttaaagctctatttgttgtcaaaagaattgaaatctgggtggaaggaatggaaaaatgttttatatattaaataataagaaattgtgtttaagtataaaaaacacattttctgagggcatttattgacattatcagtaatctagttttatcgttgccaatttgttacattttgttttttattttatttatttatttatttatttatttttgagacagagtcttgctctcgtcgcccaggctggaatgcagtggcgtgatctcggctcactgcaacctgcgcctcctgggttcaagcaattctcgtgcctcagcatcccaagtagctgggattacaggcacatgttactgtgcctggcaattttttgtatttttagtagagacggggtttcaccatgttggccaggctggtctcgaactcctgacctaaagtgatccgcccaacttggcctcccaaagtgctgggattacaggtgtgaaccactgtgccaggcctgttacatgttttagagtaatacaaaggctcttgaaaatactgagtgaagcctccaaagttgtattcctgtaacttgaaatttgtaagaatcagactctggactttcatcttagccaatcttcaggattttatggaagagaattctaaaattaatagcttttcaaattaagaacctgataagcctgaaatatttttcactagttatatattcaacctgtttgaattttactttataatataacctgtttttgaaagagaaaggcagttgtaattagatagcctaaatatatttttaattgtgtgtcatcctcaacattttcattgtcagtgattgtaaattggtagaattaactgtgtctcataacttattaccaggaagttgcttaggataaaaataatgtagccccatagcatccataaaaatggaattgcctgattacctcacaacagcaaacccagtttctcatttccagttatagttcagttaaagaatgttggaatttttttatatgacacttttaaacatgccaagtatagcgaaaataataaaccacatgtacctatcatccagctgcaacaattatcagcactttaccaatctttaatgtgtttctcccccaacttttttttcctggagtcgttgaaagccaattccaaacagcatagtcactcataaaatatttctgtgtgagtaactcataaaatactcctgtgtaactcacaaatctatacagacttctgaaaaacataatcgcggtgctatttattacacttaataaattagcatcaattccctgttaaaattttcaacaatagagcatcagttatagtctgttagaacaatagaataaagcaataaagtattatatttattgataggatatccatgtgtatagaaaagttagttattaaacaatacataaggcctgatttagtggctcatgcgtgtaatcttagcactttcggaggccaaggttggaggattgcttgagaccaggagttcaagaccaacgtaagccacaaagtgatacccccatctctacaaaaaaattaaaaaattagctgggtgtggtggtgcatgcctgtagttttagctacttgggaggctgagatgggagcattgcttgagcccaggagttcaaggctgcggagagccatgatcatgccactgtgctccagactaggtgatagagtgagaccctttctcaaaaataaataaataaatagacaatacatagactatgatctcatttttgttaaatgatatcatgatatttgttatttgtttatatgtacccataagtctagactggtatgtataatggaattgtctctatgaggtggaaattatttgtattttgcagtttttttccacaagtaatttctgtattggttatttatgctgtattattattatttttgagacagagtcttgctctgtcacccaggctagagtacagtggtgccatcttggctcactgcaacctctgcttccagggtttaagtgattctcatgccttagcctctccggtagctgggattacaggtgtgtgccaccacgcctggctaatttttgtatttagtagagacggggtttcaccgtgttggccaggctggtctggaactcctgacctcaagtgatcagcccaactcagctcccaaagtgcaaggattgcaggtgtgagccactacgcctggccttttgttgttattttttaatggctttggatttccttatatgttttgtagtccattttgtattcgtgggccaagtttgttttgagagaattcactcattttattatttattttttcttcctgtcattgcttcaccctatgtggcaattttgccttaccctggcatctgggattcacatctcagaaccaaatcttataaatttaggaagtagggggactttgtctcctgaggaaattgagttccattctgcaggtatgcttggggcctaattcctgattgcctagatttctctgaaacttttccctgccgtgggcaaatattttattcctaggtgtacttctgaattggctgtattttaccagcacttgatttatgggcaggtgcccacttgtagcccccagagagtttggctgttgtctctctccatattattccaagaagtcaaattcctgttccctgccctttgtttatggtcttggtatacccctagtacctcctatctttagtctctgctctccactgtgggttttatttatcatcagtttggatgtatggattgtttccatatgaatttcatgatcagtttggagaggatgactattttaaatagtttttctgttatttgtatgtggttgaagcagagagagaaggtgattatgtatacccacttaacccatcttgactcagaagtctcttgttttatttatgtaatttaaagtgactggatagagaactatggtgttgaatatatactgtgtgccagatagtatttataaacttaatcagatatggagtagtatttaaaacaattgagcttaaataatgtggaatcgtgcaagtgtaatttcttggatgtcaaatagatacattgtgacttatttatattttggtacagatggcctttgaaaagcccccaaggtgtgagacaagtcatcacttgataaaccactgtcttggacagatcttaatagtgatctcatacttttaccatgaaaagtagataaataccttgttggacaagatatttggaatttaaaaaaatctcatttgtgtatattaactaagattttaaaataattatgtctgtttaccaagtatattactgttctttagaagagtcttactagtcagaaagagacagttacaagtacaaccccatccacaatttcactttccatggcttcaggtatccatggtcaaccacagtccaaaaatattaaatgaaaaattccagaaacaattcataggttttaaaatgtgcgctgttctgagtagatgatgaaatctcactccattctgcttgggatgtaaaaccttttgccagcatatccatgctgtctacattacccacccattagtcactgagtagcgagctcagttttcagattgactgtcatggtctcacagtgcttgtcatccagtaacctttatttagttcataatggccccaaagtgcaagggtaatgatgctgggatattgttaacattgttctgttttattattacctgttgttgttaatctcttactatgcctaatttgtaagttaaacttcattatgaggtatgtatgtataggaaaaaacatagtatatgcacagtactatctaaagtttcatgcatccactggaagtcttggaacatatcccccatagataagggaggaatactgtataccttaaaatttaaccattggcattttcttcattcgtttttttgggtagcagtaactaagggatttgtaagttatcagattttcacaggagatgatattattggggtaaattgtatgtagatagcatgcacccctggaaggagtgcccacactttgagtacacaaatgtgtgcatgcacatacacacacacacacatacacacacacacacacattcccctttttaattaaaatgaggaaaacacacttggagagccataatttcattttataagccaagaagctaggactaaattgtggtttttttcacccttctaagttgactttttttcctgcttctctcatgacatagtagtcattttttacttaacgaaaatctgatgtaatgaaatgacattttacaagctttaaatgaagcaaatgtttgaattctctttaagtggccttgttcttttgctttcaaaagtaaaatatgttttgttttgtgttatttagcactgggcgtttcaagtttttaatagctttattgagattttgagagagaattcacatgacatacaagtcacccatttaaattggacaattcaatgattgttagtatattcacaacattgtgcagtcattactactcaattttggagcattttcatgactgtggaaaaaaactccatatacccttttaactatcacccccaaatctccatttccattagctctagacaaccactattctacgctctttgtagatttgcctattcagggcattttatatagaagagaattatgtaatatagtcttttatgacttacttcttttcactaagcataatgtttcaagcttcatccatgtagcacataccaattcttcactcctttttatggctgaatagtgctccacacacattttgttcatcagtttatccattgatggacttgatttccactttttggctatgttatgaaggatactgctatgaacatttgtgtataagtatttgtgtgttttcatttctcttgggtacatacctaaaagtggaattgctggattgtaagataactctatgtaaactttttgagaaactgatagactgttttacaaaatggctgcaccactttacattctcactagcagggtgtgagggttccaatttctctacattctcatcagtacttgttatctgtcttttttattttagccattgtagtaggtgtgaagtataatcttattgtggtagttttgatttgcaaacttcctgtgttaatattgagttgggtttgtttttgaacacatttattttagaggaaggggcagcagatgcttctaaaccactggtggactaggtcagagggtattatgaacctcatttaaatttattcccaattaacactcattgtgattccctaagtcaagtagaacttagaatgtccttagcacaatcttgtttatgttcaggtgcatttttcattctggattactgtttcctaatgttaatttaagattatatagtattgcatttaagccttgtcaaaggaaaatggcaaaatttgactcctggttgtaaaagacaatatcctaaagatgttgtcagtgatctttatgagacacacatctttgttaagtaacggttttgtaataaattcagaaaacatggttaaataaattaaagcagaaattagctcaggagtggtggtcagaaatattttttggatctgagccaaaaagaatatttaaagcctttgattactttgaattgcctttgtcaacaatttagtcaaattatgaaaggaagacagtagcatttcaataatagctttaatttttatcatccagtgtaacaaatggaatctgttatggtatccgttatcaatggattagttacagtgtgaagtcaggaggcaatgcaggttttagttattagtgaacctaactgaataattttaggtcttctggtttgagtgctataattacgtaaataatctgtggaagggaggtttgctgaggtgcccaatgaatcatttttactgcatctacagatgcaagtcataaagtttaatccgtgtgggtaacctgtaatatgtgctgctgatgttagcatagattcaggctgaaacaatcctaattgcgattatttacaacacattggagagagcctatgtgtgacatattacttggttatttttttaaatgactcgtgggggtgggggagtgttaatgttaaaggcatacttgaatcttggagattataattaagttttattccctactcccagataacattatatatatatatatatatatatatatacacacacacacacacacacacacacacacacacacacacacacaccatacttggttagtgatgattaaaaaaaagtagttgtggagacctaaatgtaaaacacaaaactataaaacttctagaagataatataagagaaaaagtgagaactttttttttgagacggagtcttgctctgttgcccaggctggagtgcagtggtgccatcttggctcactgcaacctccgcctcctgggtttaagggattctcctgtctcagcctcccaagtatctgggatcacaagcttgcaccatcatgcctggctaatttttgcatttttagtagagatggggtctcaccatgttggccaggctggtcaggaactcctgacctcaagtgatcctcctgcctcggcctcccaaagtgctgggattacaggagagagccactgtgcctggccaagagaaaaagcgagaacttttaagatacaacatcaaaggcatgatccataaaggaaagaattgataggcctgacttcattgaaatgaaacacttctgctctgtgaaagacagggtcagagaatgagaagacaagccacagactgggtgaaaatatttgcaaaagacacatctagtaaaggactgttatccaaaattacaaagaactcttaaaactcaacaataaaataatgcaacaataaaataaacaatgggcagaatagactgggcatagtgattgactcctataatcccagcacttcgggaggtcaaggtaggaggattgcttgagcgcaggagtagttcaagatcagcctgggcaacagcaagacctcatctctaccaaaaaaaaaaaaaaaaaaattagccaggcatggtggcatgtgcctgtagtcctggctagttgggaggctgatgtgggaggacccttgagcccaggtgttcaagactagcttgggcaacatagcaagaccccatcttaacaacaacaacaaaaaaggcaaaagacatgaacaaacacctcaccaaagaagatacacatatggcaaacaagcatatgaaaaggtgttcagcatcataaatgtgtacaaacccatagaatgtacaacaccaagagtgaacccttacgtaaactgggttttgggtgataatgatgtgtcagtgtaaattcattgattgtaacaattgtgccactgtagtggggatgttgatagtggcggaaggttgggtgtggggacagggactctgtactttctgcttaattgtgctgtgaacctaaaactgctctaaaaaagtaaagtttattaatttacttctttaaaaaagtggttgtagagctatttaccttttcaaatgtttgagtccctgctttgttctgtactgggtaatgccttccaaatgtcatagcctagaagttctgaaacgaatggactgtgagaaatttgaggaagtagtggtttcacttctgggtgttgtgggctttctgatttctagaacctgactttgtcatgctttcttttaaatttaaatttttttgtggagttggggtcttggctggtcttgaactcctgggctcaagtgatcctcccacctgggcctcccaaagtgctgggattacaggcatctgccaccatgcccctgtcattgctttctttactaaagtattttaggacctaatagtccaggaaatacatatatgtatattggacaaattcatgtctgtttaaagaatagggtagtctgagtgttgtccttcattggtgctaattgggaaaagttttttgaggaaatggacactgagtagagaaataggagtaagtaggagtgcaatttgttatttggagagtgtatgttattgtatgtttttgtggttcatgtaaataccatggttgaagatgatcagaattttttcaagcatctgaaaattatggtttaagttctaaaactattgtttatcatcaactaaaaaattatgcattctcagatttctcttattttcaagattatttatgcttgcttgtattgggccccttatgtacgtaatgggactttaaaaaatattcatgtccttttagatagggagtatagccacatggttcagaaattaaagtgatttaaaaacagtggacattgagcagccttgcttcagaacctgtccttgttctcctttcctgcaaattctttttgtgtaatcttccaatgctttttaaaaatgcaaataaacaaatattttaggaagatttttttttccccagaaaaaaaggtgatgtgatttattatctgtaatttgttgcatattaaaagaacattccagtactttcataaatataagggtagatatggcaaccccttccttactatgccagttcttcacttggttgataaaagtaaaattatttattaacgccttaactcatcctgaaagataaatgactacgggggaggctaaaaacaaaataagtaactgtatactatgccaagtttgcaacaacctcatgaaagtatgtacacttagcattcccattttatagataaaagaaactcagcccatataattagcaggtatcggtgatgggatttaaaactgggccttttttttccttaaaaattatgaacatttacaaacaaagaaatgtagagagaaactaatgaagtcccatatacccatcgcacggattaagtagttacaattttatatttgtttgatctagtctttttgttgttgttgtttcttaagtattttaaaacaagtcctggatattattttgcttctatttgcttaaagtacgcatctctgaaaaatgttgatctctcttatatagcgacagtgccattttgttaaactcctccaaataagcaaaaatgataagacaaaaagttggccaggcgaccaaagctatcaactccagcctaaggaaaattcagcaatttgattatgaaagggggagggggacttcttaattgtacattttacacagatttccacaaggacagtaatagctgacccacttcgaactagataaaagatacagaggcgtgtggcagccaaagccatcatgatgttgacatgatcttcttggtgagctccaagccacctttcctaactagttttagaccaatcacaatgtacataaaagtttacatgttttaattaattcttttcatgtgagaggtataatgaaactgagttttaaataagtcaggcattggtttttaatgtatggaatttttctttatgaactcatagtatgaaatgttttttcttaaaaggtctttgatttgcgtcagtgtcatcgacagatgcagcagcaggcggctactgcacaagctgcagcagctgcccaggcagcagccgtggcaggaaacatccctggcccaggatcagtaggtggaatagctccagctatcagtaagtatgcttttcattcttttttaaaggtataatagttgatatttttatcttgatttactcagttgattagtttctttgagcagtaatagaaattaaagtttttttttactgggatgatgacatttttgaattggtaaaatctgttcttctgtaatagttgctttttgcctatgaccctgtttgcattctttttgtatcaaaaatggagtatgggatgaaggagaaaggggatgattattatattatactgttctatctcctccttttttgttgatgcttattataattctgcctcaccagccagggtgggttgtaatcactgaagtgcttggctttattctagtaaggaaagcatatttcaatttcagaattggacacttttccaattttttttttaaagtatgctaaacatggagagaaaactaagtgagggtggtattttgataacttgtagacttttttttaattttagggtaaaattgaactgtgtgccaggtttcacactgatggggaattttttactgcagagttaaactcctgactatagacttttatgatggaaacacgtggcacccatcttccacgtctgaaggcataactagtgattcattcaacccctgttcttaacctcttcagtgtggtaagcaaatcacactggctaagaaaactgcagtggccctgcaggtttctctacagtacatgcaaattcctcccattagtttcattgtaatattgatgaatgcagatggactatatgactgtatgttctgactggaaaattagatgcagtctccattgtgacttatgttcaggagtttacaatttagaggtagattaggcatattcattgagagaatttgattttttaaaatttggggtgataccattaatttgctggtttcagtgttataaacatgcttttactgaagaatccagaactattattaagtttcatattctcatcagttgccaccactgagtaatagtgtattactctgttacactttgaaattgagagagagacttcatctcggtcatctaagaggtcttagtggaactaagaatattaactgcttcattattagttatgtcttattctgaactaggctgtttagacagtaaggtttttagaagcaacctgtggacacgcactacctcttaaaaacaagttgtttcttatcccttcacctccacttctaaagaaaaaaataggtgaggtgttggtggattgtggtaatttactttataattggttgtagctagaagacacatgtgaaatgtaaagttccttaaccaaaagtgtgcagcttgttgataaagtttagatctactgttacttcttggcactttagcagagaagttatatgctgaggagaatgaaatacagaaagctggtcacttgattaatttagaatgtagggaggatgggaagagatcaccctgtccctctgatgtcttccaaatcttttctgttaggtctgtcagctgctgctggaattggtgttgatgaccttcgtcgcttatgcatactcaggatgagttttgtgaaaggctggggaccggattacccaagacagagcatcaaagaaacaccttgctggattgaaattcacttacaccgggccctccagctcctagacgaagtacttcataccatgccgattgcagacccacaacctttagactgaggtcttttaccgttggggcccttaaccttatcaggatggtggactacaaaatacaatcctgtttataatctgaagatatatttcacttttgttctgctttatcttttcataaagggttgaaaatgtgtttgctgccttgctcctagcagacagaaactggattaaaacaattttttttttcctcttcagaacttgtcaggcatggctcagagcttgaagattaggagaaacacattcttattaattcttcacctgttatgtatgaaggaatcattccagtgctagaaaatttagccctttaaaacgtcttagagccttttatctgcagaacatcgatatgtatatcattctacagaataatccagtattgctgattttaaaggcagagaagttctcaaagttaattcacctatgttattttgtgtacaagttgttattgttgaacatacttcaaaaataatgtgccatgtgggtgagttaattttaccaagagtaactttactctgtgtttaaaaagtaagttaataatgtattgtaatctttcatccaaaatattttttgcaagttatattagtgaagatggtttcaattcagattgtcttgcaacttcagttttatttttgccaaggcaaaaaactcttaatctgtgtgtatattgagaatcccttaaaattaccagacaaaaaaatttaaaattacgtttgttattcctagtggatgactgttgatgaagtatacttttcccctgttaaacagtagttgtattcttctgtatttctaggcacaaggttggttgctaagaagcctataagaggaatttcttttccttcattcatagggaaaggttttgtattttttaaaacactaaaagcagcgtcactctacctaatgtctcactgttctgcaaaggtggcaatgcttaaactaaataatgaataaactgaatattttggaaactgctaaattctatgttaaatactgtgcagaataatggaaacattacagttcataataggtagtttggatatttttgtacttgatttgatgtgactttttttggtataatgtttaaatcatgtatgttatgatattgtttaaaattcagtttttgtatcttggggcaagactgcaaacttttttatatcttttggttattctaagccctttgccatcaatgatcatatcaattggcagtgactttgtatagagaatttaagtagaaaagttgcagatgtattgactgtaccacagacacaatatgtatgctttttacctagctggtagcataaataaaactgaatctcaacata

SEQ ID NO: 20 - DNA, 17256 bp, Homo sapiens
ctttccgccctctccccgcctccttttcgggcgtcccgaggccgctccccaaccgacaaccaagaccccgcaggccacgcagccctggagccgaggccccccgacggcggaggcgcccgcgggtcccctacagccaaggtaaggcaggaatctcctggactgggtcgcggtcccccggcttcccggaagcgcagtgcgcgggtggcatcactgtgcccggagcccctgcgcgccccggccatccccaccccgagggaccccctacggaggcgacctgggggctgaggtgagcgcttgggcagcagcgacggggaggggtgtccaccccacccctggtgcgggccggggcgcgcaggcctggaactcggggttcagactccccgcgactcggaccacgcggctaagcgcgctcagggtcgcgtgcccccgccccgccgccatgctgggcgccgtggtggccgcgcagctgggcgacagcaggcgtgggcgggggtggggagcggcccctcagcggtccctaccgcctgaggccagggcccggggacttttattgtgacacggcgggcgcccggctctgcttagtcatggtgacctgcgcgcgctccgcgcctcccccacgcgcagcgatggaggcgccggggctcgggcggtggaggcggagccggagcgcggccatggcggggtgagtgaggcgggatgtgcccgggctgcgggcatcgcgggccgcgagcgcccctgcggccgtgcccggagaccaggaaaacgggcgccacggcccagggcgcctccgagttccccgccaggactcggagggccaggagggcgcgacctgggtggatatttttgttggacggcgcaactcttggggtggcccgggagcggcggaaaccgagcgagagaaccaggaggcgctgcgcagaaggaggcccgggggctccgaggcgttgaggggctcgatctgcgttctggggttggcagccgagaggccgcggtggggtcacttcctcgcctcactgggcctggtggaggctcaggaggggcatgcgcagtcgcccacttgccgctttgtagggtgggggaagtgcccggtgcccaaggggcattgttgaccgattggccaaagaccaagaggcaaacccagggccttggcaccagagtgggggccgagtggcacccagggagggtggaggaggccgctctggcaggcacggtggcagggcagttagccaaccacccgtttattgacccctgcgcagtgccaggccccaggcgagaggcacaggagagggttggcccgacgccgacctacataggtctccctgccatttgaggcgctggggccggggacgagagacagtcgatcaacagacaagcaaaggaggtcatttcagttcctgacaagcgcagtgatgacaataaaacagggaagaggagactttgagttgagtcccagaaagaggggagtgagaacttgcagatccacttgtggggagccacttggagatcccccactccttttgaaacgtaactcacgtctgggcacagcagcctatgcctgtaatcccagcattttgggaggtcgaggagggggatcacttgaggccaggaggttgagaccaccctggccaacatggtgaaatcccatctctactaaaaatacaaaaaattagcccatcgtggtggctggtgcctgtaatcccagctactcaggaggccgaagtatgagaatatcttttttttgttttatttgagatggagtcttgttctgtcacccaggctggaatgcagtggtgcgatctcggctcactgcaagctctgcttcctgggttcacgcctttctcccgcctcagcctcccatgtagctgggactacaggcgcccgccgccacacccggctaatttttttgtatttttagtagagatggggtttcaccatgttagccaggatggtctcgatcttctgaccttgtgatccgcctgcctcggcctcccaaagtgctgggattacaggcgtgagccaccacgcccggtcgagaatatcttgaactcgggaggcagaggttgcagtgagccaagatcgcaccactgtactccagcctgggcaacagagcgagactctgtctcgaaaaacaaaacacaaaacacataactcatctcctggccctccaggatccaggggtttccatgaaacccttccttaagtccttagctctcactgcactccttcccaattctccagattgactgtctcagcctctgagccactgcacttactgtttcctctgcctggaaaactactccccagcctcccactttataataattttcatccttgtctcagctccaacctcaccttctcaaagaggcttggtctgccagattttaaaaaactgcaccccgggtcaggcatggtggcttacgcctgtaatcccagcacttcgggatgccaaggcgggcggctcacttgaggtcaggagtttgagaccagcctggccaacatggcgaaacccagtctctgctaaaaatacaaaaactagccgggtgtggtggcggacgcctgtagtcccagctactcgggaggctgaggcaggaggatcgcttgaacccgggaggcggaggttgcagtgagccaagatcgagccattgcactccagcctgggtgacagagagactccatctgaaaaaaaaaaaaaaaaaagcaaacaaactgcacccgattctcacgttgtcacaatgctgttgtaattttcttcatgaagctgtttttccaggtcttgcttattttagtttatgattgctcctccctgcagttgtcagctctggcagggtaggatttttgtattttgctcactgctgtgtcttcagcacccagatcagtgcctggcatacagtaggtgcccagtaaatggtgaggcaaatgaaggaatgagctcaacatgctctagaaagggaaaggccgccagattgctgaagcagagtgatcaaagggaagaggtggcaggggctaattgcgtagggctttgcaggctgttgaggagttcagttttactaggtactgtgggaggcattggaggatccagagcaggggagagacatgacttcatgtatgttttaagatgggctcttgggccaatcaggttgatcaggtcggggaagtttgcaagtttgcaaatggattctgcttcacctactttgcaggaaaactgacctaggaattgctttatcttgcaaaacgaggcccggcaggtgctggcccagtcccaacccctgccctctgccctgtgctctctcccctccaggtccctgagtgccagaggtggtggtgttgcttatcttctggaaccccatgcagccagatcccaggcctagcggggctggggcctgctgccgattcctgcccctgcagtcacagtgccctgagggggcaggggacgcggtgatgtacgcctccactgagtgcaaggcggaggtgacgccctcccagcatggcaaccgcaccttcagctacaccctggaggatcataccaagcaggcctttggcatcatgaacgagctgcggctcagccagcagctgtgtgacgtcacactgcaggtcaagtaccaggatgcaccggccgcccagttcatggcccacaaggtggtgctggcctcatccagccctgtcttcaaggccatgttcaccaacgggctgcgggagcagggcatggaggtggtgtccattgagggtatccaccccaaggtcatggagcgcctcattgaattcgcctacacggcctccatctccatgggcgagaagtgtgtcctccacgtcatgaacggtgctgtcatgtaccagatcgacagcgttgtccgtgcctgcagtgacttcctggtgcagcagctggaccccagcaatgccatcggcatcgccaacttcgctgagcagattggctgtgtggagttgcaccagcgtgcccgggagtacatctacatgcattttggggaggtgagcggggaagtggggctgggggcagtgtcaggagaaggaccagggatggaggagtgctcatcactgtctccccttgagatgtcaaggcaggaaactggagaaaaaggaggttctgggctgggtatggtggtgtagtctccacagtttgaggggctgaggcggggggattgcttcaggccaagagttcaagaccagcccaggcaacataatgacaccctgtctctaaacaaacaaacacacaaacaaaaaacaactggggccgggcgtggtggctcatgcctgtaatcccaacactttgggaggccgaggcaggtggatcacctgaggtaaggagttcaagaccagcctggcccacatagctaaaacccatctctactaaaaatataaaaattagccaggcctggtggcgggcgcctgtagtcccagctgctcaggaggctgaggcaggagaatcgcttgaaccaagaggtggaggttgcagtgagtggagatcgagccactgcactccagcttgcgcaacagagcaagactcagtttcaaaaaaaaaaaaaattaaaaaacaactggggttctgagttccttgtctacacatgtggggagactggtgaacagctggggaaggtgaggtcttcatatgtctctgggctccctggtttctctggggtcaaagtggggcagagtgcagtgaacagcagccaaatcctagggtagcccagcctttcgggcagtcagcaaatgtttattggacacccgtgacaggctgcaagctgtaagtctgaaccttagtcatgttttctttggtccacacaatgtccttatactgtttttggtttcgttttcacatttctcagtgaaggaaattatctatagaaattgacaagagagggcagggcccagtggctcacgcctgtaatcccagcactttgggaggctgaggcgggtggctcacctgaggtcaggagtttgagaccagcctgaccaatatggtgaaaccccatctctaataaaaatacaaaaaaagaaaactagccgggtgtagtggcatgtgactatagtccctgctactcgagaggctgagacaggagaatcgcttgaaccggggaggtggaggttgcagtgagccgagatcgcaccattgcactccagcctgggcgacagagcaagactctgtctcaaaaaaaaaaaaaaaaaagcctgggcgcggtggctcatgcctataatcccagcactttggaaggccaaggtgggcagatcacctgcggtcgggagttcaagaccagcctgaccaacatggagaaaccacgtctctattaaaaatgcaaaattagcctggcatggtggctcatgcttgtaatcccagctactcaggaggctgaggcaggagaatcgcttgaacccgggaggcggaggttgcagtgagctgagattgcgccattgcactccagcctgggcaataagagcgaaactctgtctcaaaaaaaaaagaaaaagtttttgaagagatgaggtcttgctctgtccccaggctggaatacagtggtgccatcatagctcactgtagcctccaactcttgggctcaaggaggcctcctatctcagcctcctgagtagctgggactataggtatgcagcaccacgcatggctaattttttagtttttaaatttttttgtagagacagggtcttgctatgttgctgagactggtctcgaacctcctggctttgaacaatcctctggctttggcctcccgtagtgttgggattacaggtatgaagcaccataccaacaccaggccaagaagtgtttattgagcacttgctgtgggccagcccctgttctaagtgatttatgtcctttgcatcattgactgttcccaactgtcctatgaggcagtactacccttcagcctaggcaagcagggcagtgccccaggccctaagccttcgggagtcccatgtcttggtgttccttcctggaaattttctaagtcccccactggctggtaccagctgggatggatgttacactgatctctatttctctccttcagggatagattctttcctaccctctatgttacatgtggggttgatcagacgccccagggttctctggcgttagtcctagggcctgcagcttctaggaaagtggtctatacagtaggagaaacatatacagtgtttctttcttgtgtttgtatgaacatggggtactagattaaaactgattacatagacgagtgcctgacaacttttttttttttttttgagacggagtctcactctgtcacccaggctggcatgcagtggcactgtatcggctcactgcaacctccatctcctgggttcaagcaattctcctgcctcagcctcccaagtagctgggattacaggtgcctaccactatgcccagctaatttttaaaaaatatttttagtacagatggggtttcaccatgttggccaggctggtctcgaacccctgagctcaggtgatctgcctgccttggcctccctaactgtgctgggattacaggcatgagacactgcgcccacgcccgccccccaccgcccagtccttttttgtttttgagactgagtctggctctatcgcccaggctgaagtgcagtggcaagatttcggctcactgcaagcctccatgtcctgggttcaagcgattctcatgcctcagcctccgaagtagctgggattacaggggtgcaccaccacgctggctaatttttgtatttttagtagagacagggtttcaccatgttggccaggctggtctggaactccttacctcacgtgatccgcccacctcagcctcccaaagtgttgggattacaggcttgagccaccacgccaagcccccttttttttttttttgggggtgggggacagagtctcactctgtcatcaggctggagtatagtggcatgatctcggctcactgcaacctccgcctctcgggttcaagtgattctcattcctcagcctcccaagtagctgggattataggcatgtgtcaccatgcccagataatttttgtattttttgtagagatggggtttcaccatgttggtcaggctggtcttgaactcctgacctcaagtgatccgcccgacttggcatcccaaagtgctgggattacgtgtgtgagccaccgcacctggccttttttttttttttttctttttttagagacagggtctcactctgtcacccaggctggacttcagtggcacgatctctgcttatcacaaactccagctcctgggctcaagtgatcctcccacctcagtctcctgagtagctgagactacaggcgtgagctaccatgcttggctaatttttatatcttttcttggtagagatgaggtctcgctatgttgcccaggctggtcttaaactcctgggctcaagcaatcttcccgccttggtctcccaaagtaccaggattacaggcgtgagccaccacacctggctacaagaaatatttatccagggctctgtataccctagaagtagccttactttgaggtggccattaatataatcccattttacagaggaggaaaaccaagacatggagcatttcagagatttgcccaagttacacacctacgaagtggtcggatcaaaattccaactcatgctggtttcttcggagcttccactttttttttttttggagatggagtctcactctgttgctcaggctggagtacagtggcacaatctcagctcactgcaatctctgcctcctggattcaagcgattttcctgcctcagcctcctcagtaactgggattacaggtgcccaccaccacagctggctaatttttttgtttttagtagagacggggtttcaccgtgttggccaggctggtctcggacttctgacctcaggtgatccgcctgctttggcctcccaaagtgctgggattacaggtgggaaccactgtgctggcccagagctgtcacttgtttttttccacaacattctattgtgattgcttattttttccttttttagtctatttgccattttagaaaatgatttcattttaaaaaacaagatgggtgagttggctcgtgcgtataatctcagtgctttgggaggctgaggcaggagaatcacatgagcccaggaatttgaggttacagtggcacctctgcactccaccataggtgacagagcaagaccctgtctcttaaaaaataaactcagacatcccatctctactaaaaatacaaaaattagccgggtgtggttgtgcgtgcctgtagtcccagctactcaggaggctgaggctgaggcagaagaatcatttgaacccggagacagaggttgcagtgagccgagatcacgccactgtatccagcctgacgacagagtgagactctgtctcaaaaaaaaaaaagaaacaaaagaggccgggcgcgttggctcacgcctgtaatcccagcactttgggaggctgaggcaggcggatcacgaggtcaggagatcgagaccatcctagctaacatggtgaaaccccgtctctactaaaaatacaaaaaattagctggatatggtggtgggcacctgtagtcccagctactcggaggctgaggcaggagaatcgcatgaacctggatggcagagcttgcagtgaggcaagatcgtgccactgcactccagcctgggcgacagagcgagactccatctcaaaaaaaaaaaaaaaagaaacaaacagaaaactcagaggccaggcgcggtggctcaggcctgtaatcccagcactttgggaggccgaggcaggcagatcacctgaggtcaggagttcaagaccagcctggttaacacggtgaaatcccgtctctactaaaaatacaaaaacaaaaattagccgggtgtggtggtgggcgcctgtagtcccagctactcgggaggctgaggcaggagaatggcgtgaacccgggaggtggagcttgcagtgagccgagattgcacccctgcactccagcctgggcgacagagcgagactccatctcaaaaaaaaaaaaaaaaaaaaagccaagccaggtatggtgatgcacacctgtaatcctcaggaggctgaagtaggagaatcatttgagctcaagagtttaagaccaacggccggacacggtggctcatgcctgtaatcccagcactttggaaggcaagggggtgggccacttgaggtcaggagttccagaccaacctggccaacatggtgaaaccccgtctctaccataaaaatatgaaaattagctgtgcgtggtggcacacacctgtagtcccagcgactcaggaggctgaggtgggaagatcgtttgagcccaggagttcaaggctacagtgagctatgattgtgccactgcactacagcctaggtgacagagcaaaactgtgtctcaaaagcaaaaacaggccaggtccggtggctcacgcctgtaatcctagcacttagggaggctgagatgggcagatcacctaaggtcaagagttcaagactggccaggcgaggtggctcacgcttgtaatcccagcactttgggaggccgaggcgggcggatcacgaggtcaggagatcaagatcatcctggctaacacagtcaccccgtctctactaaaaatacaaaaaatattagccaggcacggtggtgggcccctgtagtcccagctactcgggaggctgaggcaggagaatggcgtgaacccgggaggtggagcttgcagtgagccgagatagcgccactgcagtccggcctgggcaaaagagcgagactccatctcaaaaaaaaaaaaaaaaaaaaaagagtttgagaccagcctggccaacatgaagaaatgccatctctactaaaaatacatagtgaaactccgtctctactaaaaataaatacaaaaaaatggccgggcgcggtggctcacgcctgtaatcccagcactttgggaggctaaggcgggtggatcacaaggtcaggagatcgagaccatcctggctaacacggtgaaaccccatctctactaaaaaaatacaaaaaaacttagctgggcgtggtcgcgggcgcctgtagtcccagctaatcgggaggctgaggcaggagaatggcgtgaacccaggaggcggaggttgcagcaagcggagatcgctccactgcactccagcctgggcgacagagcaagactgtctccaaaaaaaaaaaaaaaattagctgctctggaggcacactcctgtaatcctagctacttgggaggctgaggcaggagaatcacttgaacctgggtggcggaggttgcagtgaagcaagatcacaccactgcactccagcttgggcaacagagtaagaatccatatcaaaataaaataaaataaaataaaaattaacggggcatggtggtaggtgcctgtaatgtcagctacttgagaggctgaggcaggagaattgcttgaacctgggaggcagaggttgcagtgagcctagatcatgccactgcactccagcctgggtgacagagtgagactctgtctcaaaaaccaaagccaaatgataccccagggtacacgatctactgagtctttgcccattttcctgagtcctgatgacatacttggcacatagtattaactcttttttttttttctttgagacagagtcttgctctgtcgcccaggctggagtgcagtggcgcaatatcggctcactgcaacctccgcctcccgcctcccgggttcaagcgattcttctgcttcagcctcccgagtagctgggactagaggcgtgtgccaccacacccgggtaatttttgtatttttagtagagatggggtttcaccatattggccaggcttgtctctcaactcctgacctcgtgatccgccagcctcggcctcccaaagtgctggcattacaggcgtgagccaccgcgcccggcaggattaactcatttagtcatcacaatgtacgcggttcctattatttgaatccccatttagcagataaggaagctgagactgtcagcggcagtgataagttacttgtcccggtcctgcttggtgaggtgtgggggtgactggagagtcagcccgtcccactgtcgccctctgcaggtggccaagcaagaggagttcttcaacctgtcccactgccaactggtgaccctcatcagccgggacgacctgaacgtgcgctgcgagtccgaggtcttccacgcctgcatcaactgggtcaagtacgactgcgaacagcgacggttctacgtccaggcgctgctgcgggccgtgcgctgccactcgttgacgccgaacttcctgcagatgcagctgcagaagtgcgagatcctgcagtccgactcccgctgcaaggactacctggtcaagatcttcgaggagctcaccctgcacaagcccacgcaggtgatgccctgccgggcgcccaaggtgggccgcctgatctacaccgcgggcggctacttccgacagtcgctcagctacctggaggcttacaaccccagtgacggcacctggctccggttggcggacctgcaggtgccgcggagcggcctggccggctgcgtggtgggcgggctgttgtacgccgtgggcggcaggaacaactcgcccgacggcaacaccgactccagcgccctggactgttacaaccccatgaccaatcagtggtcgccctgcgcccccatgagcgtgccccgtaaccgcatcggggtgggggtcatcgatggccacatctatgccgtcggcggctcccacggctgcatccaccacaacagtgtggagaggtgagtggcagggcctgggggtgggctcggagggtcctgctcctggcaagtcccaagacactgagatccggggattcttcctgaggctgtttcctcttcctgtcttcagggagtggaggcctcaggatgaagctaagctccttggagagttctagtcagtgacctttgattctgtgcctggggctgggaaatgcttaggggactgtcacaaacccatatggttcctttgtgcggagttggaaaatgttccatcagtttgaaattgttgggctaggcactgtggcccatacctataatcagggactttgggaggctgaggtgggaggattgcttgagtccaggagactagcctgggcaatagagtaagaccctgtctctcttgctctgttgcccaggctggagtgcatcttgggtcactgcaacctcgcctcccaggttcaagtgattctcctgcctcagaccctggggtagctgggactacaagtacccaccaccacgcctggttaatttttgtattttttgtagagatggggtttcaccatgttggccaggctggtcttgaactcctgtcctcaagggattctcccacctcaacctcccaaagtgctgcgattacaggtgtgagccactgtgccggacctaaaggactctttgagcatcaaagagtgatgctgaatgtgtgatttctcctttctgagatgttatcttgttatctgtgaagtgggggatctggctgagccactaggggtttatcagatgtgtttttgaacttgagcaattgatggctaggaggctcagttttgtcatttggaaaatggagttgctgatacctcaatccttggagaacaactgcaagcactagagttcgagtggaggtgggcacggtggtgtgcacctgtagtcccagctactcaggaggctgagccaggagggttccttgagcccaagagttgatagctgcaggctgggtgtggtggctcatgcctataatcccagccctttggaaagctgaggcaggcagatcacttgaggtcaggtgtttgagaccagcctggccaacatggcgaaacccaatttctactaaaaatacaaaaattagccgggcgtggtggtgggtgcctgttatcccagctacttgtgaggctgaggctgaataactgcttgaacccaggaggtggaggttgcagtgagccatgctctcaccattgcactccatctcaaaaaaaaaaaaaaaaaaaaagtttgaagcttcagtgattgcaccactgcactccagcctggacaacggagcaagaccctgtctctttttttctttttttttttttgagacggagtctcgctctgttgcccaggttggagtgcagtggcatgatctcagctcgctgcaacctccgcctcccaggttcaagtgattatctcgcctcagcctcccgagtagctgggattacaggcatctgccatcacacccagctaatttttgtacttttagtagagacagggttttaccatgttggccaggctggtctcaaactcctgagctcaggtgatccgccctcctcggcctcccaaagtgctgggattacaggcatgagccatcgcgccggatgaacctgtctctttaagggggaaaaaaaaaaggaaaaaaaagagtatctggcccttaagtattccacgaaggtcagctataatggccattgtccccatttttcttacgcccttgcaggtatgagccagagcgggatgagtggcacttggtggccccaatgctgacacgaaggatcggggtgggcgtggctgtcctcaatcgtctgctttatgccgtggggggctttgacgggacaaaccgccttaattcagctgagtgttactacccagagaggaacgagtggcgaatgatcacagcaatgaacaccatccgaagcggggcaggtgggtggggacggtagggaggggagcacccaggaacaccccctaccatcctggggtgaaactgagccaggcctgggagagaccccctgttgcaaccctcatgctggggtaaccacagaagccctggattctgatagagtccaagcttctctctctccccgcttcatttctgagggtgagaagggagaggagagaggaaaggtctccctcaaggaggtgatggctggggttcccaaagccagacccccagagtcaccttctctgcatggtgccctttaggcgtctgcgtcctgcacaactgtatctatgctgctgggggctatgatggtcaggaccagctgaacagcgtggagcgctacgatgtggaaacagagacgtggactttcgtagcccccatgaagcaccggcgaagtgccctggggatcactgtccaccaggggagaatctacgtccttggtgaggccctgggggcggggaagagtcctgactagcccatcttttgtggactgcttttgcttttgctttccttttttttttttttttttttttttagaaacaaggtctcgctctgttgcccagctggagtgcagtggtgtgatcacagctcgctggagcctcaacagcctgggctccagccatcctcctgcctcagcctcccaagtagcagggaccacaggcgcgcaccaccacacccggctaatgttttttttcttttgagatggtgtctcacagtgttgcccaggctggagtgcaatggcatgatctcagctcactgcaacctccacctcctgggttcaagcgattctcctgtctcagcctcctgagtagctgcgactacaggcacatgccaccacaccaggctaattttttgtattttagtagagacagggtttcaccatgttggccaggatggtctcgaactcctgacctcgtgatccacctgcctcggcctcccaaagtgctaggattagaggcatgagccaccgcgcccggcctgttttgttttttgttttgttttgttttgttttgttttttgagacagagtctcagtctgttgccaggctggagtgcaatggcacgatctcagctcactgcaacctccgcctcctggtttcaagtgattctcccccatcagcctcccaagtagctgagattacaggcgcctgccactatgcccagctaatttttgtattttagtagagatggggtttcaccatgttggtcaggctggtcttgaacgcctgacctcaggtgatctgcccacctcagcctcccaaagtgctgggattacaggtgtgagccaccgcgcccagcttaatgtttttgtttatttttattttattttattttatttttttgagacagagttttgctcatgttgcccaggctggagtgcaatggcgcaatcttggctcactgcaacctctgcttcccaggttcaagtgattctcctgtctcagcctcctgagtagctgggaatacaggcacgtgccaccacgcctagctaatttttttttgagatggagtttcactttcgttgcccatgctggagtgcaatggctcgatctcggctcactgcaacctccacctggcaggttcaagcgattttcctccctcagcctcccgagtagctgaggttacaggcatgcgccaccacgcccggctaattttgtatttttagtagagaagggttttctccatgttggtcaggctggtctcgaactcctgacctcaggtgatctgcccgcctcggcctcccagagggatgggattacaggtgtgagccaccatgcccggccaattttgatttttagtagagacggggtttcacaatgttagccaggctggtcttgaactcctgacctcaggtgatccacctgcctcagcctccgaaagtcctgggattacaggcatgagccactgtgcccggcctttattttattttatttttatttttttattttttgtttatttatttatttatttattttgaggtggagtcttgctctgtcaccaggctggagtgcagtggcacaatctcagctcactgcaacctccgcctcccgggttcaagcgattctcctacctcagtctcccaggtagctgagattacaggcgtgcatcaccaatcgcatctaattttgtatttttagtagatacagggtttcactctgttggcgaggctggcctcgaactcctgatctcaggtgatctgcccgcctcggcctcccaaagtgctgggattgcaggcatgagccaccgcgagtggcctattttcctatttttatttatttattttgagatagggtctcactctgttgcctaggctagagtacagtggtgcagcctctgctcactgcaacctctgcctcccagactcaactgatcctccccacctcagcctccctaatagctaggactacaggcgcgcaccaccaagcctggctaaatttttatgtttttttgtagagatggggcttcaccatgttgcccaggctggtctcaaactcctggactcaagtgatccacccacctcagtctcccaaagtgctgggattataggcgtgagctaccaagcctggccatttttttttttttttttttttttagtaagagactaaggttttgctatgttgcccaggctggcttcgaactcctggcctcaagcaatcctcctgcctcagccctgcaaagtgctaggattataggcgtgagccaccacgcccggcctgcttttgcatctcacagctgcatctctctctttctgtcccctgctcttggatgtggtgtgacaggtggtgaccatcccttctgttcttcccgcaggaggctatgatggtcacacgttcctggacagtgtggagtgttacgacccagatacagacacctggagcgaggtgacccgaatgacatcgggccggagtggggtgggcgtggctgtcaccatggagccctgccggaagcagattgaccagcagaactgtacctgttgaggcacttttgtttcttgggcaaaaatacagtccaatggggagtatcattgtttttgtacaaaaaccgggactaaaagaaaagacagcactgcaaataacccatcttccgggaagggaggccaggatgcctcagtgttaaaatgacatctcaaaagaagtccaaagcgggaatcatgtgcccctcagcggagccccgggagtgtccaagacagcctggctgggaaagggggtgtggaaagagcaggcttccaggagagaggcccccaaaccctctggccgggtaataggcctgggtcccactcacccatgccggcagctgtcaccatgtgatttattcttggatacctgggagggggccaatgggggcctcagggggaggccccctctggaaatgtggttcccagggatgggcctgtacatagaagccaccggatggcacttccccaccggatggacagttattttgttgataagtaaccctgtaattttccaaggaaaataaagaacagactaactagtgtctttcaccctg

SEQ ID NO: 21 - DNA, 26740 bp, Homo sapiens
cgctcagggaaggcgggtgcgcgcctgcggggcggagatgggcagggggcggtgcgtgggtcccagtctgcagttaagggggcaggagtggcgctgctcacctctggtgccaaagggcggcgcagcggctgccgagctcggccctggaggcggcgagaacatggtgcgcaggttcttggtgaccctccggattcggcgcgcgtgcggcccgccgcgagtgagggttttcgtggttcacatcccgcggctcacgggggagtgggcagcgccaggggcgcccgccgctgtggccctcgtgctgatgctactgaggagccagcgtctagggcagcagccgcttcctagaagaccaggtaggaaaggccctcgaaaagtccggggcgcattcggcacttgttttgtttggtgtgatttcgtaaacagataattcgtctctagcccaggctaggaggaggaggagataaccgccggtggaggcttccccattcgggttacaacgacttagacatgtggttctcgcagtaccattgaacctggacctcccttcacacagcccctcaatcgtgggaaactgaggcgaacagagcttctaaacccacctcagaagtcagtgagtcccgaatatcctgggtgggaatgactaagacacacacacacacacacacacacacacacacacacacacacacacagtaggaaaggtgtatttcaagcacactttctttctccttggggagaattattgctaaccatctaagttttctggaggcggccttttttctccccagcctcccggcggggtcaccctctcccaccttccaggagagtggaggacccgtgagatacggggcacgcaggcagcgacttcctgaaatgctaacaaggatcgtaggatcagttactgctgcgaggagcaagcacttgcttcttgggggagttttgcagccaacagggaaatgggctttctttgtgagttagaggtagaggtccggcggcctgagtgattgaaactgctcgggacaatgctcgtatgtttagcaaacgacagaactgtagaactgttcctgagaaatcccaactgatagtattttagtcatctcagacgacagttagcacagtttaaaaatgaggcctacttcttgaaaaacagaatccaaggtagttttgtcctcacattgacaaatgttgacacagccagtgtaatttcctataaccaggaaaactgaaagaatatatgtacagttaaaatatgtacaatgctaattaaaacttgtgtaataagtctaaaagtaatttaatgaggcttcacttttatgaccgtccttgtggtatgcttcgccaggaatatatagcttcaaaaagcaaaggccagcggaggggtaattatttttttactgcaatgttaattgtctctttgacatggaaatataaacctgttaaaactatcagtgtttaatttagtgtctcaatttctattagcaaaaatttataatctataggataaatgcacattttattttttacttttcatattatgcaagttaatttttttaatttagtcaaaggagcttataaaggatttcagggcctgttgctggatttgattttaattcattttgaaacattgacaagaccctggttgttgttttttttaacagtggtttatccgtatcagcaaaagtttagccactgtgaccggtaactgtatgaatatagttcttaatattattgtctatataaaaatatttattactctagttaatattattctatataaaatcattttgtttaaattattaagttgcctctgaaaatctgtagtaacaaagtagaacatgtcaatgtatataaatgccataattatgtattttttagtttaggcctataaaacataacattgtggtgattttaagttagagaaaatattttatagtatgttaatgtatatgcatgaaatgcaaaaatatttaaatgataggttcattgaaatagatcattttttgttatttaggtataaatcaattttcaggacgtatgtgaaaagcgcaatcttcaggaagtttctcaagatagaacacagcttggatagaatgtcttgaaatatatgcaattttccaatttcatatgtaaaatgatatacataatataaaatctagcggtgttaattataatgatatgtaattatatatttcacattaatatattttatgcccatggctatattgatttgggaatatatatggatactaattatgttaggattcatacaattccttgagaggcacaagtgctaaaaattacttgtatgaattatttaatatcattgcaaataagatgttattttaactttttttaagtttctgcaaatatgtttattatgactttttatttttatatgattggaaatacatatactaaaattccacgttaccagtttcttaaccacagaaacctgaaaaattgccatagttgatttgttacttctaccttggtgcatttacaaaatagtcatatttttattatgaagttaaatattcatttgtttatagctacttcagaaggctcaggttatttttttctttaatagcacagagtcctctcaaggtaagcactgtgcagttagtataaaccattattccccatgtgtacatgattcacagtttgtattgtgttccaagtgaaccatagccctttcagaaatcaagacttatattcattttacttctttgagtactcttgaattttagaaagtccattatgatcctaaggtagcaacaacatagcctattaccgtctatgatggtttacagatctattattccacgttagttcatcactatcaactaccatgatagagttaagctaaaccattttcccaacatatgaaaaactcctattactaaagtgatacaaatggtatcaaaaatacttttttatagcaaggttcaacagtgggcccagtgcttttacactttttcaaaagtccttggagaaacagagaaaatctcacttgccttctgtactaaaacattctaggccgaactaaaactgaaacttcatagtagaacactgtaggccaggggtgttcaatcttttaccttccctgggccacataggaagaagaagaattgtcttgggacacacattaaatacactaacactaacaatagctgatgagcttaaaaaaaaaaaaaaactcatgatactttaagaaagtgtatgaatttgtgttgggcagcattcaaaaccatcctgggctgcatgtgaccctcgggcccacaggttggacaagcttgccctagctcctccatctgctgcaaagcccagcctgatacaaaaaccaacgtgataaaaagtttttgtggtgctttattttggcagtttaagttatataaacaatgggtacagtttcattttctaaatataaaatttttacattgaatatgaatttttaagacaaattatctgaattctgattctcatatacctaactactaatatcttctctatttgttgcccaatgagattaatccacctcttaaacacttcaccatcaagaaaaacaattttgtattttaaaatgaacccatccactttcattcagctattttatattcaggcatcatcctaaggaaagaaaggttctgacaaagattaatacagatggataagtagtagcaagaaatcaaaaactgcataaaattctagcaataaagtgttaaattatggtacagttacattctggatcatcaggtatctgaagaatatttcatagactgttaaatgattgcattataaagtcaggtttttttaaagcaagattccaaacagtaaacagtttctctctctctctctctctctctctctctctctctctctcaccaaattagttataatggtttccgcaggatgagaggggttgggaaaaagtttggtgatatttattttcttcgtttcacttttgagttttccaaagtgctatgaccatcatcagtaaaatatacatttccaaagcctttgacacacggtaacagtcctacacagtggatgaactaagagcttctctacccttagatgggtagggagggaggaaagacaaggaaactgagttgtttaagtgtcatacacgagaacgtggctttaaggtctgggaaaacctgcgagggctgtgacgtcagactgtgaaatgcacgctatgtccattcaccaagacgttccattttaaaacccataaatccgtagctatacctgtttccaaggtgcctcgtgttaggcctctggtcacagcacttggcgcccttcttgggatctcttctctccgcccccactaccccaccccacaagcacactctagtcccctccaatcaatttcaggcaggtctcgccgcctccggagccacgctgggggtgcaagggccctggacccgaaagagcgcccgcccggcgacaagagatgagatgcacgctgctcctccactcctcagcccccaccatcctcctcctggatcctaacttccccactctctcaattcctagagacgctgcggatcccagaggcttaactggcagctggaacgaggtcctccaacaagaatttagacgctaggtccaattatcactccaccgcgcgcactttccgcaggagcgatgtgatccgttatcataactgcggacctggggttccacgtggaagacgattgggatttcactggccgcggtgggggtgggagcagacagagtctgagtggggttagtggactcgagacgaaaggcaggacatgacagaaggcaactctgggtcacctctccagcttggaactggctaggccttgttttggaggggatgggtagatgaaaagtgagtcagggttacccggaggaaccacggggaaagtgcgcttctgagactcttgacagccatttcgttcccttccaagccagatggagacccaagagtgttgaaaggccacgacttccctcagtttctccatctgggggtgcaggatggtatagagagtggcccgtagtatttttccagtgacgatgtctctccattgttttcttcttatattgcagctttccccatgtttgaaaattttcttttcaaatgaaatcattgattagaataaaaaaaagtaagtagctattaaaacaagatcaatttccatgacagtaagccaaccgatggagaaaaccttgggaattaataaatgaaggatttgtttggtagatgataaaaggtccttttaaagggtctgactcttcctagaaaaacccaccaacttgggaccgcaacagatttaccatatcctaattcatgctattttaatgtgtattcagcaaacccacatgtgtttacaattgtcgaagctaccaaatgtcaatagcgttttttttctatttgttgaatgtgaatctcttgtacgaagccatataaacagaagaaattacaggaatgattttaaatcacatacaaaaccaatagtattgctagaggagagttagtcaaggacggcattatgaagaaagtgagggagaatttccaaagagcagaacgatagggcttggtggaccaaagaacgtttccatctaaagggaatggcaaatacttagagtctctgaacccactgaatcttggactatttaactaatatttgtagttccagatatagcacagtgccttgtacatagtggtatttttaaaaatatagtgcctcgtagattttttttcaacttttatttaggaggagagggcacatgtgcaggttaattacaaaggtatattgcaccatgctgaggtttcgagtacgactgaatctgtcactcaagtagtgagcacagtacccacagtaggtagtatttcagccctcgctcattccctttctcctccatctagtagtccccaatgtctattgttctcatatttatgtccaattagcatttgttttttaaaaagggtggttgaagaaattctcagtgcttgtcagtgtctctcagtgcattcatttaattcatgagccctggaatgatggtttcatttgggcagaactctacaatcaaaaagaagtaataaaagggaaaaaaaagtgaaagccatcaactacaggattgaaattcccaaagcatcagaggtcctttcaaaaaatagtatgttgatttttaatttttatgacttattggctttgttcatgaaaatataaacatgttatcacaaaggattttttaattcaactatttctcagttttctctttcaccttcaaaataaaatatcataaattatttaaatggttgtgaaggcagtaggatttttttaagagagaaaagttttatagaggttcagaattacatgaacaaagacatgtaatctcttaagcaaattgaaactaataaaatcgtacaatcaaggtaacgtaaataaaaaagcctctgctttcttaattgaattatgtgagtaactagaaattttaaaagtatggcaaaggttaacaacagcattattacctgggctgcctttaaaaatacatatttctggggttcacgttcagaaaatttgattcagatttgctgtgggtcccagaaatctgcattttaaataaacacttgaaggagatactaatacaagtggcccattgggacacaatttgacaaatatgaccaattttactttttaaaccttatttctgcttctttatctttgaattgaggtccaggattttaggtaagattttaagtttagagtcagtttactggatcccagggaggagagtctgagtaatcagtggaggagttatttcaccaaatgaaggagaccctttattattatgtgaccctttgtatgaattggaaaagaatgtcttgtagataccacatttttacagtcagaacatagtttgagagaaaaaaatataacaagatatatttgtgttttaaagcttacagaaccagacagaaaatttccacataagctatataagatacgttgtctttttaaaacactatatacacttctttctgttcgtgcaggatgaatggatctctctctctctctctctctctctgtgtgtgtgtgtgtgtgtgtgtgtgtgtgtgtgtgttgtaataaggggtttctttcattttatgatccagaccaggctcgtaataaacatgacaacctaaaattatgtaaaaaagaaaaatcaaagcacaagtgtttcacaggtttaacttatgcttatctaagatcagggcaagattgcaggaaaatgtagccataacagaataaagcatttatggacaaaatgatgggtctttatgtctctgtaaaagcacagtgatggggggggaaatatagatgaaaaatgtaagctaaaaagtaacaattataagaaaaactaaaatatcatgcctttcaaatgatcatttttctgcttttaagctaaaatttgtctaatattacaccagtgactttgctgatgtattaggaaaaagcttgttttgctttcttttctcgagtgccaccattttcttgctctcattctctttcaggctgccagatcatctgactcagcaattgtataactctctcacccaatttaaagaaacagcagctgtctagagaacaatgactcccccagttgaacatctaattgttaaatgtccaacatcggacactttgaattttactccatgcaatttacatgctgaatagttgaagttgaatatattatatttaacatttaatttttaaaagcttattgaaactttcttcctaaatcacatggtaaagttattgttttcttcaaaaacaattaggaggagcttaacaataataggacacttcaacttccattatctaatttaattatcacaatatccttatgttttcaatgtttcattttttcattttgtagatctggagactgaggctcagataggttgcatggcctaccaaaagtcattgactagtaattcatatatagttgaacttggttgcccatggagtgctataaatatgtatatggtttcagttccatctcttttagttaactattattttgaaagtcgcttaacccctttgggcctctactatactcaagcatcagccgtataagtcacagtaaatatttattggttgaaaggaggttaacatctttcaaaaatttattttttgaccaaaataaaaccagtgaaaaattctcatatgactgtacatataaattacttattcctaccttaatttaaaagcaataagtgggatacctattcaccagcacaggaaccacttgaagcgtgcagttgaaagattactttctttagcattcacatgacctgtgagcagattctatttcttttgcttattagctgtcatggtaccagaatgaagtatgagaaactctcagtgctttcatgttctcatctgtaaacctgagaccctatggtagtcccgtaataagaggtagataaaatagtatgtgtgaagagtcactgtaaacttttacacagtgtacgtttgtcagttattatagtgcctaattaaactatgcccttaagaaagcacattagttttttacagtaaatacctacttcattataatttttcagtgtagctagaaatttctaaactccactttaaaaatatacatatcataataaaaatatatttatgtattcagactcctggtatgttccaaggtgttaggtaaaatcagtgtaaatttgcatacttttaaattcacatctgtacagaagatctatatggtggcctttagggtatacctctaagctattctagtattcataatcattaaagagatattaagcagtgtttgtgaacccctgttttctaagacaggaaatcaaggtagctttagaaaactggaaaaaaagttattagtctatctatctaataacccagaataataatttccaaaggaatcactgaagataactggatttttaattccttcagaatggttgtcacagtctgaatatctgaatcaacagttttgaccaaaacaattttctaaaaattctttagtataaaaaattatgtgtgtgtgtgtctgtgtgatgaaaggaatgataggcagaaacattactgtcatccttacgacattcaaaatgcctaccttggagggtgaccttcagttatttttatgcaaatgtgaagaagttatttagaagtaggatatcaaagagtaacacaaaatacactaaatagtatgctttcttaaggctaaattgacttgggggttttaaatcagtacagagtaaacatacagtatattctgttatcattgcctttttgaaaaattaattatggaagttatcatcttaaccgtaacaacacaaaagataaaactctaccctcaacccagagactcaaaggaaaacatgagtggaaatgttaaatctgtatgtgaaaagtgctaaaacatgaataggaagcagttacttatttaatcaaagttgattatatttcatcaagaagttgattcccttgagtggagttgaatcacatatcaggtgaagaatgtgatttggggaagaatggtctaacacaagaaaattttcttgcaatctttaataatatcagaggggagattggcttcagaactctcctaagttcaggaaaggacacagaaaattgaacataacagtaagactatagagtcccaagaaagcaagctacttttaaaggatagttttttagaggggcaaaagggggacaaccattctccatttgatgagaaaagcttccatgtagatggtgcccctgaaattagagtatcctaaaccagtgttaaacctatcagtgaaacatgaatattaaacctccactcccagtagtgaaaaccgaatacattattatttatctgtgactttcaacattatctcagaactctaacagcacatgcgtacatcagcagcataagcagaaatgagatattatatatgcttgtgttagcaattaaaaaggacagcatatttgagaggggaaaatctgtcctatcaagaatgaaaaagagggaggttaggaaaagtagtttagagaaagtaaattttgcaattcctcagttttaactgtagtttctccattgtaccttccacttgaaatgcactccaagcagtggaggtgggtagcaatgaatgcagaggaaacactgaacacagtgacactctccagtgtcacttctcatgatttaatgaggggttttttttggaaattcttctgtcataacatgggaaactttgttacaaagaagctgttttttcagagggttagaattcagaggtagcatcataccttttagaagagaatttgcttgttgaaaccacagatacctgctagaatgtacaggaattaatgaaaaattactcaaaaggacatttattttgatgacctaaatgaataacttcatagtaaatgtcatatatattctcaaaaaattaaaaagcaccatttattgagagcctaccgtgcacccggatttttatatatctgacattctttattcctcacagtaaccttatggggtaaattttattttccccactttgtgaggtgaggaaataaaggctcagaaagtttacataacttattcaagcccacagagctggtaaatgagaggtcagttctatctgagtttaaagactaggcttgtcccacttgcatatgtgtcatttccaaaattatgattaaggatatggttggcatttcccgccacccacattaagtccaattaagtagctgtggccatagaaagaatggagaatggagagaggaactgacttcaacagctacagcaaacatttattagctgagtaaccatagctacatagttcctcaatatgtaccactcctccattttgttatctataaatcaaaatggtggctttttaaaaagcagttttacaatatattcaagagccttctaccctttgaaaaactgcaatactatttttagtagcaattagaaacaccttaaatatctgacaacagggacatcattaagtaaattataactttttccagtgggatgtgttacagctgttaaaagtagcatttatgaagtgtttttggagaagtttggaaaatgctgtaataagttagaaaaagctcatttcaaaattgcataatattcacaatgtaaagattaagcaaagaaaaaggaagaagtatttcaaaatgttaataattattgctttgtgtggggtagtttttcattttctatgtgcagctaattccttaattatttttaaatatgtgagctttaatcaggaaagcaaatcattcaaaaatgaggggactgaattaagtgactttcaggggactttgcgtgtctttgagttccaaatttctatcactatgtattactactgaagaataatcatagaagcacagtagtttctgaaaatggagagtcagtaatcttggcccaggttttgcaacttgctctaaagcagagtcctcaaagaaaaggaagcattgatgagttgtccacaatgtactggataaattatcattaggaaaacatattgtagtagggagagtgaggacctctcaaacagaactgagaaccttaagtttgaacttttcttttccttattacttaagcactctgagcttttttttttgtctgcattatgaagaaagaataatactctctatcccatgggacagctgtggaattataaattacacatataaaactgcttgatgcttgtcacatagctgggggttgaaaaaatgatagccattattttcttggcaacttttaatgaattttttattatctctatttctttctgcctatctcctctaattatgtttattacttattttgttcctcaggatgaggtcaattctcaatatctgtgctgtacataatatacatatataccaaatatgtgcatatagtatgtacatacatacatactgtgctaatcttttagtgttctcagctgatcaaatagctacaaatagatataagtaattcgccacaagtaatttatcaacataaaaaaaatttacaaaaaagttaaggaataattgtctccatgagctgcaaagatccctcatttcacaagagtacaccctagagatattttaatagtaaatttctcacatagatttaaaatcacatttgttttgcacataatttagaaaagatacctgctatataataagtaatatacttttaagtttccttcaaaatattcttgggaagatgataataggtactgctaattctatacccagttaacattttggaaactaaggttgaaaattgtgacttaactataattatgcattaaatctacaacacatcaaagaattttgcattttgtactccttactaagatccagtttgagtaggaagataaattttacagtaattctgaatgagggaagttggcacagagtttctaaaagagtaccttccttatagcaaatactaaataattgtgctatattgaatttaattaaatagagaatagtaaaagggagaaagaaacatccaatgttttgaaacttctagagatctactcccagggacacattgttttttcttagcaaatctgtttggaggtctgctctactttctcagaggtctccctttcatgctgaagctatcttttttccttgtggaacataagtaattaaataccttgcaattatttacctaagaaagtgtttctttcccgtttaaaatgctcttaccacccacattggactcgattatcagaatttttatccggggcagcttcaggagcactttggcacttcggggctaaaccacaatctgtttttacatgtttgtgattatacccgttttgtagatcaagacattgaagctagtaaaaaaaaaaaaaagtcattttttcagggtaacaaagtaggtggtagaactaggacagggactctaatttccttacattattgcttttctaaattaaagggatgcatggaattattcctccattgcctttgccttcaaataattatctattgcacccaacatcctattctagaactcatctatgaaggcttaacacagctgtacctgggagctccattacagggcatatatctcgctctcataagctacttcctaaggaattctctttaattatgggagcttttccagactctgaaatctttttttcctggtaacacaagtgtgaggtgtcatttatcagaatgcatcaccccagtcttccctcctcaaatgattactgtaggctccactcaagagctcatcccagttcaagaccaccttcctcctccagagaagcaaatatatatatacacgtatatatatatatacacgtatatatatatatacacgtatatatatatatacacgtatatatatatatacacgtatatatatatatacacgtatatatatacacgtatatatatatatacacgtatatatatatacacgtatatatatatatacacgtatatatatatacacgtatatatatatatacacgtatatatatatacgtgtatatatatatatacattttttttttttgagacggagtctcgctctgttgcccaggctggagtgcagtggcgcgatctcggctcactgcaagctccgccccccgggttcacgccattctccttcctcagcctccggagtagctgggactacaggtgcccgccacctcgcctggctaattttttgtatctttagtagagatggggtttcaccgtgttacctaggatggtctagatctcctgacctcgtgatccgcccgcctcggcctcccaaagtgctgggattacaggcgtgagccaccgcgcctggcagagaagcaaatatattgatggttgttaccaatacatgctcttgactaagaaaccttctttcttaattaatattgacaactttaagccgagtgcctgacatatattaggtactcagttactctttttcaactaaagttatgaatgatgattctaataaaagtaacttatttgtctactagttttattatgtttatttaattcattagaaaggccatggacatagtacaaaattcaaacaatataaatcatggaatgtgaaaagtaagtcacatgcccatcccagttcttcatttccttacctcacaggtaacagcttttcctgtatctccccagagatattctatgtatattttgtttttaacaccaagctatatttaaaacaattatctttaataataatgttaatattgaaactggtaaagaaatatgtgtgtattatctcacctcaagcgtaaacaatagaacaagagagagcccattttgaaaattatggacaatgaatctagaaataatctcaaaagattttgcagtcaaaaaatagttcattagatacatgagaactgtcacttggtctcagtgtagagctattgcctcaactccctttattttcctaacaaaatcatcttgcttatcccatgaaatacgtgcatattgccaatcctacaatgccgcatcagaaccagaacccaactctggaacactaccttctcaagtatctttctgtctctttatggtaatatgttgaattaatattcacatctattatgactagtctttgatttgtagggttgctgaagtagtagcaccactgcagggctttctttagtttaaagaaagtaatcaggtgtccctactgtgtcatgatctccaccctcagctgggttctccagtctggttttaaagaacaaaacaaaaggcttctctgtctgagtcttactcaacccatcctctctactcataagaggtattccaaacctttacgattctcaaacttcctaaccgaccatcttattttcactctgcaaacaagctaacctcctcattcatagaaggaagtgcctcaacttcctccccgttctgaccttttctccctcccaaatctatgtatctcttgtgacaaaatctataaccaccgctgtactttgagttctatttcttcattatttttgagggacctcaagtcctcaaaaatatcctatcttgcctgtgtacttaacttttcttttattcttttctaactttcccttctcttcacttggcacttgcccttccaggtatatgtgtgctcaggtctcctccaccttccatctgcctcacttcatggcatagggccttgaactatcacaaccaagctatgaaagagtagtcaacgcagtgtccccacttccttgccatcccattatcctagtttttcttttggctctctgaggagtccttcacaggctggttttcaggaataagtctaaatgaatcactttcagttttcctaaacttctatgcctttgcacatcctcttacctctgcctagaatatctttctccttcttttccatctttaaactctcacatcattcttcaagactgggatcagctctcagcatccggaagcctttgcctactagagacaaatgagaatgagtttggtcaccttttcattttcttgtatcattctgtgctttattttgctcttctaagagcgttacatgcttcatttaatccctaaacaactgtttgaggcaagtacagttattatcctaatcatgcaaatgagaaaacagaggcccagacatgttgagtaactttgataaaagttaaagaaccaataagtggaacagttgaggtttgaaccctggcagtctgactgtagagatactatgtttgacctactcccctctgcccccaccccatgtctgcccttagtttctgagcttgttgaatgaatgaacaggtggtagtctttttttgttataagactgatcagaattaagacaggtttaaatttcacgtgtagaattttcaaaactgcaaaggcagtgcaaatctaaaaaaagaatggcattctcaggaaagaggaaaagtaagtgtgagaataataataacaataaccaacaaactttagtaaatttagtaaatgtagtaaatttttacattaaaagcttttggacatacattatcatattttatggccacatgaaatatattataatcccattttgcacataggaaatctgagactggcataaggagcacagagatccaggactttatattttcattcttctaggattttgcacctcaggtcgatatgtatgagtaaactgggagtataatgggctctttaacagaaaaactaggaaagttttcccactattattaattatttacataatatttttttaattttattattatttatactttaagttttagagtacatgtgcacaatgtgcaggtttgttacatatgtatacatgtgccatgttggtgtgctgcacccatcaactcatcatttagcattaggtatatctcctaatgctatccctcccccctcccccctacataagatttataatggataatggacttcaatttctagagcaaaatggccccacccaaggatgccataatccttccagagctctactgcaagatatgagatatacatatctaaaacttgttcttggtatttccaaagcagtcaacttttacacctgtttataatgcatccaaatgttgtttttatatggttgcatctcccatcttcttcaccaatagctatatatatttttcacaagagctgaaagagttcttgatgtaggaatccatggtagagtttcagagaaatccctgaattcactgaaagttttatctagaaatacatgtgcaagtgaacacatcttttttaaaaaaaatcattacctactttcttttttgagaagaaggtatttatttcaacagactcttgaaggagcctactcttcccactctcccacccccattaagaaccactgtaggccgggcacgatggctcatgcctgtaatcccagcactttgggaggctaaggtgggtggatcacctgaggtcaggagttcgagacaagcctagccaacatagtgaaaccccgtctctactaataatacaaaaattagctgggtatggcagcatgtgcctgtaatcccagctactcgggaggctgaggcaggagaattgctcgaacccgggaggcggaggttgcagtgaaccgagagagatcgtgcggtgccatttcactccagcctgggcaacagagcgaaactccatctcaaaaaaacacacaaaacaaacaaacaaaaagaaagaaccattgtattagtgatggaaatgtgttccctccctcccatcctggcaaccactttcttcctcctccatcataaaatatcttaaactaaactaaaataattttatttatcgatagtttgaattttccctatcattgctacacagctaattgagaggtaccccgaggaaaatataaatggtacagtaatgcattgtagattttaataacatacttgacatcccaaattgttttcattggcttcattttaaaaactacatgttttaaaatcaagcagacactaaaagtacaagatatactgggtctacaaggtttaagtcaaccagggattgaaatataacttttaaacagagctggattatccagtaggcagattaagcatgtgcttaaggcatcagcaaagtctgagcaatccattttttaaaacgtagtacatgtttttgataagcttaaaaagtagtagtcacaggaaaaattagaacttttacctccttgcgcttgttatactctttagtgctgtttaacttttctttgtaagtgagggtggtggagggtgcccataatcttttcagggagtaagttcttcttggtctttctttctttctttctttctttttttcttgagaccaagtttcgctcttgtctcccaggctggagtgcaatggcgcgatctcggctcactgcaacctccgccttctcctgggttcaagcgattctcctacatcagcctccgagtagctgggattacaggcatgcgccaccaagccccgctaattttgtattttttagtagagacagggtttcgccatgttggtcaggcttgtctcgaactcctggcctcaggtgatccgcctgtctcggcctcccagaatgctgggattatagacgtgagccaccgcatccggactttccttttatgtaatagtgataattctatccaaagcatttttttttttttttttgagtcggagtctcattctgtcacccaggctggagggtggtggcgcgatctcggcttactgcaacctctgcctcccgggttcaagcgattctcctgcctcagcctcctgagtagctggaattacacacgtgcgccaccatggccagctaatttttgtatttttagtagagacggggtgtcaccattttggccaagctggcctcgaactcctgacctcaggtgatctgcccgcctcggcttcccaaagtgctgggattacaggtgtgagccaccgcgtcctgctccaaagcattttctttctatgcctcaaaacaagattgcaagccagtcctcaaagcggataattcaagagctaacaggtattagcttaggatgtgtggcactgttcttaaggcttatatgtattaatacatcatttaaactcacaacaacccctataaagcagggggcactcatattcccttccccctttataattacgaaaaatgcaaggtattttcagtaggaaagagaaatgtgagaagtgtgaaggagacaggacagtatttgaagctggtctttggatcactgtgcaactctgcttctagaacactgagcactttttctggtctaggaattatgactttgagaatggagtccgtccttccaatgactccctccccattttcctatctgcctacaggcagaattctcccccgtccgtattaaataaacctcatcttttcagagtctgctcttataccaggcaatgtacacgtctgagaaacccttgccccagacagccgttttacacgcaggaggggaaggggaggggaaggagagagcagtccgactctccaaaaggaatcctttgaactagggtttctgacttagtgaaccccgcgctcctgaaaatcaagggttgagggggtagggggacactttctagtcgtacaggtgatttcgattctcggtggggctctcacaactaggaaagaatagttttgctttttcttatgattaaaagaagaagccatactttccctatgacaccaaacaccccgattcaatttggcagttaggaaggttgtatcgcggaggaaggaaacggggcgggggcggatttctttttaacagagtgaacgcactcaaacacgcctttgctggcaggcgggggagcgcggctgggagcagggaggccggagggcggtgtggggggcaggtggggaggagcccagtcctccttccttgccaacgctggctctggcgagggctgcttccggctggtgcccccgggggagacccaacctggggcgacttcaggggtgccacattcgctaagtgctcggagttaatagcacctcctccgagcactcgctcacggcgtccccttgcctggaaagataccgcggtccctccagaggatttgagggacagggtcggagggggctcttccgccagcaccggaggaagaaagaggaggggctggctggtcaccagagggtggggcggaccgcgtgcgctcggcggctgcggagagggggagagcaggcagcgggcggcggggagcagcatggagccggcggcggggagcagcatggagccttcggctgactggctggccacggccgcggcccggggtcgggtagaggaggtgcgggcgctgctggaggcgggggcgctgcccaacgcaccgaatagttacggtcggaggccgatccaggtgggtagagggtctgcagcgggagcaggggatggcgggcgactctggaggacgaagtttgcaggggaattggaatcaggtagcgcttcgattctccggaaaaaggggaggcttcctggggagttttcagaaggggtttgtaatcacagacctcctcctggcgacgccctgggggcttgggaagccaaggaagaggaatgaggagccacgcgcgtacagatctctcgaatgctgagaagatctgaaggggggaacatatttgtattagatggaagtatgctctttatcagatacaaaatttacgaacgtttgggataaaaagggagtcttaaagaaatgtaagatgtgctgggactacttagcctccaattcacagatacctggatggagcttatctttcttactaggagggattatcagtggaaatctgtggtgtatgttggaataaatatcgaatataaattttgatcgaaattattcagaagcggccgggcgcggtgcctcacgccttgtaatcccttcactttgggagatcaaggcggggggaatcacctgaggtcgggagttcgagaccagcctggccaacaggtgaaacctcgcctctactaaaaatacaaaaagtagccgggggtggtggcaggcgcctgtaatcccagctactcgggaggttgaggcaggagaatcgcttgaacccgggaggctgaggttgtagtgaacagcgagatggagccacttcactccagcctgggtgacagagtgagactttgtcgaaagaaagaaagagagaaagagagagagaaaaattattcagaagcaactacatattgtgtttatttttaactgagtagggcaaataaatatatgtttgctgtaggaacttaggaaataatgagccacattcatgtgatcattccagaggtaatatgtagttaccattttgggaatatctgctaacatttttgctcttttactatctttagcttacttgatatagtttatttgtgataagagttttcaattcctcatttttgaacagaggtgtttctcctctccctactcctgttttgtgagggagttaggggaggatttaaaagtaattaatacatgggtaacttagcatctctaaaattttgccaacagcttgaacccgggagtttggctttgtagtcctacaatatcttagaagagaccttatttgtttaaaaacaaaaaggaaaaagaaaagtggatagttttgacaatttttaatggagacgggagaagaacatgtagaaaaggggaaatgatgttggcttagaatcctaactacattggtgtttaatataggaacatttatttatataacattttaaagtactaaattcatattagtatattatcaaatggatatattatcaaatgggtttaagcatcctacacattttaattcaattgattcattttctttttgctttggatttctatcatgatttaaatatttacatatgggttactttttagatttttcatactatgaaatataagaaaaacctttaaggctagttttatgaccaagacgaaggacttcattgaatacacaaaacaataaatatactgcaacattttgtctttctttttgtagctgcaatttggtttgcttatactttctctttgtctctttgaaaactgagtcagtttcactttctcaggacaggatttaataaccataatataatttagtataattccttgatttaggcaaattatgcaatttgtgtttagtatgaaatgtacctaaaaataagtaactcctctttaacaccaccatcctcaaactaatataacaaataacagttatcctaaaataaattgtctacttccaccatgcagcactcaaattttaaggttgctatgactgcagacagtattttaaaattcctctctggaaatggctttgtttccaagatgatttaggaaccaaagaggtgaccatctcttgtttaatgaactctcaaatcataaacctgggaagtgttttagtttcctactgctgctgttacaaattatcacaaatgtgttagctaaaacaaacacaaaattattattttacagttctagagatcagaagtcaaaaatgggtccacaaggtttcattccttttggaaactctaaggggcaatctgtttccttgtcttttccagcttctagtgaccatcaaattccttggctcatggtctctgtattttctctgtggcctgtgcttccattcttgtatcttctctctgactgtgaccctctaataaaaacacttggggttatgttgggcccaccctgaaaattctggataatctccctcaagaccattaattaaatcacatctgcaaagcctcttttgccacataagttaatgtattaaaagtttttgaggattaggacatagacattgggggtgggggggcattattcagcctaccacaggaaggaattttagggttaattaaactagccttcttattttatacttgaagaaattgaagttttggaattggagagcattatgctaaatgaaataagccaaacacagaaagacaaatatcacatgttctcacttatctgtgaaatataaaacaattacattcttagcagtaaagagtagaatggtggttactagagctggggggtgggaggaatggggagatggtaatcaagatataaagcctcagttaagatgggaggaataagtttgattgttttttttgagatgtgtttcatagcatgatgaatatagctaaatagtaaatcccaaatgctctcatttgacaaaaatgtcaaatatttgagatgatggataggttacttagcttgacttaataattccccattgtgttcaaagatcataacttcatattgtaccacataaatatatacaactgtactatcccaatatataattttaaaactaatataatgaaaaagaaattgaagttcaacattcccagaagctaagtgtaacttaaaagttttgtgagaatttgttttaacaaacaaacaagttttctctttttaacaattaccacattctgcgcttggatatacagcagtgaacaaaaaaaaaaaaaaaaatctccaggcctaacataatttcaggaagaaatttcagtagttgtatctcaggggaaatacaggaagttagcctggagtaaaagtcagtctgtccctgcccctttgctattttgcccgtgcctcacagtgctctctgcctgtgacgacagctccgcagaagttcggaggatataatggaattcattgtgtactgaagaatggatagagaactcaagaaggaaattggaaactggaagcaaatgtaggggtaattagacacctggggcttgtgtgggggtctgcttggcggtgagggggctctacacaagcttcctttccgtcatgccggcccccaccctggctctgaccattctgttctctctggcaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcaggtgaggactgatgatctgagaatttgtaccctgagagcttccaaagctcagagcattcattttccagcacagaaagttcagcccgggagaccagtctccggtcttgcctcagctcacgcgccaatcggtgggacggcctgagtctccctatcgccctgccccgccagggcggcaaatgggaaataatcccgaaatggacttgcgcacgtgaaagcccattttgtacattatacttcccaaagcataccaccacccaaacacctaccctctgctagttcaaggcctagactgcggagcaatgaagactcaagaggctagaggtctagtgccccctcttcctccaaactagggccagttgcatccacttaccaggtctgtttcctcatttgcataccaagctggctggaccaacctcaggatttccaaacccaattgtgcgtggcatcatctggagatctctcgatctcggctcttctgcacaactcaactaatctgaccctcctcagctaatctgaccctccgctttatgcggtagagttttccagagctgccccagggggttctggggacatcaggaccaagacttcgctgaccctggcagtctgtgcaccggagttggctcctttccctcttaaacttgtgcaagagatcgctgagcgatgaaggtagaattatggtcctccttgcccttgcctttcctttttgtgatctcaaagcatcctccctccgcccccattccatggccccagttccctactcccacagctgtctgctgaaactgccaacattactcaattgtttctggggggaggaacatttttttttgaaacaaaatagatatatgaaacagtacacgggaattaacacgaatatttaaggtaaaacatgaccttgaagattatgaaatccatcttattttggcccagaacgggggcattgggctccttgggccataggggagctggggaggacagggtgaagagttagctctaagccctctgcttggagatgctgtaaatacagaacgcaaaatcaccttcgaagttaaagacgcgaagttcttctttactcggcccctcctcccctcccccccgccaattccctccagttacagctagcatccaggtcccgggaggtgaagaaggagacttcggctccagttacagctagcatccgggtcccgatttagaaggagctgccaattacagcgcggttccagggctgagcaaaaagcctgaggagccaagtgggagagggagtaaaactactgaattgggccacaagcaaatgaataaactgaacgactcttaaccaaacctaatatatttaatccaaacacacaagtctttcatttcttccctcctcccttccttctcttactccccaacaccccctcttcaagcacaattaattatatggttagattctactgcgtgatcagccctgttctaggtggtgggcacgccaaggtgaatgagaccaaacaagagtcttgccctcatggggtttacatttggagacagagtcgatctgttgcccaacctggagtgcagtggcgcgatcacagctcactgcagcctcaaactccctggctcaaggggttctcccacctgagcctcccgactagctgggaccacaggtgcacgccacgacgcctgggtttgtttgtttgtttaatagagacgaaggtctcaccatgttatctgggctcaagcgatcatcccccctcctcctcctaaagtactgggattacagtcccaagctatcttgcccgacctgggaaacagacgttaaggaagataacaatctattttcagagagcgagtttataaaaccaatgcaatgggtaaatatgaagtgtgaataggaggagaagctaaagagtggtcggagaatctaatgcaagctacgggagaaagaaactcaagtgcaaatgctgcctcaggaataaacgtaaaaagagactttcaagtgcaaatgctccctcaggaataaaataatcttgagactctcaagtgtaaatgctgcctcgggagaaccgaacggcgagctggagcccatacgcaacgagattagagaggaaggcagaagccagagcacatgaataaatgagcatccattttgtttcagaaatgatcggaaaccatttgtgggtttgtagaagcaggcatgcgtagggaagctacgggattccgccgaggagcgccagagcctgaggcgccctttggttatcgcaagctggctggctcactccgcaccaggtgcaaaagatgcctggggatgcgggaagggaaaggccacatcttcacgccttcgcgcctggcattgtgagcaaccactgagactcattatataacactcgttttcttcttgcaaccctgcgggccgcgcggtcgcgctttctctgccctccgccgggtggacctggagcgcttgagcggtcggcgcgcctggagcagccaggcgggcagtggactagctgctggaccagggaggtgtgggagagcggtggcggcgggtacatgcacgtgaagccattgcgagaactttatccataagtatttcaatgccggtagggacggcaagagaggagggcgggatgtgccacacatctttgacctcaggtttctaacgcctgttttctttctgccctctgcagacatccccgattgaaagaaccagagaggctctgagaaacctcgggaaacttagatcatcagtcaccgaaggtcctacagggccacaactgcccccgccacaacccaccccgctttcgtagttttcatttagaaaatagagcttttaaaaatgtcctgccttttaacgtagatatatgccttcccccactaccgtaaatgtccatttatatcattttttatatattcttataaaaatgtaaaaaagaaaaacaccgcttctgccttttcactgtgttggagttttctggagtgagcactcacgccctaagcgcacattcatgtgggcatttcttgcgagcctcgcagcctccggaagctgtcgacttcatgacaagcattttgtgaactagggaagctcaggggggttactggcttctcttgagtcacactgctagcaaatggcagaaccaaagctcaaataaaaataaaataattttcattcattcactca

SEQ ID NO: 22 - DNA, 178144 bp, Homo sapiens
gctcagttgccgggcgggggagggcgcgtccggtttttctcaggggacgttgaaattatttttgtaacgggagtcgggagaggacggggcgtgccccgacgtgcgcgcgcgtcgtcctccccggcgctcctccacagctcgctggctcccgccgcggaaaggcgtcatgccgcccaaaaccccccgaaaaacggccgccaccgccgccgctgccgccgcggaacccccggcaccgccgccgccgccccctcctgaggaggacccagagcaggacagcggcccggaggacctgcctctcgtcaggtgagcgagcagagccgccgtcgcctcacgcgggaagggcgccccgggtgtgcgtagggcgggcgccaaggcggctcggcggggatccgtcctcgccaggggccgggtcccggcgggaggaggcgccctccctgccccccgccacggcggagcgtctgcagaatggtgacaggattctgggttcttgggcgaggggtctcggcttcaacttgacaggtgtcgggcgggtggggctagggtcctgagcgaagtgacaggtgcagttccctcttgtgaggctcggaggcagagggtcgttgcgagcgtccatcagacgcaaaaaatgaaaaataaaaatacaaaaatggtgtctgtgggagagtttttcaccggagaattggagtactccggtggtcgtctgactttctgttttggttcacgcgatgcaacagttgggaagtattttcttccgggcgtgcactgcatctgaagtccatttgtgggagaggccgaccagaaagccttggacaagaagcgcagggtcctgagtgtccattgcccacaggatactcggctcaggagctttgcggcgtttccttagaacaataatgcatcgaggccttggggactcaaagccatctgtagtgattgatggagcgtaactctttagaggaactgaaacatgggcaaaactttcatgagacatttaccagaagtgcttgaaagtttctaaacttttttttttcctgtttgatgaactcttcttgcgtgttagtcggcttcggcttgtctcattatttcttccattttgccttttgactttgaaccagcaaggatcttggtgtcccctctttttgcctttgtttttggcacaaaattagtggttctgtgcgcaaatggaaattttcgttttcccttattaagtggaatctaaatttaagcaagtccatacgaatgcactagatcttgaagggaagtatttattgtattacaacatcttacttttcttgatttttctactttatggttaaatagctatgattgaaagagtgtaattgtcattattgtcagcactggttctactttgagacaagttcattgcagagggaatgggacttgtttctgtttttcactattttctctcccattcttgtctatcaccaaatcctttcaccctcacccatttctttccactcggtatacactaacaattcacggcagaaaagattgaagtgggatttaggaaatggcccctggaaggctattaaaaatttatatatttaaatggactgtcttataggtcagttaaaaaccatattcgttaaaaaaccaaaataacaacaacaaaaaattaaaaaccacgtctggggcatgttctgggaaaagacatggctttagtttctgattaaattctgatgtatccaattcttgcaaatttcccttgggaaaatgcagtaatggctactctaaagaattccatgttatgcacacagctttggaagcatactctaatgtagggtaaccaggaatattgacgttgtggccactgcttggaaaaaagaggactgtttctttcattttttaactcattttatatattttaagtaatggaactataaaaaattctcttataagtcaaaaccatacaagatacagtctgttcttgattatccatacccacaaagggtttcattaacatagacagttgaactctataaattaaccagcaagggtagaaccgctgccgtgcagtctgatactgagcatcttgcctggagatggaatcaaggctcagtccaactgcacctccagtgacagattccattcctgatttgagagtttagatcttatttctgttgccttatctctggcctaagtaatgtagctggaagggaaactgtcactaggaacagcataccacattcattgttgaaataatcaaaggttaatcatgtttcgagctgggtgtgatggcgcgtacctgtagtccatgctactcaggaggctgaggcaggaggatcacatgagcttgggagttggaggccagcctgggcaacaaagcaagaccccagtctttaaaaaaacaaaaaagctgaccaggcatgttggctcacgcctgtaatgccagcactttgggaggccaagatgggaagattgcttgaggccaggagtttgagaggagcctgggcaacaaaacaagaccctgtctctaaaacaaattttaaaaaattagccagtggctgtggcacacctgtaggctcatctactcaggaggctgaggtgggaggatcccttgagcccaggagtttgagactgcagtgagccatgatttcaccactgcaccccagcctggatgacagagtgaaaccctatttcaaaacaagaaaaaaaaacaaaaactaattatgttttgaaggaggaattggcagtctagaatagtggtcaagggcatggattatagagttagactgttgggctcacatagtggtttacctcttaccggctgagacctcaggtaagttctttaacttctccaatttgacagacatctgtaaatgtctacttttacagatgagaatacttatctaaaagggctgatgtcgggattcagtgaaaccatatgtttaaggtactttctacaggatcatagtaaatactcaaaaattattaattattcttcatactattcttattagtagataacacatagaaattagatgaatgaaaatgaattagccaacaagaatttattaaatgcttgtctttgttaaggggaaaggacaaaaataagcagtcgcatcatgtaagatgtgctagtaggtagagagatatatgaaacattgataagagaagactacagtttaacaaagtcactggcgttgaattgtataatattatctatgggtttttatctttttgttgttatctttatcctattttcccaaacagctttagctattacatttactttccttcacagaagtgttttgctgctttgaagtatatttgacttaccatgcaagcaaatatttttcactgtgtggtatccttattttggaatgaccatgaaaaagataatcatatgtttaaatttgaagtgtaatgtttttctaagataaaataagatcttaaagtatttaataatgttctttttcacagtagtgttatgtgcaaactattgaaacaagtatgtactgaatcaatttgatttataagtatatgccaattatatgattattttcatttggtaggcttgagtttgaagaaacagaagaacctgattttactgcattatgtcagaaattaaagataccagatcatgtcagagagagagcttggttaacttgggagaaagtttcatctgtggatggagtattggtaaggattttcttaaaacgttttgaaatttttttttctcattttaaaaacaacttcaaatcactatacaaaaattgaaagatagaaaaatataaagacaataaaagctaataataattccattacccagaggaaatttacctctgctaacattaaaaatgtttgaggccgggcacggtggttcatgcctgtaatcctaccactttgggaggctgaggcaggtggattgcctgagctcaggagttcgagaccagcctgggcaacatggtgaaaccctgtctctactaaaatacaaaaaaaaaaaaaaaaattagcagggtgtggcgtgcgcctgtagtcccagctatttgggaagctgaggcaggagaattgcttgaacccaggaggtggaggttacagtgagccgagatcgtgccactgcactccagcctggcaacagagcgagagtctgtctcaaaaaaaaaaaaagtttgaaaaaaattcctccataaatgcctcccaccaaactattttaaagcaggtcttagttatattttattcactatgatacaaggacttttaaaaaaacaccgccataccttataaaataatttttataccttctaatatgcaatcagtgttcagatttcctgactgactcagaattagttttgttagaattcaggatcttgaaaatatattgatatattcctttcattttttctttgcgtaagtatagatgtatatgtttaataaaaggagcaaataattactagagttttatatgtactggggcaatagtataagaattttacatagccgggcatggtggtgtgtgcctatagtcccagctacttgggaggctgaggtgggacgatcacttgaacctgggaggtggaggttacagtaagccaagatcgcaccactgcactccagcctgggcaacacaggaagaccctgttgcaaaaaaaaataaataaaaataaggctgggcgtggtggctcaaacctgtaatcccagcactttgggaggcccaggcaggtgatcacttgaggtcaggagttctagaccagcctggccaacatggtgaaaccccatctctactaaaaatacaaaaattagccaggcatggtagcagatgcctgtaatctcagctacttgggagggtgaggcaggagaattgcttgaacctgggaggcagagtttgcagtgagccgtgatcatgccactgcactccagactaggcaacagagaagactccatctcaaaaaaaaaacaaaaaaaaccccagaactttacaaatctacgaataactcatttaaaaatcattgagatatgaaatataaaatctttttttatgtgtaaaatgtgaaatgttcatttaacagatgaagacactgagtagagtgaggttgagtaacttgaccaaggtccctaggaaataagatctcaaatataaatttgagattatacatgtagttatgtatagttacctgtagttacacatagttttgtattttcctgtttttttctcatatgagcattttcttattaaagtttttttgtaatatagtttctagtgatagtataatattttagctagtggatgtattttaatttgttaactcttactggatatttgggttttttccaactttttgatgctataaaataatgtaataaacatttgtattcgtaagaataatgcctggcacaaagtgagtccttgataacttgttaaataaattaatgaatgaatctctgattattttattagaataaattcttataagttgaattactaaatcaaaagctatgaacatttttatgactcttgatgattattgctagattacacttcagacagatacttttaatgaatttactttctcaacatagtagtataagagtatatatctgtttttactgatctgattaacacagcggaatgtgtttatgtatgtcccataagaaaattgtttaaaaccattaaataaaatctctggcagtaaaaaggagaaaacaagtgtcatgatttccaaagaattgaacatagtctcacatttcttatgtaaaaagagaggaatactgaagtatcttgaatgtatgacttgggtattataatccccaggcatctaatgtatattttaactgacttgggtacctcatgtacaaagctgtttttgtgcatatacaattaaatgggatcagagctccttcacttttctcttcctaaaatactagatttttagtgttcagaaattttggaagggatagctgattataaagagcattagtgaatatacatactgtagttttcaatttataagtgcattgtgttccaaatctgtttgcaagtttgatatagtagttaggtttccagcctggttcacataacttatttttttttgtactaaactataacaataatagttttaacagtagaggctcttttgagcttcagaattgaatacatatataagcaaatgttactgctttattaccctttttcatcctggctttgtctctaccttccctgggaactggcccagtttgaatcttatttcctaatggagctcataatggggactaggatgtgtgaaattatttatggctaggtactggaggaaggtaagaaaggaatttcatgttatttttgggatttgaggtgtgcttttgaagggtatgatggaagatgatgtcctgttgtcctgttgtaaatcaacagacttttccttgaaatatgattttaagttagagttacgtttttgaggtttggcctgagaatttaaccttcatttatataataatatctaagggagaatgtgatacagtgtgttctaagaagcaaatgtaatgacagaataaatgtgtttccagtgcagctattctagtggcagttgtctctcttctttgaaacaagaggaggaatattgtcaaaaaggaaaccctttttaacaatagaaagtaggtgatgtttattgggatagaggatgggttaagagcaaggattaagagtcaaacagatataccatgtccgaactccattatcttgaacatgttatctacaattttcaagccttagttttcttacctgtaaaagggactgacagtaatttctggatcttggagttatgtgcagattaaataaattaatgcatataaagctcttattagagtcaatgagtatgtatattaggtcttgcaaacagaataattttacttaagaaataccccagaaaattttatcattgatgtatttttttttaggagaacttaggatatcagttaaaatggttacaattttaaatgcattgtagtgattttgatgtagtaatgtttgttaaaattcttatttttaagtactttagcatcagaaaagttgtttatgcatacatgaaagcatatattaatccctttaaaggaaaagtttgtggtattttgtctagaaaagtgttttctttttttaaaataaatatttagtaaagtgtaataataaagattagctttgttcataaggttagattgtatttatgctgattatagcatatgaataggactttccattaagaaattggctaaggtgatgttcatattgtgacttaaggtgaatcagctgttagaattttggtttactttctgcatcttgattggtagtatggtagaatggaaaatgccttggacctcaaggcaggaaactttggttgtaattatattgtagctatatgattttaggcaaattggttaattctgtgagtctcagtttgctcacctgtaaggcagaaataatgcctgaatgtgaacctcataggctttttgttatacatacatatatatgtatatgaaatgtatgatatacatatctcaaagagctttgggatatattgctcttgatagaaccacttacttatttttgtgatatggtggttatattttaaataaatacagtcatgtgttgcttaacaatgggaacacatctgagaaatgcatcattaggtgatttcatcgttgtgtgaacatcatagcatgtacttacacaaacctggatggtatagcctatgacacacctatgctgtgtggtatatagcatgttgctcctagtctgcaaatgtgtacagcatgttactgtactgaacattgtaggcaattgtaacacaatggtaagtatttgtatatctatacatagaaaaggtacagtagatcatccatatccttactgattttctttctatgtgttttactaattattgagggagaaatatgaagcctccaactataattagaatggtccttttaaattctgttttttattaatgtattttttattttattttattttgagatggagtcttgctctgtcacccaggctggagtgcgtggcacgatctcggctcactgcaacctctgcctcccgggtccaagcgattctcctgtctcagcctcccgagtagctgggattataggcatgcgccaccacacccggctaatttttgtatttttagtagagacggggtttcaccgtgttagtcaggctggtctcgaactcctgacctcatgatctgccctcggcctcccaaagtgctggcattacaggcgtgagccactgtgcctggcctttattagtgtattttaaagctttatccttgggtacatacaagtttagaatttttatgccttttaggtaaattggtacctttatcattatgtaatgtgcttttttatccaaatttatatcttttgttctgcagtgtccacatatcgattccacttttcttgtgatcactctttacaatgtgtatcgtttaccttcattttgattttaacctatttcttttttatatttaaatggatttttgttgttttgtaatcagcattcattaaaaatttttagctgaatactttttacttttgttagggttccctgtgtctcttcctttcatgttgtgccacagatgagccattatttatatcttttctctcattggaggttcctttttttaggggaaattaaataatctgaaatataaggaaaggatatgttgatttcaagaaaggttgtttttgttccttatctggcttgttcttgttgtgagggtgggagcaatactctttgcagctttctgcattctaggaagaagtggaattttacactaccatttgctttctttacaggtttaccttggtattcagtgtctgtccataggactaattaaaactataccagactccttctattttaaacctatccgttcagtctcaagttatctttttgcattgcctctcacgtctgtcccttcatttcttttaccagcagtgcttggtttttactgtttgctttggttttaatttcctttttatttttttaatttcagaaggtggaagcttatgtcattgacttgagcattttttatgcatgttttagtgcctctttctgactagtctcttcttttctccatccaatccatcctgtgcctgatttttagaaaagactggtgtacagtttgccccttttgctttaaaatttatttttcattgttacaacccactctcagtagcctccattgtaacaccctcccatgctcccaccaccattatgaagaagtaaagtccaaactttctcagtatttgtagttcttcatggtctgtgctttaaccttccttccagtcttattttttatttccattgttggcccccaatgcctgtgttctcttcccttccatatgaatcttccatatgaatatcttccatatgaatatgatagtattcatattcatgcgatctcccctttttttggaatacccttcttttttcttttagcctaaattctgtttttaagatgcagttaaagcttctcctttatgcatatctcttataagatatattatttgcagacttttccccccattctgtgagttgccttttcactttcttgatgatgtcatttgcagcgtaggattttaattttgatgaagtccagttttctattttttttttggtggtggttttttttttggttgcttgggcttttgatgttgtatctaagaaggccttgactaacccaaggtcatgaagacttattctgtgctttcttctaaaagtcatatggtttttagttcttgtcagtcttgggtttttttttgttttttttttttgagttaatttttgtgtatgatgtgaggaagaggtctaactccagtcttttgaatgtggatatccagttgtctctgcaccacttatggaaaagactattctttcttcattgaattgttttggtgcccttgatgaaaatcagttgactataaaaaccagggtttatttctggagtctcagttctattccattgctctgtatgtttattctttttttttttttttttttttgagacggagtctcgctctgtcgcccaggctggagtgcggtggcacaatctcggcttcctgcaagctccgcctcccgggttcatgccattctcctgcctcagcctcccaaagagctgggactacaggtgcctgccaccacgcccggctaatttttctgtatttttagtagagacggggtttcactgtgttagccaggatggtctcgatctcctgacctcgtgatcgcccacctcggcctcccaaagtgctgggattacaggcgtgagccaccgcgcctggccgtatgtttattcttatgatagtaccatactgttttgtagtatgttttatagctttgtagtatgttttgaaatagggaagtgtgagttcgacaactttggttttctttttcaagattacttttgttactcttggtacttgaatttccatgtgaatttttaggatcaatttgtcaatttctgttttaaaaaaaggcagctgggattttgatagggattatgttggatctagatcaatttgcggaatattgcattcttaacaacatgaagtcttcagatgcatgcatatggaatgtcttttcgtttaagtctttctttcaccagtgttttcagttttcagagtataaatcttactaaatatttattcttggtgatattattataaatggaattgttttctttcctttttggcttattcattgtaggtggatagaaataaaatctattttttttggataagagcagctaaaatcagttgggcacggaggctcacgcctgtaatcttagcactttgggaggccgaggtgggtggatcacttgaggtcaggaatttgagaccagcctggccaacatggtgaaaccctgtctctactaaaaatacaaaaaattagctgggtgtggtggcatgcgcctgtagtcccagctactctggaggctgaggcaggagaatcgcttgaacccgggaggcggaggttgcagtgagccgaagtcgtgccactgcactccagcctgggcaaaaaaaaaaagaaaaagcagctaaaatctatgtatttaacaaaaatctctaatacagtaccattttatttattatagtcctcatgttgtatattagatctctggacttgttcatcctatgtatttgctacttcgtatcctttgaactacatcttttcaaaggatgaaattgggtaatgtgatgcctctagctttggtctttttgtgtagggttgccttgactattcgggctctttttcagttccatatgaattttaaaatagattttttttttctttttcctaactctgtgaataatgtcattggtagtctgatagaaacagcattgaacctgtaaattgctttgggcagtgtggccattttaatgatattgattcttcttatccatgagcatggaatgtttttccatttgttcgtgtcatctctgatttatttgagctgtgttttgtaattcttgtagagagctttcacctccctagttagctgtattcctagatattttattctttattgtggctattgtgagtgggttgcattcttgatttggctctcagcttgggtattggtacacaggaatgctagtgatttttgtacattgattttatatcctgaaactttgcttatcagctgaaggaacttttgatcagagactatgggattttctaggtgtaaaatcatcatctgcaaacaggaatagtttgacttccttttttcttattccgatgctctttatttccttctcttgtctgattgctgtggctaggacttccaataccatgttgaataggagtggtgagagagagcatccttattttgttctgcctttcaaggggaatgctttcaacttttgcctcttaagtatgatgttggctgtggatttgtcatagatggctcttattattttgaagtatgttccttcaatgcctagtttgttgagctatataccacactttctttatccactaatcggctgatgggcacttcagttgattccatacttttgcagttgtgaattgtgctgcaataaacaagtgcaggtttctttttgatattatgacttcttttattttgggtagatacccagtagtgggattgctggatcgaatggttgatctgcttctagttctttgagaaatcctcacactgttttccatagaggttgtgctaatttacatttccaccaacagtgtataagcattcccttttcactgcatcctcgccaacatctattgtttttttactttattttccatataaaaaggggtttatttagatgttagaatcatctagtgattcagaaagattggacatgaatccacccaggcccagggctgagctgcagagcagccgctgacatccgcggggatttcacatgcaacagggagctctcacgtgcttgctggccattgtgctttaaatcgttttttccagcggacagctgtgactgcagttttcaaatgtgctctggcctccaaggaccaggggggcggtggggggcgggggtgtcctctgtataaaaagtgctgtcctgcgagcttcccgacggacactttggggcatctgagcgattcccggggagggcagctctgccttcctcaggctaccactgcagccaccgacggacattctcaccagcaatcaaccaaaaaacatcagagtctctgtgaacttggctgcgatgataagaaccaaatgttttctaatctaagacttgtatgcagaacacaggaaattgcaattaggaacaccctacaaaattgaacaacagtattttctaaaaatattttttacatcactttaaataatttacagaaagctacagaaatcatatttaccaggacacatctgttaaataaaagcattgtttcatgttggtgtacgtctatacagggctatgtataaccgactcctgtttctcctccctgcaaccacagaaccatcacacacacacacacacacacacacacacacacacacacacacacacacacacacacacacacacggatacacgcacagatacgctcctttccacaaatgcacgcaaaccgggacgcaaacccacaactcgagggcttagaccttcactgctgagctgccgccactgtcctccgtgcgcggagtgtcgctgaagtcactggcgtcactaaccaaggcgtgcccgcccaaggtgccctggtcctggtcgtccctatcgatgacccttcgtcaatacctcaggtctaaaatgctttcctccgagcccgagttcctcctgtcgggcaaactccgccctgtctgtgccttgctgcttggccagggcccgccgtccttcttcgccagcaagtgtgggcttccaaagacagggctgggcccggcctgggcctccctgaaggcagagaaggacgggccctgtggaggcagccccatgtcgggctgaagaggctggcctgcctgcccccctgggagacaccctttccaaaatggaagagctgggtggacagcgcggggagaagcccacaaggggtaggctgggcaggccccaggcggggccctcggaccccttgtctttcccgctcccgacgccccgcctccactccgcatctctactttccgagcgcagcgcgcacgggttccggtgggtgaagtcgctcgagggcagggtgtggtcagcctgggctccagagtccctttcagcttcctggctaggggtcaggaagccccggctcccgcagcccatgtgaaagctccccccagcacctccggcctcggtgcccgctgtggcactgctgggcagctgaataaaagcacttctggcagcatgctcggcccctcgtgagcgctggtctttctgaatgtaaacatttctcctgctcgctgagagccccttggcggagacactgccactggtgctcctgggcggtgccggatccccttgggcgggagcagcggggagccccttcctgccctggctgaacaggtcggctgtgccctgtgctccagcgctctctgcacctcatggcccttctgccggctgtgggacccccctggcccactgactccgcgtgcacacgccaggcggtggggcccgctccttcctgcacagcaactctggcctgaatgagccccatttcccgagagcagcagggccctctgcctgaacttctgaactgctcagactccttggccttttccgccaaaaacttactaatctacagttcgatgctctcgtcactgtccactgaactcctgtcgtcagacagggagccggggctgggagctgggccctggcattccctggggaaatggattcccttcagaggcggaggcagaggcgcatcccctcactcggaaggccggggccgtgtcctggctcctgacgccctcctgcttcgtcttctctgccatactgccacagacactgggaggtttgttccctggaccctcgccgctgtctctcttggacttggagagtcagctattaagcaccggcgggcttctgtctttccagtctctcgggagcccgcccagctgctccaggaagtgcatctgggcagtgctgaacctgaccttcctgcacgcagccctgggttccctgcacctcttcttgagctttcgcttggaccttaagtccttgatggccgtgtccaggtcctcgtcactgtccagggagctgctcttgtcttcggagctctccttctcgtccaggtgcctcacctcgtctgtcttaccctggccctgcgtcatgcgagtgtcgccgggccccttggctgcgccctcccctcccgggacctcgctggctttgccctggacgggcaggtcccgcccctcatggccgggcacggctcacgcctggctgtggtcggcatcctggccaccatctttcaccacctcccgcgttttcttgggcgtggacggcctcatggcatggccgccgcctctacgtttccttttgcagctcagcagcgggtccggtgttttagagaggggggccttggggccactggtctggctgttggggccaggcggtgaaagtgggccctgggcagcctgcgagcagctctcacctctggccagcaaactccccgactatgccttgagggtcaaaacgtctggatttcctgatcgatgctgtcgtcgctgtccacggagctactgtcgccgtcagagcgggaaggcacgttcagggagtagaagcgtgggcttgcagaaagggacctgttgctgccttacatgggggccggcagggtagtcttggaaatgcccaagattgcttccgcgcgcgtcagttcagcggacgtgtctgcctggcacgaggaccgttctacaaactcgttcctggaagccgggctcgctggaggcggagctttggtttccttcgggagcttgtggggaatggtcagcgtctaggcaccccgggcaagggtctgtggccttggtggccactggcttcctctagctgggtgttttcctgtgggtctcgcgcaaggcacttttttgtggcgctgcttgtgctgtgtgcggggtcaggcgtcctctctcctcccggcgctgggccctctggggcaggtccccgttggcctccttgcgtgtttgccgcagctagtacacctggatggcctcctcagtgccgtcgttgctgctggagtctgacgcctcgggcgcctgcgccgcacttgtgacttgctttccccttctcagggcgccagcgctcctcttgaccccgcttttattctgtggtgcttctgaagggctgcagggggctgctggcttcgggctgcccttgttctcctgcttggtcgtgaccctggacttgaggcttctgggctgcacgttcgtctttgctaaccggggaggtttgcgaaaggcgaactctttatgggcgcccttcagaccctgccgatgcgccacctttgcggctagctcttcgtgggatttcaagagtgacttggtcgaattttcgtttgggtctggttttttatctattgaccccatcacatttttgggtcgcatgctatctcttctcattcagaagctgttctatttccgccttaatgctctgctcgaaggagtcgttgctgctcgctctgaccgggaaggcagaaccctagtcctcactggatctcacctggctgccagggccaccacctgagccaggtacaagttttggggggacacacggaagtcggggcactgccgtgagatagttctggcttacatctactgccactgcctgcagccctggaaggctgggctgcgcctggctggcccctgccagccccgggctgtgcggctccactctttgcctttaggtactcccggatggcttccgcaatgtcccggtccacggaatcatcattgaatctagcaccaacgggccaaagtctgcagtttcctcctccctcatggggtcaaagtcagcaacaagaccacaggcaggcaatgcgggctgctccttgtgcacggtgggcttggcagctggcttggcgtctgccctgtggcccctctgtgcagcgcgctcatcggtggtgccccgagcaaccccgctgcgctgcagcgtgctgatgagcatctgcacccgggcgctcaccgacacgctctccaccccctcgtcagcctccgagaagcacccggggaacctaaagctccctggtgggccaaaggcctcccatttggactggggagcaacccctggagtagcgttcctgagaaacattctagcagaaggggagggacgcgcagagggacgacgctttatttctctgccagcttcatatactcaaaaggttggcagcggggtgcagtggctcaagcccgtaatcacagcactttgagaggccgaggcgggcggatcgcgaggtcaggagtttgagacccgcctggccaacatactgaaaccccgtctctactaataatacaaaaattagccgggcgtggtggtgtgagcctgtagtcccagctactcgtgaggcagaggccagggaatcgcttgaagccggaaggtggaggttgcagtgagctgagatcgccccactgctctccagcctgggtgacagagcgagactccgtctcaaaaaagaaaaaaaaaaaaaagagtggcaagtggtgcccatgagataaagtctgcaaatgcttctttgcagtttaaaaaggacgacgactataaacccaggatcaggacgacgttacgcatagatttattcttgacctgaccaacgagctcttgaaattctctttgcaactaggtcgactgtgaaactgcagccagtgtccccaaacgccccaaggataaggcctttatcactccgacgcatcctctctctgctttttaaatagacttttgactcggccaggccccctgccacccaccgcgctgaccctgcctgcgcttgcgtcccgcgtcccgcatccggggggaggcggcgggcccgggtctctggggctggcccatttacttagttttgtttttgttgcatttgcttttggtgacactccctttttgatattccacatataaatgaggcaataattttctttctatgtctgcttatttcacttagcataatggtctccctgtccacctcggctcccgcgcggggaggaggggcaagggccctccgcccgggccccgcctccccgcgcgccgctgccaccgccccgcacctttttttgactttttaataatgctcattctgactgtgataaggtggtatctcattatggttttaattggtatttcccttgtgattggtgatgttgagtatttttcatgtttcttggccatttgtgtatcttcttttgaaaaatgtccgtttggctgggcgcggtggctcacgtctgtaatcctagcactttcggaagccaaggcgggtggatcacctgaggtcaggagttcgagaccagcctggctaacatggtgaaactccgtgtctactaaaaatacaaaaattagctgggcgtggtggcatgcgcctgtaatcccagctactctcgagactgaggcaggagaatgacatgaacccaggaggcggaggttgcagtgagccaaggttgcgccattgcactccagcctggacgacaggagtgaaactgcattgcaaaaacagcaacaaaaaaaatccattcatctagtttgtccactttttaacaggattatttgttttcttcttgctgattttcttgagtttcttgtagattctggatcctttgttggatgtatagtttgtaaatattttctcccattctgagggttgtctcttttctctgttgattatttattttgctatgcagaaactttttagtttaagtcccatttacttagttttgtttttgttgcatttgtttttggtgacaccccctattttttagattccacatataaatgagatcatgcaataattttctttctgtgtctgcttatttcacttagcataatggcctccatgtccacctgtgttgtggcaagtgacaggatcacctttctttttatggctgaataatattccattgtttatatatactacattttgtttatccacttctctgttgacagacacataggttgtttccatattacttagctgtatatagaaatacaggtggtttttgtatgttgattttgtactctgaaaacttggtgaactaatttattagcttcaatagtttcttagtgaattccttaggattttctagatgtaaaataatgtcatttgcaaatagagatagttttacttcttcctttaaaatctggataccttttatttctttttcttgcctaattgctttgtctaaaatctccaatagaatgttgaatagaatgatgagaaggacattgttgtctcttcctggatcttagtgggagaccatccagtttttcaccattaagtagatgttagctgtggggtttttgtagatgcctttcatcagttgaagaattttttatttctagggtgttgagtgttttgttatgaaagggtgttggattttgtcaaatgatttttctgcttctattgatataataatgtagttcttgttctttattgaaatggtgtagtatattagttgattttcaggtgttaaaccaacattgcatctctggaataagtcccacttggtcacaatgtataatccttttgatatgttgctagatttggtttgctaatttttttttttgaggatttctatacgtgtatttataagagattttggtctttagtttttttccttgtgctgtctttgtctgattttagtatcaagataatactggcctttcacagaatggactgggaagtgttccctcctcttctgttttgatggggcagtttgtgaagaatagatattaattcttctttaaatatttggtagaattcatcagtgatgccatctgggcctggacttttctctgtggaaagtttcaaaattactaattcagtcattttacttgttataggtttattcagtttgtcagtttctttctgaatcagtttttatactttatatttttctaggaatttgtctacctcatctaagttacctagttcattggcaaataattgttcatggcattgccattataatcctttttatttctgtaaggttagtagtaatttttttttatttcattcccgattttggttaatttgagccttctctcttttatcttggtcagtctaactagaagtttctcaatgttggtgatttaaagtttttttttctggtttcattgatttttctttatttctctattctctaaaaaattttgatcaaacgatttttccctgttttttcactacccaatgtttatacttaatgtgtgtattggataactctattaaagttcatcatcatgtactttcatcatgtaatagtcagatatatcttatatataattgtactgcctacttttagaattgcttgttctttaaggctttgacttcataaaagttttcactcttggccaatattatttactacagcgtgttttcttcttcatgaggaaccatggaagaaatctttggtccaagacccattaagctttcctggagaagctaactaattaatttaatttaaccttatagatactatgaatcttataattgtttgttactgttttaactgccagctttcatgatagcatgcattttgggggatactaacatttttcttgtcatttttttcacctttctatattttactttcacaattataagtaaataaagacttgttttaacataaatcacactttatagtaataaagagcggatctctgttgctctccttttttactttaaaattttttatttttaattattatggagacataataggtgtacatatttatgggatacatgtgatgttttgatacaagcatataatgtgtaatgaccaaatcatggtagttggagtatccatcatcttaagcttttatcatttatttgtgttaggagcattccaattctaatcttttagttattttgaaatatacaataaattattgttaactatagtcactgtattgtgactatatagtgtttccatagaacactagatcttgttccttctatctaactgtctttttgtacccattaaccaactcctcttttatcctcccatccccactacccttcacagcttctggtaatcatcattctactctgtctccatgagttcaatatttttttttttttttaagctcttgcttgtaagtgagaacatgtacttgtccttctgtgcctggcttatttcacttaacatgatgttctctggttccaaatgacaggatttcattctgttttatggctgaataacattccattgtttatatgtaccacattttctttatccatgcatccattaatgggcattcaggttaattccatgtcttggctgttgggaaaaatgcagcattcaacatgggaatgcagatatctctttgatatactgtttttatttcttttggatatatacccagtggtgggattgctgtatcatatggtagttttatttttatttttttgaggaacctctaaactattcttttatagtggctctactaatttacattgccacaagcagttgtgcttttgttttttttttgtttgtttgtttttgtttttgtttttttttactgttttaacataattatttggagcttcattcatgatggcatatgcatcaacaatttatttattctcattactgagtagtatctcactgcatgggatttgtttttttttttaagttcaggggtacatgtgcagttttgttacataggtaaacttatgtcatgggggtttgttgtacagattatttcattgcccaggaatgaagtccaatacctactagttgtttgtcctaatccgcttcctctcccaccctccaccctctgataggtcccagtgtgtcttgttcccctgtgtgtgtccatgtgttctcattatctagctcctacttataagtgagaacatgcagcatttggttttctgttcctgcgttagtttgctaaggataatggcctccagctctatccatgtccctgaaaaacattgctctttttctattcctagttatatccatagaaatgaccattgatagtttttgcttactctgtccctccagtttttccttcctccagcatatacacaaggattttaattttacccaattgaagtcttacttatctacaccttttaacaagtcatcatcagtaattttggaataggcattagattcacatggttcaagattcaaacgaaagaaaagtataaacagtaaaaagtctcctcattcctttccctaagccacccacttctcttcagaggcaactaataaaagtttctagttttgcattattctacaccttgcttttttcatttagcaatatatcttgaagagcacatctccctctgtatttagcttaatccttttagtggattttttttttattttttgggtatatcataatttatttatgaatttcattgttgagagacatttagtttgtttttgaatgtgtaatactacaaaccgttgcggtgaattatccttatatatacattttcatgcacaaatgagagtacttttatagtgtagattcctagaagtagaactgctaggtcagaaggtattcacatttaaaaattttaaatttgctcatagaatgaagtctttgctcatagaatagtctttgctcaaatctcactttaccaaagaggcctatcgtgaccactctgcttaatactgtaacctgcccctacttctccctgaacttctctatccattgcactctattccttttctagcatagtatatggtttacctatttatactgctttttggttactgtctttttccctctgctccaagaaacaggaatgtttgttttgttcactaatatatatttctagcagttagaatagtgtttgatgcttagtaggcatttagtaaatatttattgaataaatcgaatacataagcaaacagtatccaaaattatcctccgtaaaaatgcctaatttcttttttttcctctgtatctcaatgaataaaaaaaaatactgtctttctttacccacttattttggatttttttggtcttgttttttgtttgtttgtttgtttttgagtttgacaaatttattggtattttattaaagacattcatctcagttgtttctctctcccagcttgaccttaggttaatatttcatttgggtcaagaaaagaatatcagaagaggtatgttattttaacaaacaggaaaatggacaaaaatggatagtttgcctacattaaagtgagttaaattcaagtatcttgatataattaaatcatataagaactaagagttctatatacatttccattgttttacctggggcttattctaaacttaaatactagttaacaaagagttaggaatatacacaggttgcttctctgagttattaccgactaaaagagctcagcgagcagttaccaccaataaaacggtctgaagctgcctccaaatacaatattgtagtaggagttttcaaggaaatttttatactgtatttttttttgtctgtgactgtgcttttaaagatgtgtttaactgtcacattaaaaaaaaagttcgtatacaatacaaaaatacaaaaagaaaacaccctacaatacacaaattcacaaagtatgtgtggtgagattccaaaaaatgtttgaagatgcattttctttccttctatttcagtatctaaaatgtgctttttgagaggccattggtcaatatgtatacatttaaaataaaccatataattttactagtaagaaagccagtagttaagttcaattcaaattggatttcacaagttagtaatttaaatccttggacaaagttacagaaagtgcatcttcttgttttccatcttcatacaatgttaaattttttttttttggtgtttataccttttaaaaaataaaagcagccaaatacttaagcaatatgtacatttaaatttttggtggtggtttgtattttaaaagaaacagttttcttatgattcgcttcaagttctggtggaaatgcttacaggaactagctaataaacaaaaaacaagagaagcacattcaaaatactgatttactttggtagcaaatggtttttctttgaagattaatgaagatagacaagacccattaaggtgaagtgggctatttcaaatattcaacagtttacatataaaaaagttattttaagagctaagcgtctgtatccactgatagcaatgcaacacctagtttatgatgacttgaaagaaaacaaatgcccatgaagaaaaaagctgtattttaattttatctaaatgtactttcagtcaatagttcagtaacattttcctcccaatacaatactccctctctctataaggctattcctgggagccagacaagtttaggtaataagggagttaagagagtaactgcttgcagttttaaatagacaattaactttttgcttccctcttaatgtgctaatagttgtgtctaaaaaaataggcaattcttaaaaaggtaccatttctgatttctttattatctgtaaactttggaaactaatcacacaaaactaccaaattagcaaatgtcttgaaatctgtatacaaaacataaattacctctaatttcaaactctcatttattggtgtaccactcaatcttttaaaaagatgaaaaagaaaaaaaaagtggctccaaaggtagtcttataccattcttaaaaaaaggaaactgttctttttaactttatacccacccacaccccaatttcaaaacatcatttaattgtcttggtcatagacatttcgaagatgagattttatattccactcccatagcttctggttatcagaaaacccatgctttcctttattgaaggagtttggtccagctgatgttggtgtatcccttgcaatattcttcatcctcatctttgcttctggaggcctttcctctgattcactatcttcatcttcattaaaagctgctgctactgaaagagtttttggagcaagagttggaacagtttctttaggcttacttgatccaagtttgatggatatgggtgatgctttctttgtcgtctgactacctatggcaaatccaaagttggagatctttgcaggctttgttggaggtctgcagcttcttcttcagctgatcgcttctcagcgctgcggctggaactttcctctccattactccagcagctccagctcattgcgacttttccggcttctcctctcccgccttcccatcagccatttcccccgccgcattgtttttttaagatttcagaaatctttctaatacaagttgggatataaataattagatatagaaaatagctacaaggtatttcttttaactttctccacccccagctcccagcagtcaagagtcaagccctaagtcttgtcctttctgtcagaaatagatacaagaaggatacagcaaacactgctataacacctctctcataggattcaaatcagtgtggagattattataggctccagatgagttaggatatctttaagtctcaatttaataaaactaattgttttcctgtgctttaaatatctctccattctatataaatataatatagatctaacagatgtagtcttgaaatagatggctataatgtcagtgaagtatttttttccttatttatatacattataactttccttatttatgtacattataattttaaaggcctgatagtcataattattgatgttcagattggtagttatttctgtctcttatgtattcaactataaacatttaatcaagtttatgagacctagatatttagcagagttttggagtaaattattttattaaacaaagaatataaaataaacatttctacttatgttcctgttttaatttacctcatttatatgcatcttgatattgcattttcatattctaaaaactatttttaaagacaggttgattcagaattacagtgtacttgaaaatcatcaggtacctattattagttttcacccacattgaatctgtgtttcagaaactgtctaccaaactttgtttattaagtaattattttccctagttttattcaagatatacaaagctgccaactagtgcttttcatcagcatcaggtaaattgtgttactatactgcgttgaattttagcaaaggtaaagtatttgctattttagttattgtagctttattgaaagcaaacatataggttttttaaagtattggaaaactcgccagattatcattatatgacttggaaccctagaaactcccagaccacgagacttaatggttaatgatctctttcagttctctttcaacttggaattctcttattccaatgccaactcattgctcttttggaaagacccattctttcctctattgtcttggtacctcctcaggacatattccccaaagtggaaatgtcagtttaagataattttcagcattgtgtagaataagaatggttagacagctgatgtcagcaagatggtggaatagtagcgctgtccttcagaaacaccaattttgacaactaccatagaaagaatgcctttatatttgagcatacatggaacattctccaggatcaatcatatgtcaggccataaaacaagtattaatatatttaagaagattgagataatatcaagcatcttttctcaccataatggcataaaactagcaagcaaaaataacaggaaaactgggaaatactcaaatatgtgaaaattaaacatgttcctgaacaaccaatagtcaaataagaaatcaaaatggaaattaaaaaaaaaaaatgtgatacaaatgaacatggaaacagcacatcaagatttgtggaatgcagcaaaacagttccaataggagatttcatagtgataaacaccaacatgaaggaaacagtaggaccccagataagtaacctaactttacatctctcagaactaggtagaaaaagaacaaataagcccaaagtaatagaaggagggggataagaaagatcacagcagaaataaatgaaagactcaaaaaacaatagaaaagagcaacaaaatgaagagtttttttgaaaagataaacaaaattgataaacttttagctagaataagaaaaaaagaagattcaaataaataaaatcaggaatgaaagaggagacattatgactgatatcacagaaatacaaagaatcctgagaatactttgaacaaattatatactaacaaattggatgacctgaaagagacagattgtttgccacatactacctgctaagactgaatagcagaagaaatagaaaatctgaatgaccaataacaaataagggactgaatcagtaatcaaaaatctaccaatagagaaaagcctcaggacctgatggcttcactggtgaattctaccagacatttgaagaataccaatccttctcaaacgttttcaaaaatttgaataggaggaaacacttccaaactcatttaacaaggctagcattaccttgataccaaagtcaggcaagggtatcacaagaaaagaagattataggtcaatatccctgatgaacatatgtgcaaaaattgtcaacaaaatattagcaacagcacattaaagggatcatacatcatgatgaaattggatttatctctgggattcaaggatggttcaacatatgcaaatctataaatataccacttcaacagaatgaaggacaaattatgtgatcatcttaatagatccagaaaaagtgtttgacaaaacttaacattctttcatgatgaaaactctcaacaagttaggtataaaaggaatgtacctcaacacaacaaaggttatacgtgataagcccacagctagcattatactcagtggggaaacctaaaatcttttcctttaagatcaggatcaagacaaggatcatttgtcacttgcattcaacatagtactggaaatctagccagagatattaggcaagaaaaagaaataaaagacatttgctacagtttgaatgttttccccctctaaaactcatgttgaaacttaattcccaatatggtagtattaaagatggggcctttaagaggtgattgagtcctgaggcctctgcctttatgaatggatcaatctattcatggattaattggttttcctgagagtggcatcagtggctttatcccaagctaacatcttagcatgctcagttctctcaccatgcgataccctgcaccacctcaggactctgaggactcacagctattattcaaaaagtcagaagataacagatgttagagaggatgtggagaaaagggaactattgttcaatgttagtgggaatgtaaattggtatgtcttttatggaaaacagtatggaagctcctcaaaaaattaaaactaaaactaccacatgattcagcaatcctaccttttggtagatatccacaggaaatgaagtcagtatgttgaagagatacatacactcccatgttcattgcagcattattcacagtcgcaaagatatggaaacaacctaagtgtctgtcattagatgtatagataaaatgtggtacagattgttttaaactaatgattggttatatcctgataaacccattgtaagtcaaaaatatcttaagttaaaattgcattaagatcatgacaaacccagttgaaaaatcgcaaattgaaccattgtaagtcaaggactatctgttatatatattggaattttattcagccttaaaaaaggtaggaaatcctgccatttgcaagaacacggatgaacccgaaggacattatgttgtattagtcagacacagaaagacaaatactgcatgatctcatttatatgtaaaatctttaaaaagtcaaatacatacaaacagtaaaaaggtggttagcaggggtggggagcctggggagaatgtggagatgtttgtcaaagggtacaaactttcagttataaaatgaataagggttagatgtggcagctcacgcctataatcccagcacgtttggagaccaagataggaggattgctttaggccagagttagagaccaacttgggcaacatggggagacccccatctctacgaaaaattaaaaaaaattttacaggcggtgacatgtacttgtagtcccagctacttgggactctgaggtaggaggagtgcttgtgcacccaggaggttgaggctgcagtgagctattattgtgccacagcaatccagtctgggtgacagagtgagaccctgtcatgagacctgtctcaaaaacaaaaacaaaaaaagtagtagttctggacacttaatttacagcatggttgattatagttaataataatgttttgtattcttgaaattcactaagagaaatcttaagtatccttacgacatacacacagacaaaatggtgactatgtgaagtgatagatatgttaattagcttaattgtagtgcagtagtgcccccttatcctcagaggatatgttccaagaccctcagtagatgcttgaatccacagatagtacttaaccctatatatactatgttttttcctatcctgtacatatatacctgcattaaagtttaatttgtaaattagccacagtaagagattagtaacaatgactaagaaaatagaacaattatgacaagatgctgtaataaaaagtatgtgaatgtagtctgtttctctcaaaataggtactccgctcacctgttttcaaaccatggttgaccatgggaaactgaaactgtggaaagtgaaaccgtggatatggaatgactgatgtaatcacttcttattgtatagatgtatcaaaatatcacattgaacaccttaaatataaactttttcgtttgtcaattgtacctccataaagctggaaaaaaatgtgacctcatttgtttgttggtgatttccttttttgaaacagcacatgtcatatttggtaaaaggagttgatattgttaatccatataattggatctgagttgtaggaattaatctccttactcaatggttttcaaccttgtttccaagagtagtagatatcagttttgtagctatttttcagaaaagctaattagtagccctttgagtatggtggcagttttctttcctatatggttatacctttttggatggatcatttttgggctttgagctcaataatctaagcagagagcttgaccagaaacttagttctaggtaggttatgtatcatctgttcagaaaatgaggtctgtaatgtcgttctttgtgtgtgtgtatgtgtgtgtgttacccttattgatacttaccagtttgctattaatgtgtgaatgggagctgaagaaactatagtggaaccaacagtcttaacttacactttggtggttcagttgctgcttgtttctctgagcatatggagaaaaaaaagaaaaaaaaacaaagagagaaaaagccactctgtagctactgccacaactttttttttttttcctttttagaactacgctagtgttagtgctggacactacaaggctcttggggtaaagtagtgaattagatacaatatttctgccttcaggatgcttacatattcatagttgagatagggacaaatgagcaagcaagcaagtcacagttcagttaagagctgacaggtttatgaactgagttccataggagtttttcaaatttattttaatttttctgatcatatgctgcatgatctgtaagagttcttaagggagggagtcccaggtgctcaacttttgggcagatggccaggtaaatctgaatttgccaggtacatgtttttctggaaatagaatcaactttcttacccacaaaggcattgtgtaactgggtgactgattcacatggtgttcacccctgcatgttgtttcaaaaatgtgattgagtacaagtaaggtcagtttttacattcctcttcttggctttgccactcttgccttttacttctgtgcacatccaagaatgtccttaacactagactgctgtaagctcatattatacaggtgaaattttctagcgtcttagcctgttattccttctgttcctacgtatcacctaggtaaggaggaaatctaggagcaaaagataaaggcagttcttccccctatttctctgtaataccttcatatttcatttaatgtaaccctactgctaattacttattacagtctcatgaactatgcgtaaggatatatcttttgaccctgaggtagagcacaaaagcacatgtttcttatgacttattttcatctttcatatttcacaaagtgcaagctagatagaacattatttttaacttttgaaattgcaacttaaatttatgtcagttgtgacagcatacatagtagtacttttctgatagttccaggatgatttatgtcaccacttggtggagctcttttataagtaagtgcattgtttaaaaaagcgagtataagttgtcactaattaggggttatcattagattggttcaaatgaactcaactaaatgatggtataattggtaatctcttcaagtactgagtgtagattttgttttaaactgtaatgtatgtgattaaaattttgataaagatttttctcgagtatttctaatttttctctctcctgctttatgtaaatgtagcacttattgacttttctcctattttacaattgtagataatttaaaaaatgtatgcaggattaataaggaaaatgaaaactgttcgtaatcctaccatgtagagataatcgtgaacattttaatatatattttcattttctcttcttttttgttttttcacaaaattggaatcaaaatatgtgcagaactttttattctgtttttttcttaacgttatatgttgggtatttttacatatccctttaatattccttgaaactgttttgggtttttatattattctatgatatagctctatcacaatatgtttaaccattctgttttaagatttttaggctcttcctactatttttgctattataaataacttttcaaacatctattacactaaatctttttttaatttttaagttttgtgggtacatatcaagtgtacacatttatgggacatatgaaatgccctgatgcaagcatgcagttctgttactctaaatcttgactcaactctatttttacttgttaaattcttagctataaaactgaggtattttaaggatttttatgtaccttaacaaaatgtccttcaattgacattattctcaaatatgtttgttgaaaatatgtttgttgaaagtacctttttttttttgcaaagtgcttgttctttgcccattttccccccattttttgttctttttttggtgtgtgtgggggaattgttttggctaggtaagaattacttttcttctgtttcaacaatttttaaagtgctatcctgagtccttttcataattttcaagaaaacacatcagttacagattttaggttgcaaattgttgttggaaaaggagacctggaccttaaaagaggaatcaggctggaaagcagaatgagatatgagaatcatctgtatatgagatgatgagggctgtaggagtggatgagagtgctgaggaaaaaagagaatggtgggaaaaaagcccatggagttgagaaaccccatgaaaaagttgtgagaggaaaagagaagagaatgaggatgtgagggcatttaaaaaagctactgaaaaaagttgcatggaggtatactgaaggagaaaaattgcaacagtgtcagatgctgcatagaggtctttctggattttgcatccatgttcatcagggacatcagtctaaaattctctttttttgttgtgtctctgccaggctttggtatcaggatgattttggcctcataaaatgaattagggaggattccctctttttctattgattggaatagtttcagaaggaatggtaccagctcctctttgtacctctggtagaattcggctgtgaattcatctgctcctggacttcttttggttggtaggatattaattactccctcaatttcagaacgtgttattggtctattcagggattcaacttcttcctgatttagtcttgggagggtgtatgtgtccaggaatttatccatttcttctagattttctagtttatttgcgtagaggtgtttatagtattctctgatggtagtttgtatttctgtgggatctgtggtgatatcccctttatcattttttattgcatctatttgattcttctctcttttcttctttattagtcttgctagtggtctatcaattttgttgatcttttcaaaaagccagctcctggattcattaattttttgaagggttttttgtgtctctatttccttcagttctgctctgatcttagttatttcttgccttctgctagcttttgaatgtgtttgctcttctctagttcttttaattgtgatgttagggtgtcaattttggatgtttcctgctttctcttgtgggcatttagtgctataaatttccctctacacactgctttacatgtgtcccagagattctggtatgttgtgtctttgttctgattggtttcaaagaacatctttatttctgccttcatttcgttatgtacccagtagtcattcaggagcaggttgttcagtttccatgtagttatgcggttttgagtgagtttcttaatcctgagttctagtttgattgcactgtgatctgagagacagtttgttataatttcttttcttttacatttgctgaggagagctttacttccaactatgtggtcaattttggaataagtgtgatatgctgagaagaatgtatattctgttgattttggatggagagttctgtagatgtctattaggtccgcttggtgcagagctgagttcaattcctggatatccttgttaacgttctgactcattgaactgtctaatgttgacagtggggtgttaaagtctcccattattattgtgtgagagtctaagtctctttgtaggtctctaaggacttgctttatgaatttgggtgctcctgtattgggtgcatatatatttaggatagttagttcttcttgttgaattgatccctttaccattatgtaatggccttctttgtctcttttgatctttgttggtttaacgtctgttttatcagagactaggattgcaacccctgcctttttttgttttccatttgcttggtagatcttcctccattcctttattttgagcctatgtgtgtctctgcacgtgagatggatctcctgaatacagcacactgatgggtcttgactctttatccaatttgccagtctgtgtcttttaattggagcatttagcccatttacatttaaggttaatattgttatgtgtgaatttgatcctgtcattatgatgttagctggtgattttgctcgttagttgatgcagtttcttcctagcctcgatggtctttacaatttggcatgtttttgcagtggctggtaccagctgttcctttccatgtttagtgcttccttcaggagctcttgtaaggcaggcctggtggtgacaaaatgtctcagcatttgtttgcctgtgaaggattttatttctccttcacttatgaagcctagtttggctggatatgaaattctgggttgaaaattcttttctttaagaatgttgaatattggcccccactctcttctggcttgtagagtttctgctgagagatccactgttagtctgatgggcttcgctttgtgggtaaccctacctttctctctggctgccttaacattttttccttcatttcaactttggtgaatctgacaattatgtgtcctggagttgctcttctcgaggagtatctttgtggcattctctgtatttcctgaatttgaatgttggcctgccttgctaggttggggaagttctcctgtataatatcctgcagagtgttttccaacttggttccattctccctgtcactttcaggtacaccaatcagatgtagatttggtcttttcacagagtccggtatttcttgtaggctttatttgtttctttttactcttttttctctaaacttctcttcttgcttcatttcattcatttgatcttccatcactgataccctttcttccagttgatcgaatcagctgctgaagcttgtgcattcatcacgtagttctcgtgccatggttttcagctccatcaggttatttaaggatttctctacactggttattctagttggccagttgtctaatcttttttcaaggtttttagcttctttatgttgggttagaacttccttctttagctcggagaagtttgatcatctgaagccttcttctttcaaatcgtcaaagtcattctccatccagctttgttccgttgctagcgaggagctgcgttcctttggagggggagaggcactctgatttttagaattttcagcttttctgctgttttttccccatctttgtggttttatctacctttggtctttgatgatggtgacgtacagatgggggtatggtgtggatgtcgtttctgtttgttagttttccttctaacaggaccctcagctgcaggtctgttggagtttgctggaggttgactccagaccctgtttgcctgggtatcagcagtggaggctgcagaacagtgaatattgctgaacagcagatgttgctacctgatcgttcctctggaagcttcgtctcagaggggtactcagctgcgtgtggtgttagtctgcccctagtggggtgtgcctcccagttaggctactcaggggtcagggacccacttgaggaggcagtctgtccattctcagatctcaaacttcatgctgggagaaccactacgctcttcaaagctgtcagacagggacatttaagtctgcagaggtttctgctgccttttgttcggctatgccctgcccccagaggtggaatctacagaggcaggcaggcctccttgacctgcggtgggctccacccagttcaagcttcctggccgctttgtttacctactcaagcttcagcaatggcgggcgcccctctcctagcctcgctactgccttgcagtttgatctcagactgctgtgctagcaatgagcgaggctccgtgggtgtgggaccctccgagccaggcacaggatataatctcctggtgtgctgtttgctgagaccattggaaaagcgcagtattagggtgggagtgacccgattttccaggtgccatctgtcacagcttcccttggctaggaaagggaattccgtgaccccctgtgcttcccaggtgaggtgatgcctcgccctgctttggctcacacttggttggctgcactcactttcctgcacccactgtctgacaagccccagtgagatgaacctggtacctcagttggaaatgcaaaaatcacctgtcttctgcatcgctcacactgggagctgtagactggagcttttcctattcggccatcttctagtctttaatttttcatctgtatgatgagaagtgaatccaatgacttttttagattgaaaaattttgaatcaaactcaactaaaatgaacaaaatatatgaaactacaataatgaagacgttatgatattggtgaaaaaagacaagtaaatcaatggaacagaacagataatccagaagtagacccacatatatatattattataagttcattttctacagaggtgcgaaggtaatggaggaaggatattcttctcaacaaataatgctggagcaattgggtatccaaatgcagaaaatgaacttcaatccttacctcacaccatttataaaaactaaccagaaatgaagcatagacctaaacttctagaagatgacataggagaaagtcttaatgagcttgggttaggcaaagatttcatagatacctaccactgaaaacataacccataaaagaaaaaaaatgaataaattgagcttaatcaaaattaaaaacttctattccttgaaatatacttcttatggaagtcaaaacacaagctgcatctgaaataaaggttacattttgctcataggaaagttcttcaggtccttaaaaatcagaacctacttgtagaacatttcacttatgcattttatcatatcagatgatcctgtgtttcattgttttgactactaaatgttctaataaaattcgctgttttaaaaaaatgaataaacaacatactaaattttagcaactttcgcttcattttttaatctttaaaagagagagagagaaaaaaaaaggctggaattgatgaaaggacatatattgagagcagttattgcctgagtgcaaagaaacaaaccaaaatggtaagaaataagcataaaaatttaaagactatggtagttggggttatttattaaagagacaaacaacctttgacatcttattagttcccaagaaattgaccatattaacataaacacaaatacagaagttgatttttgttcattttattaaaatatatatttttaattagtcttgaaaacagtgaagcagtgtatactttgtatcttcaatttcagaaacagtaagtatgtaacatagtttcaaaatcagatttattgaggtataatttacatacacaaaatatgccaattttaagtgcacagttcaatacgttttaacagacatattcactcatataatcaccaccattaagatatagaactttttgatcactccagaaagttctttcattcccctttgcagtcatttcccaacacctcccctctgttccgcaggcaactacagatctactttttgactttaaagattggttttgccttttctagaatttcatatgaaaggaattattcaatgcatccttttgagtctggctttttctcagtgtaataattttgagatttatctatattgttatatatattaggacatttccttttgattttcaaataacattccattgtagggatataccccaatttatttttccatgcacttcttttttttttatatttgggttgtttgtagtttttggccattatgactgaagctgctatgaacattcacatataatgttttcatttctcttgggtatgaatatctgggagtagaattgctatgtgttatgaaaagtgcatatttaactttataagaacttccaaacttgttttccaaaatgattgtgccattttacattttcaccagtgatgtttaagtgttccattgcactacatcctcactgacccttgatattgtcagtcttttacattttagctattctagtgggtgtataattgtaatttaagttgtaaaatatttacatcccaagtagctaaaattaagaaaaagtttagagttggatggtggtaaacctttaattacctgtaaaatttggtaatctggaacaactcacttatcctaaagcttttatataattgatatttcaaaataatgtaagatggtattacatgctttttagctctattgtaatctccagttaagagtaagtaaatagttccaactatttaatgaacattaatttgacatttcttttgtttccaacttaatgtaatccaaaattacccataaaatgtaatatttaggggtggtatatattgtggggaaaaatgtgttctaaagataatgaaaaagtactctagtgataatgatagccatcaatcattaagaactgactgtatactatatactacgccaaaggctttataaatataatttcatttaattgttacaaaatggggtacatattcttattttgattttacaaagacagttaaggaactgaaacatgaaatacaaggttaaaaataattgaataaataaattgataaaaggaatgaatgaatagagcaaggaaagaataagcgaataagaacgtgggcttgtttttttcaaacaaattatatgttatggactctagatctcttaacttagcttcagtgacattggattattgaaaaatgaaactattttgaggaattgactgacccctaaagtttccacaataacttatttaattttttatctttctaatacttttttgccttataatataaaatttgaatgtttgttattagtgtgaaatgaaatcctttcaaatatatgccatcagaaggatgtgttacaaatatacagtattacaaacatttattttgtatgctgaataagaaaaaatcagttataatacagttttaacatagtatccagtgtgtgaattatttaatgaaatatttgatctttattttttgttcccagggaggttatattcaaaagaaaaaggaactgtggggaatctgtatctttattgcagcagttgacctagatgagatgtcgttcacttttactgagctacagaaaaacatagaaatcaggtaaagtttcttgtataaatataagcctctgccataaaaggaaacgaattctggattttcctctcaatagacttttgtgaattagtgagaaatgctaaaataaagtaaaacaaaaagaacttggaccaaatagtgaactgccattctctcatggagccgttatgaaagtgtatttatgctgtatttctttaagaggtagcagtttgtgtcctggaaaaattttcattgtgtctctcactattcatgtgtaagctttcttaattgtggctgttaataaagtgaacagaaaagcaaggatttgtaaataggcttgttttatattaaaacctttatataagtagtttgagtttatcttaaaggtatttaggtaagatttattaaagcctaagattgttttaactagaggatattataactaaatgctttttttcagattatatattgatttgaacatgctacaatacttgaaccagttaattacttaataggtgtttgttgttgagtttataagcctcataagaagagtttattaatgtgttttcaataatgtatgaactttatcttcagaaagtatccaggacttccagtcattttctttgcaacatatttacaaaaatgcaacagtatgtatttttaccaaataggtaattatgtttctccttgaacaaagacatctagaattaaacataattgatattttatttaaacgagatagattaaattgttgcatttttgaaatactttttttgctatatctaaataaaatgtggaaacaaaggccttgtatatttgtaaatatacaaaataatagaaatgacataaatagttcatagagtcaatacctgcaacaccacaggcactcactgcttctctcccttccttgttttcttcccttaagtttcccctagaaaaaaggctttgttgtaacaattcagttttcatggtaatctcaggacaggtattgccatatacctcaaaaaaactggaactgagagtagttctttaataaatgctattctgaggctgatttctttttctttggatatatctgcacttttgttcctttctcttttctcttctaatcaacattctgatcttctattctttgtcatttctactctttctttatttgctttttcacatagcttgtcatggctcccccattcctttctgtatcataggaactttaataaccttttggttcccctgctgattagctgaagcttttatttccccagtgtttgattggtccagcccatttttttgagtgagggctataactcattggttgctggacagcctatggatgggtcaggtgactatcttttgtttcagttagctgctttggtataattccttatacaaaattcatgattagaaattagcatgtgagatgtagttgatgattgctatctttaatatcctattggaaaatgtatatattgatgtttcaaatacgttaatttttatggaaaagagtaacgaagagtgatttaaagttattatttaaactgcttaaattatttaaatcaactttccttttccaaaaataattcaattctaaaatcattggtggggcaaataaagtatgcattttggtgtgtatctctgacaggagggtgccacagggcccagagcaggatgttagagtcaaagtagggtgaggagggcatcctttgtgtgggggcaacctgatggggctgctttgtgtgcagtgtcagagactaagcagggtgtgcaggcagccggtgcacaagtgaggtgaggagggcagcctgctgtggggagtcagaacccttccacagtgaggaagtgtctatgctaaggggtggggtaagtccagaactgggagtcagttctgagaagaacagaaaagtgtccacacgggggagggggtggctttggagatagaaaatggttacttacagggggattgattaaatgagtaagtaaactgaggatgaatgggttccaggtttcccactgtcaatgaagagttacaaatatagaaagggaaacactaaaatgaagcatatggttttatattggaattggatgaatggatgtgaactcatgttttttaaaacacatagacagatacagaataaatatacgcatatctcttcttgacccttcgttttcttatattctcaatgatgaatagatataagcataggtatatagataatagaggtgtaagttgaaggctaattatttttgcaaaaagtaattccttccaaaggatatagtagtgatttgatgtagagctgataatcttttgaattgaaatatctatgatttgaaaacgaaataacacaaatttttaaggttactgatttacttttttctattctttcctttgtagtgtccataaattctttaacttactaaaagaaattgataccagtaccaaagttgataatgctatgtcaagactgttgaagaagtatgatgtattgtttgcactcttcagcaaattggaaaggtaaagtaaacattttattaggtttacactctgattttttatgtcattgttcacaattagattctgggaattatttaacacatttagtaaagttagtaagtattaattcttagacttgtcccttttaatgttagctcattaattcttagctttcttatttatccagtaatatgcattctgaatgcttcctggaaaattaaccgttttattatcctttcatgtcttccatttgttttcaaaaactttaagcttatctcccattttagccttctttgccagaaaacttctagttctgaatagaatggtgacataaatttaaacttcttcctaatagtgttatttagtttggaacgagaaaacacttgcaatggatggtgtatgtgacctatactataaagtaatgatttgtactcccaatggtggcttagaggactttttccattacagttcgagtaggagcataattaatatgcttaggttaagttttttctatacttttcatcaaaactgtacttccctaccccaaatgtttcagcccttaatttggcatatgtctgttatcatgtttgttttgaggctcatttcatttgcggttaagagaatatgaaagttacagtgttagctaaataagcaattgtgtaatagcatggtaaagggagaagggtaaaagaggcatggccctattctggagagaatgaggatggagatagaggtggaaagaagcatctccttaggaggatggctctattttctccccctttttcttttttgaccactaaaacttcacaactgtggtggaggatgagaaaaattagagaaaaaactcaaaggcctagggcttttgaaggactgtcttttcttgcccctggttttaattgtaatatggtagcattggccatctttttttttttttttttttggtcttttcttgatgagaatagaagctttttgcacaagaaaaagggaaatttttaattattaatggagataaattatctaaataatttgcataacaaacatgaactaattatagaatacttggaaaacacagaaaggcataaataaaatatgaatcgaccaaaatgtcaacagtggagagaatcacttttcatattttagaatgtttctttcctttgggtattgtttcacattgagtagaatattatatatatgtgtgtgtgtgtgtgtgtgtgtgtgtgtgtgtgtgtgtgtgtggcttttaaaatttacctaattgtgactttctaaatttttttctattctttaaacttgtttacaacctttttaattcatatctggtagcttattttaatatgatcctaaatacaatgttgctttagagtttttttggtacaatattatttaggcccctgaaaaactggaaacaactgatattcacagctgaagttaaacaatacatattaaacatatctaaacataaaatgttataaatataaaataaaatgtgataaagaataatggcaatattggcaagtgcttctaatgttaaacaaatgaagcaggatatactctgattatgactgtgtgtaaggaagaaacctagaccactaacgcatagaatgaaatgactggagagaagtttaccacaatgttaacccaagttttatatgagtaacttacatttgtaaggaggatgtattacctttctagtaaacaaagcaagcaaaaacttctttaagccaactttaatgagtattctatacatataagtactttaagatctataatcatcagggtttttttttttctagatatagaatttggggactcattggtaggagtgatttggggtacagttctgattttttttcctgctatagtaatttcgactggatgcttccaagttgtttgctctgctgtctgagataaggaatctgcttggatatttgtttctgttgtaagaagcaggaattacatagtggacaaagcattacattgtatatgtttaagggtgaagggtaactatagtggtgattttggtcagagaaaaaaccatagaaggcaatgtccgaatagggtttacaggaaaaatagaaattcaccaagcaaaatgagtgggaactgggagcgagcatcttagagattagcatgtgtacaaagccaaagcagtgatatcaggatgtactttgatattgctaatggctgaaaggtaagaagggatcagattggtagtaatcttgggctttgccctgcaggcagtggaaactccttgaatgattttaaactagggagtaacagttggatttggcctcaaaagaccactcaggactttgtaaaagggatttaaaatttttattgacaaatcatatgagataatttaaagagtaaactttactaaccttaggtggatcagctgggtgttttctatcttatttataccttttttttgaagactaattgagaggattaactgtaattatatattaaagtgatgtgagatgtcataaattgggaaaatctacttgaactttgttttataatgctatatattttttgtttttaaaatatatacttcttaaaagaagataaataaagcatgagaaaactactatgacttctaaattacgaaaaaatgttaaaaagtcataatgtttttcttttcaggacatgtgaacttatatatttgacacaacccagcagttcgtaagtagttcacagaatgttatttttcacttaaaaaaaaagatttttatggaataatctcaaacatcttgatagttagggttagtttgatcgattatagcaggctacttcataaattaagcccatagatttaagtcctgtgtagattatttatcttctcacaaagaaaatagtataaaatacatgccttgtactacaaagaagaactaataaggtggaattgattcaggacagcatatcaccaactctgagaaaaatgcaacaaatgcaaattcattgactaaatctttattgagggtctgttacaggcactttattaactaataatcagcataatttctgtgtgagaataaatgtaaaaatctgtattaaaatttccaaatgattattttaaatgtataatgcatgctctaacagtatgcccatgtagagctccagagttttttcttggaaacagaatgagtagtacatgagattttctgcctcattggagtagtattgaagataattaatataaagggaaattgtatatttactgattaattgatatcaatctattaattccaacaagtgaatgtctctggaaagattatcaaggcaaagtgttaaattggcaaactaaagtcatccaaaccttcatttttctgctcacagtgttgataattaatcagaaaaaagagcaaaaaatattaaggtaatttgaaacaaagtatgttataacatactatgttttttatatatttttatattagaattgaaatattcagtatttcttttacaaaatttttctttcaaaatgtatacttttttttcttaatttttttttttgcagcttctcatggtcaagaatgtatactattctgtgggctaaatatcatatcttagaattataagacatagaaacattaaatgaatagagataaactcaggtgtaaattatgcaattaaaatggactgcattctattatgcatttaactaaggtcattttttttttaatgcacaaaaagaaacacccaaaagatatatctggaaaactttctttcagtgatacatttttcctgttttttttctgctttctatttgtttaataggatatctactgaaataaattctgcattggtgctaaaagtttcttggatcacatttttattagctaaaggtaagttcattatatttattaaatgctaatatttcaaatgtaataattaaattggcattcctttggactaaattccccaatttttattgagtaatgtactcctccctcattctctgcttggcttattaactgttagcaagttcctataattctggtactagaaacaaccttggaaatgctttatttaatttttgtttctaatattccatcttccctccctttcttttttttgaagaataatgatgttactgttttcataaaaatgatatttgctcatgataaataattcaaataaaataattttggtcacaaaagcacaaagaaaaattatctaaaatccacccagggataatcggcattaaaattacataattgggatgcagttaaggtatagaatttttattatttttgtttgtttatgcaaacagtgttaacttgttatcagttgaaataatgggttataagatagtatttgcaagcctcatagtaacctcaaaccaaaaaacatacaatgtagacatgaaaaataaaaagcaagaaactaaagcatatcatcagagaaaactactttcactaaaggaagacagaaaggaaagaaagaaggaagagaagaccacaaaacaaccagaaaacaaataacaaaatgacatgagtaagtccttacttaccaataataacgttgaacataaatggactaaagtctctaattaaaagacacagactggttgaatgatggaaaaacaagactcatttgatctgtttcctacaagaaacacactttgcctataaagacacataccgactgaaaataaagggatggaaaaatatattccatgcccacagaaaccaaaataagagcaggggtcactatacttatatcagacaaaatagatttcaagaacaaaactgtaaggacaaagaaggtcattatataatgataaaggggtcaattcagcaagaggatataacagtgttaaatatttatgcaactaatactggagcacccagatatataaagcaaatattattagagctaaagagagacataggccccaatacaatagaaatagctggagacttcaacaccccactttcagcattggacagatcttccagacagaaaatcaacaaagaaacatcagacttaatctgcactatatagaccatatgaatctaatagatatttacagaacatttcatccaagaatatacattcttcttgtctgcatattgatcattctcaaggatagaccatgtgttaggcttaaaacattaaaaaagcatgaaataatatcaagcatattctctgatcacaatagaataaaactagaaattaataacaaggtattttggaaactgtacagatacatggaaattaaacaatatgctcctgaatggccatgggtcaatgaagaaattaagagggaaattaaaaaaatttttgaaacaaataatggaaacataacaaaccaaaacctatgggatacagtaaaagcagtacagagggaagtttatagctgtaagtgcctacatcccaaaagaggaaaacatctttttttaaaaaaacttttaggttcaggggtacatgtgatggtttgttacataggtaaacttgtgtcacaggggtttgttgtacagcttacttcatcacccaggaattaagcccagtatccaatagctattttttctgttcctctccctcttcccactttccaccttcaagtagaccccagtgcctgttgtttccatctttgtgttcttcagttttcatcatttagctcccacttataagtgaggccatgcagtatttagttttttattcctgcattagtttgctaaggataatagcctccagctccatccatgttcctgtgaaggacatgatctcattcttttttatgggctgcatagaattccatggtatatatgtaccacattttctttatccattctgtcattgatgagcatttaggttgatgccatgtctttgcttttgtggatagtgctgcagtgaacattcacgtgcttttgtctttatggtagaatgatttctattcctttgagtatgtactcagtaatgggattgctgggtccaagggtagttctgcttttagctctttgcggaattgtcagactgctttctacaatgtttgaactaatttacactcccaaccaagagtgtataagtgttctcttttcttttgcaacctcaccagtatctgttattttttgactttatagtaacagctattctgactggtgtgagatgatatctcattgtggttttgatttgcatttctctaatgatcagtgatatggagcttttttttcatatgcttattggctgcatgtatgtcttcttttgaaaagtgtctgttcatgtgccttgcccactttttagtggggttggttttttttctcttgcaaatttgtctaaattccttataaatgctggatattaaacctttgtcagatgcatagtttgcaaaatttttccccattctgtaggttgttcatttactctgttgattgtttcttttgctgtgcagaagctcttgagtttaattcaatcccacttgtcaatttttgattttgttgtgattgcttttggtgtctttatcatgaagactttgcctgttcctatgtctaggatctattttttttttttgagacagagtctcactctgtcacccaggctggagtgcagtggcacaatctcggctcactgcaacctctgcctcccgggtttaagtgattatcttgcctcagcctcctgagtaactgggactacaggtgtgcaccaccatgcccggctaatttttgtatttttactagagatggggttttactatgttggccaggctggtcttgaactccctacctcaggtgatccatgcacctcagcctcccaaagtgctgggattacaggaatgagccaccacacctggcctggccatcttcaatccatcttgagttgatttttgtatatggtgtaaggaatgggtccagcttcaatcttctgcatatggctagccacttatcctagcaccagttaatgaaatgggagtcttttccccattgcttgcttttgtcagctttgtcaaaaagatcagctggtcctaggtgtgcaaccttatttctgggtgctctattctgttccattggtttacattattctgaaaaaaatgtgcctgtttttgtaccagtaacatgctgttttggttactgtagccctgtagtatagtctgaagttggataatgtgatgcctccagctttgttctttttgcttaggattgccttggctattcaggctcttttttggttccagttgaattttaaaatagtttttttttttttatttctgtgaagaatgtcattggtagtttgataggaatagccttgaatctgtaatttttttggggcagtatggccattttaatgatatttattcttcctatccatgagcatgggatgtttttccatgtgtttgtgtcatctctgattgctttgagcagtgttttgaaattcttgttgtagagagctttcacctccctggttagttgtattcctatgtattctttttgtggcaatttttaatgggattgcctttctgatttggctctcagcttggctcttgttggtgtgtagaactactagtgatttttatacattgattttgtatcctgaaactttgctgaagttgttgatcagctgaaggagctttttggctctaagactacagggttttctagatatagcatcatgtcatctgccacagagatagtttgactccctctcttcctatttggatgcccttcatttctttctctcacctgattcctctgattaggacttccaatactttgttgaataggagtggtgaaaaagggcatccttgtcttgtgccagttttcaaagggaatgcttcaagcttctgcacattcagtatgatgttggctgtgggttagttataggtgaaaaaaagaggaaaaactcaaataaacaatctaacattgtatcttaaagaagtacaaaaataagagcaaatcaaacccaaaattagtagaagaaaagaaagatcgagcagaaataaatgaaattgcaatgaaaaaattgcaaaagatcaatgaaacaaagtgtttttttaaaaagttaaacaaaattgacaagcctttagctagattaactaaggaaaaaagagagaagatacaaataagatcagaaatgaaaaaggagacattacagctgatactgcagaaactaaaagtatcattagtggcttctataagcaactatatgccaataaactggaaaatatagaagaaatgggcaaattcctagacatgtacaacttaccaagattgaaccaggaagaaatccaaaacctgaacagaccaataacaagtaatgagattgaagccataataaagtctcctagtaaagaaaagcctgggacctgatggcttcactgctgaattgtaccaaacatttaaagaagaactaataccaatcctacttacagtattctggaaaatagactaggaagaaatacttctaaactcattctacaaggcctgtattaccctgataccaaaaccagataaagacccattaaaaaaagaaaactataggccagtatttctgaggaatattgatacagaaatcttcaacaaaacactagcaaactgaattcaataatacattagatagatcattcattatgtcgcagtgggatttatccctgcaatgcaaggatggttcaacataaacaaatcaatgtggtatgtcatatcaacagaatgaaggacaaaaatcatatgatcatttaaattgatgctgaaaaagcatttgataaaattcagcatccttcatgcccaaaaccctaaaaaacctgaggatagaaggaacataccttaacgtaataaaagccatatataacagacccacagctagtataatacttaatggggaaaaattgaaagcctttcctctaagatctagaacatgatgaggatgtccattgtcatcactgttattcagcatagtactggaagtcctagatagagtagtcagacaaaagatataaagggaatccagattggaaagaaagaagtcaagttatccttgtttgcagctgatacaatcttatatttggaagaacctaaagactccacaagaaaactattagaactaataaacatgttcagtaaagttgaaggatagaaaatcaacatacaaaaatcagtaatgtttctgtatgccaacagtgaataatgtgaaaaagaaatttaaaaagtagtcctgtttacaatagccacacataaaataaaatgcctaggaattaaccacagaagtgaaagatctctatgatgaaaaccatagaatactgatgaaagaaattgaagagcacaccaaaaaaatggaaaaaaattttatgttgttcatggattggaagaattaatattgttaaaatgtccatactacccaaagcaatctatagattcaatgcaattcctatcaaaataccaatgacattcttcacagaaatagaaaaaacagtcctcaaatttatatggaactacaaaagacccagaatagcgaaaactatcctaagcagaaagacgacgttgcttgacttcaaattatactacagagctatagtaaccaaaacagcatggtactggcataaaagcagatacatagaccagtggaacagaacagagagcccagaaacaaatccacatgcctacagtgaactcatttttgacagtggccaagaacatatgctggggaaaagacagtctcttcaataaatggtgctgggaaaactggatatccatatgcagaagaatgaaactagacccctatctgtcaccatatacaaaaatcaaatcaaaatgattaaggacttaaatctaagaccttaaactatgaaactgctataagaaaacattggggaaaatctccaggacatcagtctgggcaaaaatttcttgagcaatacctcacaaacacagtcaaccaaagcaaaaatggataaacgagatcatatcaagttaaaaagcttctacacagcaaaggatacaatgaatgaagtgaagagacaacccacagaatggaaaaaatatttgcaaactacccctctgacaagcaattaataaccagaatatataaggaacccaaacaactctatgggaaaaaatctaataatctgaccaaaaaattggcaaaagagttgaatacacatttctcaaaagaagacatacaaatgacaaacaggcatatgaaaaggtgctcaacatcagtgatcatcagagaaatgcaaatcaaaactacaatgaggtatttatctcactgcagttaaaatggctgatattcaaaagacaggcaataacaaatgctggctaggatgtggagaaaagagaacccccgtacactgttggtgggaatgtaaattagtacaactactatggagaacagtttggaggtttctcaaaaaaattaaaaattgagctaccatattatccaacaatcccactgccaggtatatacccaacgaaaggaagtcagtatatcaaagaggtatctgcactcctatgtttgttgcagcactgtttacaatagctaagatttgaaagcaacctaagtgtccatcaacagatgaatggataaagaaaatatggtacatatacacaatggagtactattcagccataaaaaagaacaaggtctagtcatttgcgacaacatagatggacctggagatcattatgttaaatgaaataagccaggtacagaaagacaaacatcacatactctcatttatttgtgagatctaaaaatcaaatctgaactcatggacctagagagtagaaggatggttaccagaggctgggaagggtggtggaggtttgggagaggtgaggatggttaatgggtccacaaacatagaaaaaatgaataagactttatagcacaacagggtgactttagtcaataataccttaattgtacattttaaaataacttaaagagtgtaattggattgtttgtaactcaaaggataaatgcttgaggagatggataccccattctgcataatgtgcttatttcacagtgcatgcctgtatcaaaacatctcacataccccgtaaatatatgtactatgtacccacaaaaattaaaatttaaaaaattatgtaattgtcattccagatatcttcatatatacattttgattaaaaagatgggtagttgagtgcattcacgaatataattttctaaaactaggttcatattacagtgctacctttaaaatataaaaattaatttcactgaaattttatagaagagagaaatggaaggaattgcttaaatttagataagtattttgtcactttaagtgatattatttctaaaattatttctctaagattatgaaaaaatgtgaaaaaattaagaggttacaatctttatttaagtttgtgtttttatttaaagcaatatactttaatctggtttgaagaaggttactatcttcactcttcctggtgcctccccctctccattttcagattagtccattttattgttatgacattatcaagtattataacatttaaattctattttgtcactataattattgcatttggttagtctcagttctgtatttaaatggattctaaggttatcataactcctatatcatagtttctccatttctcagttctttatttttattcatctcttagctggctgtattttacaatcaacaagtttttaaaaatatgctttttggttccatgttctttatgtttgacatgtttaggaatcatgtctatagcttttatacttgaaggacagctttgtcatgtattctattcttgagtcatattttgtttccctcaggacaatattttctggcattgaacattgctgttgagaaagctgagactagcgtaattccgctcctcatttacttcctgaagaattttttttttaatttgaggtttaataccttaaacaggataacatttcttgattttgttattctgtattagctttttttttttgaacaccgtatccctttttaaactgaaggttctgctgttcattttagaaaatcttaacatactctatttaaaaatattctattcagctaggttgttctataccattgtattttgggaacattttcttatgttggattgcttttattctccctatttattgtcttctctcatattattctgaatttttaaatctttttcttacatattggctgtttttatctcaagcattttttccattttgagctaaactatttttgtaatggtgttatttggtcctcatcttttttcttagcttgtctagttccttccttttatataatttgttcattaatttcctttttatgatacatttttattgaattggatttataatagacgaattattcaataatatgtatttggatcactaaacaaatatattgagaatagcaaatggattttaaccctcctgctaacccagatcaattgctagtggcttcccggcccattgtgttaagaaggactctagattagcatcaggtctctacagggaggggtacacttagtgatgtgatggctgccaagtaaaagctatgaggtggtgatggtgatgctaccctcttatctcagaggcacgtttacatttcatatagtacattacaggtgactaaaggtcatggttgtgcatcagagagggtaagatgatgatcaggagaagcttcaatattaccatttatttattgattcaacagttagttatttattagaatttacaatgtctcaagcatgatattacgtgctaggttaaagtggtggaagatgtatatgttccctgctcagctagaacttacagtcaagtaagggagatagacattaaatgaacaatcacagaaatacttaactacatttgcgataaggaatgtaaagggaaagtgtaatcccccaatgggttcttcctgctggctgcacagacaaaatcaatccaccaagattgtggcattgcagtagagatagtttaattgaccactaggctgacccatgtgggagaactggagttatcactcaaatcagcctcagctggttaagttcttagtgcaagcactcatagggcattttcttcttttagattatctttcagattgggttctctgtctgatttttttccccttcttatgttgtgattcttttttgattttctatgtttacataatcactgtgcttttccccctcgtattgctgggactgtatatgtgtaaccctgatttgatgttctgttttctctgatttaatgtgagtgaatatcccttcactctgcacttaatctgtgacttgtttatgttccccaaagagctatggtatgggagcaggcatttttattatatctgcttttagtcaggaggtaagggagaaagtagataattcaactgtaatgatacaagccgttgttctgagtttttgttagaatgaactttataacagaacacttctagtggcagttttatcttttttctatagcaggattgttttgggattcaaattgtccccagttcaacacagtatgcagagtctctgtgttgtcagaaaaataagctatagttgtttacttcctccattttactcttctcttatcagcagtttctccctccaagtcagagaggcaaaagatgaggataccgtttgagttagtctcgctcagtcagtctctcatttgatattggtaccagcactttaatacctaataaaatgaaagcaaaagaatgtacttgagagagattctttcatctgacttcaccgtttttacctagaaatccttgatatcgttctttaccactatggtattttaaaataacttatttgtgaatatattgcagacatattttttgcaccataccattgtatctagaaaacctataaagatgcaacgttatctgttttctcacaaagtttctgcacatccagtgtttgctgagattattactggtttagcagtcagatactcagaaaatagaaagtgaatcaaattgaacttctcttttaaaaataatgtatgacatggagccataagcaaatttgtaatagctgtgttttatcatgatttgtatattttatgtagctacactatttgttttcttaggtatctgttatatgcatttattttctcacagccatctagttgtatatatattctaataactttaaagattttatggtgaacaattattttatagatgactttaaatttatatactaattttgttatctcttaatggttttggttattgtaagattttagaggggttgaaattaaaaatatataaggtttagatataaataattggaataaaatcataattttataaataaaataattattttaaatttttagataatgagaattaattgaatcattggaattagaataaattctaataaacttagtaattttatataataaatatacttataaaagtggaattaaaaatttgaattctaattattataataaaatattatacaaatataaataaaatatttataaaattagaattaaagattagcatttatcatacttcaaaatctttctctggagtaatacattctatagttcttaaaattagaaataaatttaaaaagcaaaatttatagtgattttagacataaagaattaattataacagaaatacttaaatgtaaaattctcagagtagacttaacacttgatttataattccataactttacatatttctattttacatattttataccttttaaaacagattttttttttttttacaaaaaaaagaaagaaaatctttaccatgctgatagtgattgttgaatgaataaatttatggatatactctaccctgcgattttctctcatacaaagatctgaatctctaactttctttaaaaatgtacatttttttttcaggggaagtattacaaatggaagatgatctggtgatttcatttcagttaatgctatgtgtccttgactattttattaaactctcacctcccatgttgctcaaagaaccatatagtaagtatttaatttatgccccttttactttctcattcagcagttgcttattgaatgtctagtgggtaccaaacatggttctaaggctgacaggatgataaaaaataaatcagacatggactttgcccataagtagtgtaagttatagaaggaaagataagacatggaaacaaatgattagagtatatggtagaaagtggtttgggtcaaaatacaacaaatggaggtttgggagacaagaaagtttttccagctgtggaagaccaaagaataccatataaaagaagtagtatttgaaattaacatggaagagtggttaggattggggaaaggcattctcagtaaagtgttgggggagggcattcccagtgaagaaaagcaagaaacaagaaaaagatatgaatgaaattgcatggggaagagtggcctattctaagggaacagcttaactaagtttttattactattggatgttgtaataactatgtatttttttgtatataagctataactcatactatttcagtgggtgatgagtgatgagatgggaagtatatttaaataaaaataacttgctaatataattagatagcattaaggaagtatgagtaaggtatattccttttagcctagaattgcttcctttcatggcttcaagagtaggatttcaaagtcacttattatattattatatacagaaaaatgtaaacttacttaaggtcagactaattccttgcttctgaaatgatgaaagtattaatgctaaaaataatagataacatggaagtttcaaagtgttgttgaaatggatggaaggatgaaggctcattaaactttgtgaacaagaatttagtggaaaaattaagtatggagcagaattttgaagatgtgttgaacatggtttggcagagaaggcagaaaccttcatttagcagaaaccacatgcaaagaaagaaataaaaaaaattctatatagaaaacaaatatacttcaaattttctcccaaattttataaatttcctttatataccctttccccacttttttcaatgttataactttaataagttgatgttgcaagttactttaggttgacaatctttgttcttttggataattcaaatgtacatgtgaattctctaagtgctctgttaaagagcaatcagcatggggtattattgaactgactgaatatggtaactcttagttaatttttgttgtagagaatttcaaatgaatacaaaaatagtagtataataagcctccatgtacttatcatgtaacttcaacagataatttacagttaatctgtagccccattgcctgctcagttcccccagctgtattattttgaagcacatctttgcataccatttcatccttatacatctcagtatatatctctaaaaaatactttttaaaaagcataattacagtgctctttgttatcacacctacaaatcaataaatagtgactccttaatattactgaatatctagaaagtgctcagattttcttgtaaaaataattaaaaaatttttttacagtttgaatgagaatctaaataagatttatactttgtgtttggttgacatgttttaaaaactcttttaaaagtttctcttccatcctttctttttttccttgtaatttattttttaaataatcagattgtcttgagttttccacagtgtggtttttgctgatcatattctgtggtatagtttaacatgttcttctgtcctctcaatttcttgtaagttgttgattggatctagaggcaatacatactttttatacttaatcatctgtaattttttttttttttttttgaggcagagtctcactcactctgtcgcccaggcctggagttcagtggcgcgatctcagctcactgcaaactctgcctcccgggttcaagcaattctcctgcttcagcctcccgagtagctgggactatgggcatgcaccaccacacctggctaatttttgtatttttagtagagacggggtttcaccgtgttggccaggctggtcttgaactcctgacctcatgatccacctgccttggcctcccaaagtgctaggattacaggcgtgagccaccacacccagccatctgtaatatttttaatagctgaacctgtatttagtttggattgggaatgctgaaaataatccaggagattttttttttaaatcacagtttattatcatattattatatttactataatatattttatacctatcttttaaagacatcataatttactaaaacttaaaatattgtttttatgctatgtctagaaattgaattcagaaatatttgctaattatttttaagactctaggacagaaaacttttttttcctcttgcagactaaaatacgcttagatttagtttgaaagttggctatttccatgccttctctttgtatttgtttatgagactgtagtttacagttctttttgggagcagagtagaagagggatggcaaaaactaatattagtacataatttgtagtagatatggatgaaattgttatccttctaatgaaacctaataagtaaaagtagtagaatgttaccaagattatttttgacctaagttatagttagaatacttcattattttatatgatggatgtacaattgttcttatctaatttaccacttttacagaaacagctgttatacccattaatggttcacctcgaacacccaggcgaggtcagaacaggagtgcacggatagcaaaacaactagaaaatgatacaagaattattgaagttctctgtaaagaacatgaatgtaatatagatgaggtaatttaacttcatgatttctttaaaacagttaaagtagatttagatgtaagttctccctaacaatatttacttcttttgttatgagcatgttttttttgtaattagtgctaactcttttgcagtagcaaaatatttagaaaaaattaattcgttatatttagttactttgattttaaagagagtagctccctcactctggaatcactgaaaagtatataatcaagacaatagttttcaaatgtagtttttttttttttttattcctctgaggttactgatacccctaatgttttaaaataccctgccaaggctgggcatggtggctcacacctgtaatcccagctctttgggaggccgaagtgggaggatttcttgaggccaggaggtctagaccagcctgaacaacatagcgagactctgtctctacaaaatacatatttaaaaaaatgaactgggcatggtggcatgtgcctgtagtcccagctacttggaagactgaggcaaaaggattgcttgagcccagaagtttgaggttacagtgagacatgattgcaccactgcactccagcccgggcgccagagtgagactatgtctccaaaaacgaacaaacaaaccaaaaaagccctgcttagaaaactctagtgctctagtgttttagtttagtgataagtgataccaacattaaatttctgtttggccttctataattactctctttctaaatattacagcacataatgactgctggagaatacatatgaattcccaggaattacttgtcttgttcatagaatgtggatgttagaaggaatcttacaaataatgtattcaatctcctttttataatgagtaaacaagcttccagggactgatagcttattatttacagcgtctacattagactttgggatatctggtactattgcttctttcctttttaccatacagtttttctcatagtttgttttattgtccacaatcactaacaccagatagcagtaaaaaatgttacatctttgaaatttctctgttaactttgggaaggagtgagagtgtggtcctaaaatctagtttaagaagtattagaatgatttatcaagatatatcatagtttttgcactatggcttactaatttcaacaaatatacagttgactcttgaacaacaggtttgaattgcatgggtccgtttatacacagatatatttaattacatatattagaaaaaattttggagatttgcaataatttgaaaaaatttgtagcaaaccgtgtagcctacaaatacagaaaaaattaagaaaaaggcatgtcttgaatgtacaaaatatatgtagatactagtctattttatcatttactataccataaaatacatacaaaactgtagctgcagatgcctgctgtttcaggcggacgatttttgttaacagatgacataaacttactgtaaatgtattttgtcttcttacaattttcctaatattttcttttctctatctttatcataagaagatgatatatttagtatgtatatatagtacatatacaaaatatatgtgaattcaatctttatgttattggttggcttccagtcaacagtaggctgttagttaaattttgggtactcaaaagtaatcgataggtctgtagtctcagctacttgggaggctgaggtggaaggatggcttgagcccaagcatttgaagctgtaatgcatgtgattgcacctgtgaatagccactacacttcagcctaggcaatatagagagaccccttctctaagaaaataataaaaaataaaaaagttatacacagattttttactgcatgggggattgacacctctaacttaccctgcattgttcaagagtcaagagattagattttgttttaaattttaatgatcatgttgtaacttcatctttttcaggtgaaaaatgtttatttcaaaaattttataccttttatgaattctcttggacttgtaacatctaatggacttccagaggtaatctgaaaggaaatttaataaaatattaatgttttgagactgtggagggaggataattgtctaactttcttagatcaatttactgtgtatcacattttttttttgcccaagaagaatctagccaagtagaattgtggtgaaactaacttttgtatagtaacaaaaagcttttgagtatataatcaaatgtattagcatcattttgtgatttatactagaaatcaatctttattgaattttttccaaaatcaaagtatagacttttaaacttctaaataccattaaatagctaaattttaatagctaaatataaaccattaaatttgctttggtaagcctcattaagcgtaggaaccatgattaatgccatcaacattattggcattactacattgtggaacatctcttttgaggatttttaagaactgcttaattgaaaatacaaatgtatttgttgaaatgactgtgactattgcagaagtgttttaccttagtgatattccatccatctacctgttttgtttcgcattttgctacaaatgtctttccaatgagaacagaataactgagagctttgcatggtaagacgaaatatgtggagaaaaggatgctgtgatagatgatgaagaacaaaaccagtgttttagaagacatagtattagtcactatgaccaaaaggcatgaaataaaatagctagactgctagttctgtaacctgaattgatagctagtttttgaattaatttattaattcaacaaatattttttgaatgcttaatatatgtcaggcacgtgctagatactatggatacagagatttcactctcagtcactatccttaaagtgctagtgggagaggctgacaaagaaatagagcattacaggagtctacaagagtgtgaaaaaagtattcacagggttctgtgatatctcaaaggagagctacctaatccaaactagggctgataggttttgtggaaaatagtttagaggtgatgtgatttcaaatctgagtaagcattacagatatagcatttccaagggttggacattgtagattcaaaggtgcagtgatgtatgatagtatggtctgatcagtgaactctaagtaattcattaaggttgggatacagggcagaacaattaaaatatggtactgaagaggcaagaagggaccaaatgttatattaatgagtcttgttaccacttttggtaccaaaaactaggctgttcataactttaaaatctgttgtagcaatctttttttctcctttaaaaggattatagttttaatataaatcttaagagtaattttactttttctccaatatttcacataatatagccaatcaatagatgactggtaattagtgcctcaactaaggtaggacaggaacaatgattaaacataagcatggattactgttctatctaatacatttatgaagattaatgaaaagtttgcatttaattggatttcttcctatcactccttttaaaatgcaattttacttctctgaggttggaatcactttggcgttaaaagtcacagtagaaggcatgccaatagttttctcttgggcattggtttttaaagtataattaaaaaattatggatcagaactgatgaaagatttacaaattctagcaattgaaaaagtatctaagattgggaataaattgtgcaagtgtgttaattgaactgataaattgagctaattgtcttgcccaagatacttaactgaagggtactggagtgaaccaaagggtttagaaaacattggtagaatatgtaatcaagaggatttgcaacaatgtttgaaaaaatattttatattgataagcataaaagattaaaagcaggctgggcgcggtggctcacgcctgtaattctagtactttgggaggccgaggcaggtggatcacctgaggtcaggagttcaagaccagcttggccaacatggcgaaaccccgtctctactaaaaatacaaaaattagccgggcatggtagcaggtacctataatcccagctactcgggaggctgaggcaggaaagttgcttgaaccccgggggcagaggtggcagtgagccgagattgtgccactgcactccagcctgggcgaaagagcgaaactccatctcaaaaaaaaaaaaaaaaaaaagattaaaagtaaagcatatatgggatgtttggaaaatcttggcagttaaacagttattataatacctatttttatcttaggtactgttttgtagcattggctatctttgtctacataaaattctaataaatattttctatgcacgaaatagacctaaaatcaaagttgaacaaatgttgcaattttctgtacctcacttttagatagaccttatttatattgcatgcgaactcagtgtatattacaaaattaaatgtatattatacaaaaattctttaatgaaatctgtgcctctgtgtgctgagagatgtaatgacatgtaaaggataattgtcagtgacttttttctttcaaggttgaaaatctttctaaacgatacgaagaaatttatcttaaaaataaagatctagatgcaagattatttttggatcatgataaaactcttcagactgattctatagacaggtattgcacatggtatatttgattgatttgctttagatataggttgatactgatataggtagattatatagtctttagcttagtgacctttagatatcatttataacaaattactttcaaatgtctttatacaaagaaaagtttaacagtattttaagcatataacttatctacaaatatagatttaatgtgaattgtgtgtcctataacagttacctttttgcagttaactgaatataattttttaaaatgtgcaccaaaagataatggctaaagtaattagtttcttcaaatagtggtctctaccttatttctatcctttcatatactattgcctgcctggtttatttaaaaaagtttatacaaaagtgtagtctctgttattatcatgtagaaacctaaaattggaatggttgagagtgattgttaaaatttttgactgatcataagtaaagttaattttgtgtctttagcatgaactcttttaatatgaaactgaaaatatgcgtaatttagaagttaaacacagtaaaatgttttaaattttatttaagtggaaataaagtttttagaaggaataatgcattgaaaaacttgagttttaatgctttttaatactgaacaacttggttatcaataccaccagggagaaagcatctgactttcacttttaaaaaaagacttaatgattggtatacctctttgtcataaacataatggaaagagacccacaattaaaaagagtagtgaaaaatattttatttaagcagcagctgggtcatctattttctatcctatctattattgagttatcattttatatgattttatgagacaacagaagcattatactgcttttttgatgcataaagcacaaattgtaaattttcagtatgtgaatgacttcacttattgttatttagttttgaaacacagagaacaccacgaaaaagtaaccttgatgaagaggtgaatgtaattcctccacacactccagttaggtatgaattttcctacttttaattatattataattttgttattcatggctttatagtgtttcagatttgttcacgtttctttatgtattcatacatacatgtaagaaatatatattgaaggccaggtgtggtggatcacacctgtaatcccagcactttgggaggccaaggcgggcagatcacctgaggttaggagtttgagaccggcctggccaacatggtgaaaccccgtctctactagaaatacaaaaattagctgggggtggtggtgtgtgcctgtaatcccagctgctcgggaggctgaggcaggagaattgcttgaacccgggaggcggaggttgcagagagctgagatcgtgccattgcacttcagcctgggtgacaagagcgaaactccgtctcaaaaaaaaaatgtgtatatataatctttgtgtgctgggcattttactggttgctgaagatatggttattggacctagttttgtctgttcttaaagaacataacctaaaataggaatgtgttccatttcagtaaataaaaaagaaaaaattaaagtatcactatttgatctgcatgcaaccttaaaggattagaactattttttatgtctttttcctcactcatttcccacatcaaaatctgttatcaaggcttgttgaataatctacctccaaaatatttcctgagtgcatctacttttctccatttctgctctcacaactcttgtccaagacattgttctctttctcttggattttttgcagtagcctactacctgatcttgctccttctggtctcatcattgttcctgtctcctcaccatcaaagatattctccatagagcccccagaatttctcctagaaatgtaaatcagttacattcaccttgctgttaaacccactgactgcttcccattgcaattggtatacagtgcaaattccttaacaatgcctaaaagatcttatatggtctggtttctgttgcctctccaacctcatcttgttttctttctcactctgtgttagccacactttggccttctctgtttcttgggctttccaagttttttgaaaaccctcgtacttgatattccctcttcttgaaatttcctccttttctttccatggattaccaactgctactcttcattcagcacaaatattgcttttgaaaagatatttctctctgaagtattttattatttctcatatcatcctgttccattcctttatagcatgtatcccaatttatattgatagattcatttgtgtttgcttgcttttactaatacccaaaatagccttaaaattccatatcacagagaccataacctttttgttcactgtctaataattagggcctgttataaaacttggtacatagtaggcaatcagtaatatatttcaaatgactgtatagatatgtaaatggatacattttcatataagtatagtatatactttggacaagataatgagatgacacagaagggactataaagcaatgtctgaactgaattttgaaacatgcaaaggcctgtgtcacaggataaagattttagggagtgggaacagcatgttcaaagggctggaattgtgaaacatgtaagtggagaaaaccctgctgtcacaccaccgacaacaatcaacacagaagacttttgtgaccaaatgtgggaaagttttcctcaccaagaaacaagcaatcagttctgcagcagtcaccagctgggtgtcctctaatttacttctgacactgcttacctggagatagtgtcagatcccacaggttgagggctcagtccccaaaactggccccaacttcagatgccagttgcaagtctgggtttttggatcttctgaccaaagggcttcaagttggggttcccatgacacctcttaggttcgattaatttgctagagtagttcacaaaactcaaggaaacacttctgtttactggtttattatagatgatattacaaaggatgcagatgtaaagatgcataggatgaggtatgggggatgggatgggaagcttctatgccctccctggccagacagctgtccaggagcctccacatgttcagctatccggaagttctctgaaccctgcccttttgggtttttatggaggcctcattgcataggcatgacagattagatcattggctattgattatcaacctaaccttcagcttccctccccttcctagaggttgggggctggggctgaaggttccaaccctctaactctgcctcgggctttctagtgaccagcccccatccagatgcttcctaggggctgccagccatgtcaattcattagcacacaaaaggacatcactggagtttctaagtattttacgagttgtatgtcaggatatggggtcaaagaccaaacatctatttcacaatatcacacaacacaatgtgtctggggaactattagcagctctgtattgattgactataaaatgagagtaggaagtcacaggagaggagagtgggtactagatatgaagggccttatatgccatactcacaaatttggagtgtagcatgtgcatgatatagcctgtgctataaatggatgttaagcaggggtaaggataaaatcagacataatttttgcaagttcacatggtaatagtcagtggggggatagactgaggagaataagaaaaagtgagaaatagacctgtcagtctgtctcagtggttcttaaccatgtgtgcaaattagaataacctgaggaattttgttttgttttttctttttaaaaattttgtgtcccattccactgaggaatatgcctaggccttactaccacagacatagtgtataaaaatctctgggcttgtctgttgtagcagtttacttgagagtttttaaagatctgaaccaacgatagtggtgggaatgaaggaacaataacagatttgataaatatttgatgaattcatacttagaatgttgttcttgaggcatttctgaagaagatatctagtaagcagtaggatagccttctatagatttgggaatcatcaggggagttaaacccataaaaaaaaatgagattgcttgaagggagggtgcataatggcaagagtgggtggctaagggctgaagcctaaaggatgctagcattaaggactagacagaaattgttaggttctagagcaggggtccccaattcccgggccagagactggtctgtgtcccattacgaactgggtgatacagcaggaggtgagtggtagacaggcaagtgagcattactgcctgagatctacctcctgtcagatcagcagtggaattagattctcataggtgcatgaaccttattgtgaactgcgcatgtgagggatctagattgtatgctccttatgagaatttaatggctgatgatttgaggtagaacagttcaaaaccattccccctactctccatggtccatggaaaaattgtcttccatgaaaccagtccctgttgccaaaaaggttggggactgctgttctagagaatgggaaagtatgattggggagtgcagagattgaagcgaagaaagctgagggagggagggagtttcattaagagcaagtatttctctaacagtgtcaaatgcttcaaggaaggtcaagtattagaacaaatgagaaaagtcttttgtttttatcagttggtcatttgtggctttaatcactgtagcttaaatatgattagtggacacagaagcatatagaagctgtgttgcaatatatttgaaagacgaggctgggtgtggtggctcacgcctgtaatcccactttgggaggccaaggtgggcggatcacctgaggacaggagttcgaaaccagcctgggcaacatggcaaaaccccgtctctactaaaaatacaaaaattagcccagctgggcacctgtaatcccagataatcaggaggctgaggcaggagaatcacttgaacccgggaagtggaggttgcagtgagccaagattgcgccactgcactccagcctgggcgacagagcaaggctccttctcaaaaaaaaaaaagaaaaagaaaagaaagatgaggaagtgtaaatactggtttagacatgcttagctgagaacactgagcatattttactaaataatagttgaggatcttttcagccctaaacattctacagttctttgcataattaaagtgtcccaaatgttcagctactccaaaattgtaacattgatatttaccatatactgcccccttcataatacacacacataaaattatagaattaacaagatcttaagagattgacctaattttatgctgtgaaagtggtgatttttaaatgtatccaggatcttagtatcctttcttcttgaaggtctctgtaaagaaaaatcatctgattctttacttgagttgctaagtatcttattgtctttaatttgaaaatgtttaatatttggttgtaataatgttttcttaaaacaataccattttgttgccagtttatatagtttctcctaaaaataatgccactattttattgatatgtagttttattagtaaataagtatatctgttctataactataaacttattgattgtgaatacatattttcttaaagatttaagtaaaatgtaatttcttataaaccacagtcttatttgagggaatgtagagacaagtgggaggcagtgtatttgaagatacatttaacttgggagatggaaaacatttcattttttctttttttctcccttcattgcttaacacattttcctatttttatcccctctaggactgttatgaacactatccaacaattaatgatgattttaaattcagcaagtgatcaaccttcagaaaatctgatttcctattttaacgtaagccatatatgaaacattatttattgtaatatcttggcaaagaaacttgaaattaaaagttaaagtactgagttctttttaaaatactaatctcctatctaacatgtagttatccataatcttttcttgcttttttaatcttacaaattatatattattagtagtattgttttatttatacagtgttatttaaaacatttttatgtttacctatttgccttgctcaccattcttccttgcaacttatgcctcacttctgagataatttttttcttcttcagatatatcctttgataattactttagtggtattaatttgggatgaactttttgaggttttattttgttttttgatctgaaattttctttacccttatttttttgtgagatagctttgctcgatcttcaattccaggttgacatttactttttagactcttataagtttgaagataatacattacctggatcccatttttgctaattaagaagtcttatgccactcaatctaactgttgttcctttgtagttaatctgtctttttctctctggctacttttaagatcttttctttgaatgtagtattagataggacttaacattccccatacccctacaatctttttcatccaatatttaacccatttttatttacaattcttacctggccctgttagcattatagtttgcaactcctgatagacaataagtttaatatctgaaggcatctgataccctctctcccctaaagacaaggagaaagaaagagagagaatgaaactatcatctatattgcttgcttgctccttcactccttacttaaactcagatgaggattgggacccactgaaatgctcatccactaaaattggacatagggtcaggagacttattaaaatttggcttatttcagcaactgtgctttttgtacttgttaacaattcattcattgccataacctgcctgtgattttgtcataatctgttgtcatctcttgctatgttcccccaggaattagcaaagtaatttctgtcatcatgttcgtaattgttttggctcagaattgattttgtttgtccaatatgcataaagtcgcttttgtttatgagttatctatagcacaagaatatatgccaaaacatatgtaccccaattacctaaaccttttagcaagggctaatgaaagaatttaaaagaatgataagccctttcttctcatatcattttgaatacttcctccaatatttggagtatgtaggagttcttttttatttaaaaaattctgcctcaaagacttttttttaaacttggaaactatatgatctttttttatgtttttatacagtttttcaaccctcgctctcttccttccctcctccctctagtagtctccagtgtctattgctgccatctttatgtccatgagtacctgatatttagctcccactcattagtgagaacatgcagtatttggttttctttttctgtattaatttgtttaggataatgacctccagctacatccatgtggctgcaaagggcataatttcattctttttttatgactgtatagtactccatagtgtataagtaccacattttctttatccaatccaccactgaagggcacctaggttgattccatgtctttgctattgtgaatagcataccagtgaacatatgagtgcatgtgaaagacattttctagagctcaatttaaagcttaacttttaatgaagcttaaaagcttaattatgtagatgataagttgcatatgtcaaagtgaacatgtcttgaaggtcattatgtttttccttcattttacttccttattagttcaaatttcttcatttttaaaattaatgccaccttccctccatgtaaaatcttagaagctatgaacattttaatggacattttggcaacaattcttttatgacaggaaatgcttgtttgttatatgtttctaagtttgtgtgctgttttttttttttaggaatatagaattgctgatattctagaatgtgaaaatgtcgccagacaatgcacattacaatgaaaattataatcttatttttatttatatatatatatatttttgagacagagtttcactctgttgcctaggctggagtgaaatggcatgataattggctcactacaacctccatctcctgggttcaagcgattcttgtgactcagcctcccaagtagctgggattgcagaagcctgctaccatgtccagctaattattgtaatttttgtggagatggtgtttcacaatgtttcccaggctggtctcaaactccagacctcaggtgatctgctcacttcagttttccaaagtgccgggattacagtcatgagccactgtgcctggccataatcttaattttagaaactttatttttgaatgtatatattgaatgtgttttatgtataaaggataaaaaatagaataaatctttgtagctgatgagaatcatgctgtgattactttttatatatcataatatgaattatataatattatataatatgcattttaatacatcatcttgtgatgtgttttaattattaaagttgaatagccccactccaaatgatacatgtattggaacttcttttgcaacaatttccctatcttgtatttctgaaaatgtaatcaaatgatttagctaattcataactctttcaaagcacgttttaaaattaggaaatggtccgggcatggtggctcacacctgtaatcccagcactttgggaggccaaggtggttggatcacctgaaatcaggagttcgagaccaggctggtcaacatggcaaaaccccatctctactaaagagacaaaaattagtgaggcgtggtgcgcttgcctataatcccagctacttgggatgctgaggcaggagaatcacttgaacttgggaggcggaggttgcagtaagccgagattgcgccactgcactccagcctgggcgacagagtgacacttcatctcaaaaaaaaaaaaaaaaaaaaattagtaaatgataccaagctcaagccttggttttatttcatttgctttttcggaagcaacatacatcccaatataactcttaattgaaggtattttatgagaatgtatgaggctctttctgatggatggaaagcttaacaaatttgctcttctctagcctagtggcagaaaatttagataatagggttttttagttgtactgtagtattttttgctcattaacatccagtgaaatgatattgtctgcttatgttcagtagttgtggttacctagttattatggaagtgtttccacatttttatgaacaatttaaaaagtcatatattatggagcagaaaatattaattctgattacacagtatcctcgacattgatttctgtttttacctcctaaagaactgcacagtgaatccaaaagaaagtatactgaaaagagtgaaggatataggatacatctttaaagagaaatttgctaaagctgtgggacagggttgtgtcgaaattggatcacaggtaacttgaattcattgtaattcgtggtactatagagtaataatattaaaagcagcatctttccagttcgtataaatactctaacagtatttgtctagtagtataaaatactgtcagatactatatccctgctgcctgtgtatgctgctatttatgggtaactttatggaaaactacctcccaccccattataaaaactatgtaataaaggaacacatagccattgtagaaattttggaaaatacaactaagaaaaaaattgaaatctttgatattaaatttttgattttgctttgacttctacatgtatgactgttcatgtatgcatatcctaatgtgaatgggactatacatgccatttgtcagtgatattattgagtgatattatttcaggaaatctaaagctaatataataggtaagagtatgggccatggagtgacagccctgggtttatatttggttctaccattgttgatcttggacatgtcatttaacttctctgagattcaggttctatatttgctctgctttgttgtgtggcattaatgaggataatatacaaaaatatattggaaaactggagtccactgtacacatttatttcagtgtagtgaggttatattttgatgccatcagtgttttaaacattgatatttaatggttctttttgattctacagccatgcaccacttaacagggatatgttctgacaaatgcatcattaggcaattttgttgtgtgaacctggtagagtgtgtctgtacaaacctagatggtatagccgattgtacatctaagctgtatgatatagcctattcattcctaggctacaggcctctacagcatgtgtactgaatactgtaggtaatggtaacataatgtgttaccatttgtgtatctaaatatatccaaacatagaaaaggtaaagatatagtacaaaagataaaaaatggaacatttgcacagagcacttactatgaaaggagcttacaggattgaaagttgctctgaatgagtcagtgagtcgagtggcaagtgaatgtgaaggcctacaatattacctatgacatgactgtacactatcgtagactttataaatactacacttaggctaaactaatttcataaacattttttctttcttcagtagtaaattaaccatagctcactgtaacttttttactttataaatcttcagtttgtaagaaacttttgactcttataacacttagcttaaaacacaaacaccttatacagctgtacaaaaatattttctttctttataatccttattctgtacacttttttctatttaaaaattttttcaatttcataaagatttttgccaaaaacaaaggcaaacacacacattagcctaggcctacacaggatcaggattaacaataccactgtcttctgcctccaaattctgtcccaagtcttcagggacaataaaatgcatagagctgtcaactcctatgatgatgatgctatcttctggaatatctcctgaaggagctgcctgagggtgttttacatttaacttttttttttttttacaagtagaaggaggatgctctaaactaataaaaagtatagtataataaatacataaaccagtaacatgttcattattaagtattatgtactgtacataattgtatgtactatacttttatatgactggcagtgcaataggtttatttacatcagcatcatcacaaagatgtgagtaatgtaatgcattgcactacattacactaaacaataggaatttttcagctccattataatcttatgggactactgttagatatgcagtcagttattgaccaaaaacgttgttatgcggtgcatgattatatatgagatttttgctcttagtttggaaggaaataatatggtgtgtgtttatatttctaaaatttggttattctttcaaataatgggaactagttatttggctaaaacttcttgctcataaggtcagtttgatctgatttttgcctgtgtcagttttactaaatttatggacaaagactgtcctcttaatcctggacagctatcttgaaaatacatgtcctaggtcatgagaaatgttatataaggtacataaagtgcttaaaatagtactgggcacataacctatctttagtatgaatgatataaactgaaatggagttaaggaaatccaggtactggacctaccctcttgttaatttacttgggaatgttaatcaccacttaatacttaagttgtgagttttagacaagctagcttttgtgttgtcttggcggccatatttgtaagaagggtgagaagtatgttttaagaaaaggctttttaaaaaattttagtaattgtcagctgggtatagtggtacatgcctataatcccagcctcttgggaggccaaagcaggaggatctcttgagcccaggagtgtgaaggccagcctgggcaaaacagtgagactccatctcaaaaaaaaaaaaaatttcataattgtgattttctaaaatagcaggctcttatttttctttttgtttgtttgtagcgatacaaacttggagttcgcttgtattaccgagtaatggaatccatgcttaaatcagtaagttaaaaacaatataaaaaaatttcagccgggcgcggtggctcacgcctgcaatcccagcactttgggaggccgaggtgggcagatcaggaggtcaaggcatcaagatcatcctggccaaaatggtgaaaccctgtctctactaaaagtacaaaaattagctgggcgtggtggtgtagacctgtagtcccagctacttggcaggctgaggcaggagaatcccttgaaccagggaggtggaggttgcagtgagccaagattgtgccatttcaccccagcctggcaacagagcaagacaccatctaaaaaaaaaaaaaaaaaaaaaaaaaattcaatgctgacacaaataaggtttcaattaaacaacttctttttttttttttaaattatctgtttcaggaagaagaacgattatccattcaaaattttaggtaaattttttacttttagtaaaaaatttttttctttttatagaagtaagtattttataatctttttttttttcctttagcaaacttctgaatgacaacatttttcatatgtctttattggcgtgcgctcttgaggttgtaatggccacatatagcagtaagttaaattttcataaataaacacttttgttcaatttaaagttaaaatgtggtgtgtttctttggtcgggggagagggatagtgtgaggttaaggagaaggaatgcttattttagatcactatatactgaagaatgtaattggtcattataagccatttaagaggcttatttgagttatttgaggccatcttggggataatatttcactaggcttctcttctgagtatactggtatactgaatccaaaaaaggtactttttgaaatccctccgaagacctttgagattgtagagtgccaaaggagtattcaagagtggcctctactgatatggaagcactgctgtaacctccatggttatgaaactaaagattgaagctagaatccactggataaacagaacaaaggccaattacaatgtttttaaaaacataaatgtatatcactttgcaaattatgttgcaaatgttaaaagaaagttttgcttgcagaaacaaaaggaacatttgtataaggatgcaaaacacagaaaaagaggaacttttagtttccttattagtaaacagataaggaaaactgtgaatcctcatttataaccaagaaatgcatattttaatgagataccattttgtaactaatgaaattagcagaatcttgaagaatctgtctatcctcttaccaaggattaatgagaattaaaatagatatgccaatggctgataagatactaaacctgttcctgatataagtttagggtatttaaatctttgaaaatttgagatcagctataagtcctttctctaggaaaaacacagatttgcttacactcaaaattggaaggctatttcctatgagtccgtagactccaaaataaaaaattctgctctaaataaaaatggtttaacctttctactgttttctttgtctgataataacttccaaaaaaatacctagctcaagggttaatatttcataaatagttacttttttttttcatttttaggaagtacatctcagaatcttgattctggaacagatttgtctttcccatggattctgaatgtgcttaatttaaaagcctttgatttttacaaagtgatcgaaagttttatcaaagcagaaggcaacttgacaagagaaatgataaaacatttagaacgatgtgaacatcgaatcatggaatcccttgcatggctctcagtaagtagctaaataattgaagaaattcattcatgtgcatatggctaacaaattattgttagtgagaggtgtttcttaacatctacctcaagaacatatagggaatttaatgaataatgttatttcagtctatagcccaaggatcaagtggaatattagaatggagctttaatcgagcaccctaaaccatctaatacagcacagtgatttatttaagaatagcttttcttaaaacatgccactttaaaacaaaacggattttttttttatactttaagttctagggtacatgtgcacaacgtgcaggtttgttacatatgtatacatgtgccatattggtgtgctgcacccattaacttgtcatttacattagatatatctcctaatgctatccctccctcctctccctaccccatgacaggccccagtgtgtgatgttccccaccctgtgtccacgtgttctcattgttcatttcccacctatgagtgagaacatgcagtgtttggttttctgtcttggcaatagtttgctcagaatgatggtttccagcttcatccatgtccctacaaaggacatgaactcatccttttttatggctgcatagtatatatgtgccacatattccatggtatatatgtgccacattttcttactccagtctattattgttggacatttgggttgcttccaagtctttgctattgtgaatagtgccacaataaacatacgtgtgcatgtgtctttatagcagcatgatttataatcctttgggtatatacccagtaatgagatggctgggtcaaatgctatttttggttttagatccttgaggaatcgccacactgttgaactagtttacagtcccaccaacagtgtaaaagtgttcctatttcttcacatcctctccagcatctgttgtttcctgactttttaatgatcgccattctaactggtgtgagatggtatttcattgtggttttgatttgcatttctctgatggccagtgatgatgagcattttttcatgtgtcttttggctgcataaatgtcttcttttgagaagtgtctgttcatatctttcacccactttttgatggggttgattttttcttgtaaatttgtttgagttctttgtagattctggatattagccctttgtcagatgggtagattgtaaaagttttctcccattctgtaggttgcctgttcactctgatcgtagtttcttttgctgtgcagaagctctttagtttaattagatcccatttgtcaattttggcttttgttgctattgcttttggtgttttagtcatgaagtccttgcccatgccgatgtcctgaatggtattgcctaggttttcttctagggtttttatggttttaggtctaacatttaagtctttaatccatcttgaattaatttttgtacaaggtgtaaggaagggatccagtttcagctttctacatatggctggccagttttcccagcaccatttattaaatagggaatcctttctccatttcttgtttttgtcaggtttgtcaaagatcagatggttgtagatgtgtggtattatttctgagggccctgttctaaaccaaaacagaattctttaaagtatttagataatttatttaaagtacagttgttatatatttgaaaatgcaaatgtctgctcttaaattgtgagattatgctatttagattattaaaaagtgcatttttttcttgttaaatatagtaggattcattttttcccattattaaagtataaaaatgtatactattgttcaattataggtattggttcaatcaatataggggcacaaattatattgtctaggattctctttatagcattataactattgataaggcttttgttttaataaaagtggcaacttgaggttatgctcttcaaatcaacatagttggataatactttgtgaatcatcagttttgtaaattaatggtttcttttgaaactgtgttgcatgctaagtatatatcttttaatttgtatcagtatatagaagtggtaattaaaaaattaagactttaggtatgccataatcctaatttgcacatgtaaccttagttttaatttccttacgttttgaatttttaatgactaagcgataatttatttcttagtgttttcttgtattgccatatagacagagtgaatagaggagagaaacatgggaaattgatagaagaatgttacactcctattattgaatttcataactacttatggaatgaatttacacttgataaggagtacttagaagaaaactttctgaatctgggtaattaagtgaaagtaaaaataaatagataagtaaataaaataagcacatagagtactttttaaaggcttatgtgtcctctcctcccagaaattgatattgagatattcctgtatcatctgaaagtgactattgttatttcttttagagaattaattttatttctatcaacacatatttattgaacatacgccatatgccttgaattgagagagatactgtgaagatacaaaaaagataaaggcttggaaaattgtggaggatgtaatagaaatttactgtttaaaaattgtttgtactcaagcctgtttagctcagttatttagggcttctaaacaatattcctttatttttgagaatttttggagaaaaagtgacaagccccaaatctggaaaagagtatgattgatttacaataggagacgtggaagtcataagcctctgaatttaaatattaaatgtagtatctctggcagatgaaactatagaggacttttatttagtcatatatttttagtgtttgagtcttatattacatttttaatcataaaaaccttgagtggtagtggataactttgtgaagataagttatgccacacaaacaggatactgtgtatttttcctgtgagaataattgacattatagagaagggatatggcatagatacatttgcgttttcacagacttttttttaaaatttgaaatataacacatattaagaaaagtatatatctcaagtgacagtttggtgaatttgtcacaaattgaacacatccgtgtaaacaacacccagataaaggcccagagcaagctttcatagtcttttgattctgtgtcataataaaaaattctcgttaaaactgtagattgataggaacatattcacacagagttgttgactgagggaaatttcaaatgaggtgctgcttacttctctcctgccaataatttaatgaaagaaagaacatcatcttatttttaatggttgtgtggggaactgggttcagcatttttgcttgacagccttgagataaaataaatccataaggaaaaagcccacttctgtttcttttcatcccagagagattaatgggcaatatatgagtgtaagatactggaaaagtctgttgagaaacctagtgaaatctcattctctgaaaagttgggggattacaggtgctatcgaatgcatcatacctaagggttagatgaaatgacttccaagagtttggccctattaaatctgttaagaggtttataatgccagcaggtgatgaaatgaaatttggatgccttagtttcagtattttcagaatttatcatattttttcaataaatgtttataaatcaaagtatgtcagatgctttattccctatatgatctgtctttcctggactattctggactcttcctattgatctctcatttgctaccttgagaccatttctctcacagcagccagagaaatctgctcataatgtaaatctcatcatgctaattcctcaggtaaaaaacctcctgtggaggacatattcatctggtaatgttggaagaagaccctaccatatggctttctgcaaaaaagaccactatactacctgtttggaatacaaaaagtaactgactgaaattactggacaggaagaacagatgctagttgagaaagagaagaggggagctgggagcctgaggagaaggcttttagtctagggctaagtgcagtaggtatagggaaggacagtaaggtagggcagggatgtcagtgggaaaactatgggtctcttcaccaggaaaactggaaaattgaagctagggaaaccttggccactgaagagagtggaagaatcctgcaagggaaagagccaagaaagggtacccagattctgtctgaaatctgaataattcctgtgtgtcacagactcagagcagccaaatgaagggcaaaagatctgaactgaaactggagttgctgcccaataaacagaacagttcaagttaagcaaagataattgcttcttacaacaaaaccattctcattttagaaaaataacagaatttaggatcttcacaatgtaacatttatgatgttcaggatacagttctaaaattatccagcatagaaagaaggtcaaagaaaccaaatgctggtttatagaataggagctttaggccaggtgtgtggtgcacacctaatcccagcattttgggaggctgaggtgggaggatcatttgagcccagaagttcaagaccagcctgggcaacaaagcaagaccccatctcttaaaaaaaaaaaaaaaaagctaggtgtgatggcatggtggcatgttcctgtggtcctaggtacttgggaggctgaggcaacacagcgagactctgtctcaaaaaaataaaaaataaaaacaaaaaaactagaatgggagctttaagttaactttggttaggcattgctaaatgatggggatacattctaggaaatacttcatttaggcaactttgtcattgtgtgaacatcatagagtgtgcttacacaaacctaggtggtatagcctgctacacatcagggtaggaatagcctgttgcttctagactacagacctgtatggtattttttttttaatctccactcttgagtatgtctttttaatattcaatgtgatgaaactgaagtatgtagaaagttgcataccaaagtatgatagctgtcttgaggaaaaatacttattttattggttgagttgtgaactgaacccgtcactcttttcgtgaaacacatgtgttacttgtaagactgataagcaattgtgtttatttatgcttgggtatgtggtagattcttgaaagtgaacaaagtgagcctgtcatttcaaagaaaacaactgacagtaaaggttgccaatgataaattttgtgttttcaagtaaaaattagaattttagaaacttgtatccaccactgaaagcttgacagagtcctaatatataaaatacttttctgatgaaatcggtggtgatatcaatgaatgtgagagatttgtaaacatttacaagaagtacataattcagtgaaccagtatttccaaatgaccaaatacatcgttataaaatcattcacgggtaagatattcattaaaagttcaagataaaccaatggattttaaagtcttaaaatacgaaaaatttatttcggttcattgagattgtttccagttccgccctgcaactaacctttaagaaactatgacttgtcgagttttggcgtagtgtcagaaaacagtaaccataattatctgaaaaggttattaaagtactcctcctctttccatatgaggccagatttttctttgtatacttcaacctaaacagcatattgcaacaaagtaaatgtagaagcggataggaaaattcagctctttgctgttatgccagatagtgaagacattcagaagatcataaaacagtgctattgttctatcttttttgttttgtagaatatggttatttttcattaaaaattatttatgttaacataatgggtttattaagataaatatttttaaattttctcaagttcttttgagccctcaacatcctttaatgtaaaaaagctattagctactttatgcttcctaatggaagaatatataaccaccttgaaaacatgatgttgaaagaagccagtcacagaaaaccacatattgtataaattcatttatatgaaatgtccacaagaggcaattcagtagagataggaagtagattattggttttctaaggctggtggggaggactaggtgttttgaggatgatggctagagagtatggtttttctttttgagataatgaaaatgttgtaaaattgactcattattgtagtcaattttataacacttttatcatctctgtgaatatactaaaaactattgaattgtacacattaaatgggtgaattgtataggatgtaattttttaaatttctgttttaattaaattttaactaaattaagttttaattactaacaaagtaaatattaatagatttaacccacacaaacaaaagcttttggggtccttagtaattttaagaatataaaagggttttgagtccaaaaagtttgagaacccttgcctgtattctcttccccactcagacttgtctttcactcacacaaccatgtttgtttttgcctgtccctgagtcttgaaatgctttcctctgcctttttcttgaccagattttaaggtccattttgcctttcctgatcatcctagtctatagtcattcttccctcatttagtcttaaattgtttattatctatatacttaactagtcatttataaactttgttttactatatgtgcatatctcatgttaaattcatgtaaagtacttaaaacaatatctgacattgtattataaaatgtagcagttaattacataagggtaaagaacagagaggagtcaacttatgatgacatgcaggtttctggcttgtataacttaagtggatagtagtgtcattcattaaaataagatacctaggattgaatgaggtttgcttgggaagatgaatttcatttgatgagttttaagtaattataggtcatttcaatagaggtgtcaagtagcagttggatatgtgtgtctggaacttaggaaagaaatctaggctaagattatggaccataaaaaatgccacccttttttgacagtttatcttgtgccaggcactttggtgagcacttcttaaatttaattttcatcataatccatgaggtagtttaccctagatcaggaaatgaatgcttagaaaagtttaataacttgccctagaccacacaagcaaaatggcaagatctgtgatttgaacccaggtctttctggctccaaagctattaatccttatgctttgctgagtaactgaagtttggagaagggataagatcacttaaggggagaatatagtatgagaagagaaggaggctaaagatagaattctaaggagctctaacatttaaaggatggacagaaaagagaagcctgtgcctacaaaagagattgaaatagaacagccaggaagataagaagaaaatcaggagaagtggtatcatagagagaccgaccaggtgcaatggctcccgcctgtaatcccagcactttgggaggctgaggcaggtggatcacttgaggccaggagttcgagactagcctgaccaacatgacaaaaccctgtctctactaaaaatacaaaaattagctgggcctggtggtgaatgcctgtaattctagctactcgggaggctgaggcatgagaatcgcttgagcccgggaggcggaggttgagtgagccaagattgtgccactgcactccagcctcagtgacagagcaagactctgtctcaaaaataaaataaaataaaattaaattaaattaaaaactgaaaaaaaggaaaaggagagagagaacattacaaagtctgagtgagtgcttgctcactcagacttttcagataggagctgaaaagttttagcaacaatgaagtcactggtgacagtgacaaggactgttaaatgaaggggtggggataggatgagatctgaatgagagataaagtggacacagtcaaatagatggcttttatcaaaagttttgcctgtgaagagaaataaagatataacagaagtaaagatacagcttgatgtatgtgaagtagagggaatataaacatattttttaaatcagaaaggtagggtttaaatattgatggaaaagagccattagaagtgttctctattgctggataacaaattagtggctttaaacaaatattttattttgcttatgattttttgggtcaggaatttgggttgaacttgactgggtggtttgtctccgactatgtgtcagcaggtgcctggagctatagggtccacttccaagatgcttcttcactcacaggtctggcatcttaccgctccttggtgcacactcagctctcttcctcccatcctccctccctagagtggttagaatgttaagctttggagttttcacctgcagagagaagataggagattcatagtgaaagtagaggttttaagaaacaggatatttggcagggtgcagtgtctcacacctgtaatcccagcactttgggaagccaaggtgagaggattgcttgagcccgagttcaagaccagccttggcaacatagggagaccctgtctctacagataatttttaaaattagccaggtgtggtggcacacacctgtggttcttgggaggctgaactgggagaattgcctgagcctgggatgttaaggctgcagtgagctgtgattgcaccacagcacaccagcctgggtggtagaatgagatcctgcctcaaaaacaaacaaaacaagcaaacaaccccaaaacaaacaaacaaaaagtaacaggatatttcattaaataattcattcattaaataatgaagttgaacgtaatgaatttaatgaagtttaataggtgtagtgggagtaacaatgagaatgaaagtgtaggaggttgtagtcaaagagttgtttcaccttagaatttctggagacagaacatttctgggtagtttactgtattttaagaaatgatcttgggagtgcatgaggatcctggccaaggagccagaaagtacagtgagcaagagtccaggacatgtagcaaggaggaatgtgactgaaataaagactaatgtcttcagtgcttgaggggagtaaccaggagacaagtgggactaaatggggcagagggctagagaggtcctgaaagcaaaactcctggctcacttaaaaaaaaactaatctctctctcaatacctaatctaatgtctaacatatagaatttaggtgcataaagcattagatttgtaatgtcctttgatgaatttacctctttaatcattataaaatgaccctctctttatccctcgtaatattgtttgctctgaaaactacttgtgcctgatactagtgaagccattccagctttcttcccattaatatcaacatggcatattttccccattctttatttaacttatacgtgtctttattcttaaagaagtgattttcttataggcagcatattgttgggtgttgctttcttaaatcttgcctaacagtatctgccttttaattgggatgtttagatttaaatttaatgtgactattgatatggttgggtttaaattctccatcttattattcattttctatttgtctcatctcccttttcctccctttcctctttttctgccttcttttggattgaatttttaaaattctgttttatcttctttgtaggcttactgtctatacttctttattttgtaattgttttttgatttataatatgaatctttaatctttaatagtctttctttaaatagtattacactacttcacatacagtataagaatcttagaatagtatatttccattttcccttttccaacctttgggctgttgttgtcatacattttgcttcgacagaagttataagctctacaatacactcataacttttgttttaaaccaattatctcttaaagagaattcaaaacaagagaaaaaagatgtttttatttgattacatatttacctttccagtactcttcattccttgtgtagatccagattccttttgttttccttctgactgtaaaactttttttggccaggggcagtggctcatacccgtaatcccaacacttagtggggctgaggcgggaggatctcttgaagccaggagttcaaaaccagcctaggcaacaaagcaaaactctgtctctattcttataaaacaaacaaaaagcatttctattttttttttctttttgagatggagtctctctctgtcacccaggctggagtgcagtggcgcgatcttggctcactgcaacctccacctcctgggttcaagcgattctcctgcctcagcctcctgagtagctgggattacaggcacacgccaccatgcctagctaatttttatatttttagtagagaaagggtttcaccatgttgatcaggctggtctcgaactcctgacctcgtgatttgcctgcctcggcctcctcccaaagggctgggattactggcatgagccaccgcacccagccaacaaaaaacatttcttgtgtgcatgtctactagtgatgaattcttccagcttttatgtctggaaaaaaacattttacctttatttttaaaaggtcttttgctgggtattgaattctaggttgacagtctttttgttttttctttgagtgctttaaaaatattgctccactgtcttctggtttgccttgtttctttttttcttttttttgagatgaagcctcgctcttttgcccaggctggagtgcagtggcatgatcccagctcactgcaacctctgcctcccaggttcaagcgattcttctgcctcagcctcctgagtgactgggactaaaggcacatgccaccatgcccggctaatttttgtatttttagtaaagatggggtttcaccatgctggccaggctggtctcgaactcctgatctcaggtgacccacccaccttggcttcccaaagtgctgggattacaagcatgagccaccacgcctggccttgttctttttttgctgtatctttttcctgcaggtttttctttctgtatttcatgttgaataccttctaaagctatgtcttcaagtttattaatttttttcttctgaggtatctaatctgctattaatctcatttattgtatttttagtcttactatagttttcatttctagaaatttgatttgggtcctttttatatcttccatatctatttttattatgtttatgcttttctttaccttcttgaacatatgggatataggtattataactttttaaatgtccctgttactaagtctagtacctatgtctttttaggtctgtttctcttgactgatagttctctctctctctctcttttttttaagagtcgtatgtttctgcttttttgactgcttggtgatttttttgttaggtgccagatatcatgaattttgctttagtgggtcctggatatttttgtattcctttcactattttgacctgtgttttggaacacaattaaattatctggaaataatttgacttttttaaggcttcatttatttatttatctggtttttgtttttggacacagagcagtctttaatcaatagccgattttccttcactatccaggcattgctcttctgagtactctactgaatatcccatatatgacaaggtttttccactctggctagttgaaagcagaactcttcctgaccctgtgtcagctcctggaaggattctactccttcccatggttcttccctggttttgagtagtatcatcacatccatgcactgatcagtactcagctgaagactcaagcttaaccctctgcagacctctggagttctctttttgtagctttcttctctctagtattctgtcctgctaattttagtttgccttggcatctcccatttcttaactctgtttcttcaactgggggaccactgggctgcattccagtttctcatctctggactgtggaccataaactgtccccaggcagtaagctgtggcaataatgaggctcaccatttgttttccttctcccagggattgctgttctgtactgcctgttgtttattgtgtaaaaagaattcttttatttatgttgttcaattttgtggttgtttaaacgaatctggtccctgtttcttcatcagagctggcagggttactaaacgtaaggcttagtgattgatgaagtatttacaaatatgaaatatgtacacttacagaatatttagggtatcatttccgcttccttgtgttaaatgcatcaggtcttctgactgatgcattatactgtttcagaggggtgcttactatatggagaacatagaagtactagttattaactatttttttgtattaaattttggtacgtcacataaacattgagtctcctttaaatgtgtcaaatgtagctgacttactaattggattctgtcatactctttttctgtggtcaccaaatattagcaaatttcttcattcagttacacaagtacttggccaacatacttttacataagaaaatacttaggatgggctggcaagatagccaaataggaacagctctggtctgcagctgccagcgagatcaacccagaaggcaggtgatttctccatttccaactgaggtacctggctcatctcattgggactggttagacagtggatgcagcccacggagggcaagctgaagcaggatggggcatcacctcacccgggaagcacaaggggttggggaactccctcccctagccaagggaagctgtgacagactgtgtcatgaggaacattgcattccagcccagatactatgcttttcccacagtcttcgcaacccacagaccaggagattccctcgggtgcctacaccaccagggccctgggtttcaagcacaaaactgggcagctgtttgggcagataccgagctagctgtaggagttttctttcgtactccagtggtgcctggaatgacagcgagttagaaccattcactcccccggaaagggggctgaagccagggagccaagtggtctacctcagcggatcccacccccatggagccaagcaagctaagatccactggcttgaaattctcgctgccatcacagcagtctgaggtcgacctgggatggtagagctaggtagggggaggggcattccccattactgaggcttgagttttcccctcacagtgtaaacaaagccaccaggaagttcaaactgggcagagcctaccacagctccctaaatccgctgtagccagactgcctttctagattcctcctctctgggcagggcatctctgaaagaaaggcagcagccccagtcaggggcctatagataaaactcccatctacctgggacagagcacgtgggggaaggcgcagctgtggacacatcttcagcagacttaaacattcctgcctgctggctctgaagagagcagcagatctcccagcacagtgctcaagctctgctaagggacagactgtctcctcaagtgggtccctgacccctgtgcctcctgactgggaaacacctcctggcaggaatcaacagacacctcatacaggagagttccagctgccatctggtgggtacccctctgggacgaagcttccagaggaaggaacaggcagcaatctttgctcttctgcaacctccactggtgataccaggcaaacagggtctggagtggacctccagcaaactccagcacacctgcagcagaggggcctgactgttagaaggagaactaacaaacagaaatgaatagcatcaacatcaacaaaaaggacgtccacacagaaaccccatttgaaggtcatcaacatcaaagaccaaaggtagataaatccatgaagatgaggaaaaaccagcacaaaaaggctgaaaattccaaaaaccagagcgccttttctcttccaaagaatgacaactcctccccagcaaggggagtttgacgaattgacagaagtaggcttcagaaggtgggtaataacaaactcctccgagctaaaggaccatgttctaacccaatgcaaggaagctaagaactttgaaaaaaggttagaggaattgctaactagaataaccagtttagagaagaacataaatgacctgacggaactgaaaaaacacaacacgaggactttgtgaagcatacacaagtaccaatagctgaatcgatcaagcagaaaaaaaggatatcagagattgaagatcagcttaatgaaataaagcgtgatgacaagattagagaaaaaagaatgaaaaggaatgaacaaagcctccaagaaataggggactatgtgaaaagaccaaacctatgtttgattggtgtacctgaaagtgacagggagagtggaaccaagttagaaaacactctacaggatattatccaagagaacatccccaacccaacaaaacaggccaacattcaaattcaggaaatacagggaacaccacaaagatactcctcaagaagaggaaccccaggacatataatcgtcagattcaccaaggttgaaatgaaggaaaaaatattaagagcagccactgctcaaggaaataagagagggcacaaacaaatggcaaaacattccatgctcatggatgggaaaaattatagcgtgaaaatggccatactgcccacagtaatttatagattcaatgctatccccatcaagctacctttggctttcttcacagaattagaaaaaactactttaaattttatatagaacctaaaaagagcccatatagccgagacaatcttaagcaaaaagaacaaagctggaggcatcacgctacttgacttcaaactatactacaaggccacaataatcaaaacagcatggtactggtaccaaaaaagataaataaaccaacggaacagaacagagacctcagaaataatgccacacatctacaaccatctgatttttgacaaacttgacaaaaacaaccaatggggaaaggattccctatttaataaatgatattgggaaaactgactagccatatgcagaaaactgaaactggaccccttccttacaccttatacaaaaattaactcaaaatggattaaagacttaaacataacacctaaaaccataaaaaccctagaagaaaacctaggcaataccattcaggacataggcatgggcaaagacttcatgaccaaaacaccaaaagcaatggcaacaaaagccaaaattgacgaatgggatctaattaaactaaagagcttctgcacagcaaaagaaactatcttcagagtgaacaggcaacctacagaatgggagaaaatttttgcaatgtatccatctgacaaagggctaaagtccagaatctacaaggaacttaaacaaatttacaggaaaacaaacaaccctatcaaaaagtgggtgaaggatatgaacagacacttctcaaaagaagatatttatgtggccaacaaacatatgaaaaaaagctcatcaccactggtcattagagaaatgcaaatcaaaaccacagtgagataccatctcatgccagttagaatggtgatcattaaaaagtcaggaaacaacagatgctggagaggctgtggagtaataggaatggttttatactgttggtggcagtgtaaattagttcaaccattgtggaagacagtgtggcgattcctcaaggatctagagccagaaataatatttgacccagtaatcccattactgagcatatacccaaaggattataaatcattctactaaaaagaacatgcacacatatgtttattgcagcactattcacaatagcaaagacttgaaaccaacccaaatgcccatcagtggtagactggataaagaaaatgtggcacatatacaccatggaacactatgcagccataaaaaaggatgagttcgtgtcctttgcagggacatggatgaagctggaaaccatcattctcagcaaactaaccaggaagagaaaaccaaacaacacatgttttcacttataagttaaaactgaacagtgagaacacatggacacatggaggggaacatcacacaccggggcctgtcagggggtgcgggtctaagggagggatagcattaggaaaaatacctaatgtagatgatgggttgataggtgcagcaaaccaccatggcacgcgtatacctatgtaacaaacctgcacattctgcacatgtatcctagaacttaaagtataataaaaaaacagaaaatatttaaaatatatctttcaaattatcttttcaaatttaaatcgagggtcattttatgtatgagtataatttgtaatgaatagcccatagttttagagtcctgattcattgacaaacttataaacaaaattttaagcttttttggtattcttttgaaatgtcaaaattgatgggaagcaaacacaaaagggagaacagtctgtggctctgaaaaaaccaaaaaggatatctgttgtatgtttgtatggtgggtcattaacctttggtgtactttgcagaagtattttaagtatttaccattggacattatttgttttaagttatattttgctgagagctacaactcaggaaggcaagtgaattgtaagataacgattaagccacatttaacactttttaaaagcatgggccaggacaatgaagcagtatgatgccatatatacttttacacaacagccatgctaatataatgataaagcaattatgctatatttttaaaagcttctcatgaattacctaaaataaccatgtatttacttttctttgccagaaagaggaaacattttattttaattttaaaaaattcaattctgaaaacatagctaaagctttaacctttctcactctgacccaatatattcctaatatagctttgcccttgacttccacagctaaatactagtttctcaagtgatttaggagacttgacttcattattcaaaactgaaattatttagcttgttctaaatgcaactttgcttcccactatgtctatttttccattacttttcaaatcatctgggcttaaatactgagcactttctccttttctttctcaatagtttgatagagtcctgtaatttttttttaaagctgtctctcatatttattatattattattttaatatacttcattacacttccctagaacagatcatcagctctctttaagtaatttgtctgaggtcacccagttggcatttgaactcatattggtttgattccaaattccatactggtttctagtaaaggtctctgtcactgtactacattatttctgtgaaatcattcatgctgtttttactacctctataatatatagtcaggcatatgggacagtataaagggagcaatacaaatagtaagttaattttattctaagtgaaagcataatatgtatgtgtattttttatcctgagtaacaagggaagtgttttgcctaggagctaataagtaacaagaaagggaaaagtaacatttgttgactagctcctttgtgcagtgcactgtgactattggtctggcttattcctcaggaagaaggattaaaagaagactttacaaaaatgagcaaactatattataaaagtaaatgctagtatgcatatatgtttcattcatgcaactcctagaaatgagaatttactataagtgttttcagaatccacaataatttaggttgaaattaggtatttggatcaactttcaagggaaggggtgacaatgaggtgaaatagacatctagattgttttcgtagactgaaacattggacctgaggtttttgttgttgttttactctttctctgtttttagtaaaagattccaggtatgcctaaagtcatcttctatacgaatgcaaaaatgtaacgacaaagaagggaaaataaaagaaggcaatatcttaggaataaatattttatagtgacattatttttctgctagtgaactaataatctacaaaaattttaagatagataagcagaaagaatacaaacaaaaaaagatagtaatttaactcatatgaataatcatccactgaaatgtagcaaggatatgctacatatgaaatgtaattagatgattgcttaaagatctaggaatataagctcaatgtaataaaataactttcttcatcattgttaaggattaataaggcattaaatgggttttcatgtgggtcctcatatgttaaaaaggacaacaataagaaaatctaaagaaactgagataacttataaatcaatgcaggtattctgtgttaaatgcttatgtaagcctgagttcttcatccagatctgtttatgattttaaacataaaatcattttcatttctaaacctttgctcaagtaacttgtagtacctgagtcctatgtctgatccctaagtctattcttttctctatgtatctatacccttctttaattttaaaacactctgacatatgaaaaaatgccagagtttactgtagagaaatattcataacttgtctattcatgtcactcctccccaccacaccatccatattatacacattacccattctctttgttcattaattggcaaaagggactaagaaattcaaggatgtccaaaaataaaaaacaaacaaaaatctaacaactcaggaatgtcctgtaggtagctcatagaaacttagtttaggaagtagtgctcatcacttgcttacttctttggaagtttgtctgataattatacagaccagcatcaaaataactctcatttatgtgtgtgacatttcagtgtagaagtaataataggtaatgtttttgcatatgtcctattataggtactgttaaaagtgcttcagtgtattaactcataacttctcacaactctatgaaatagattctgtcatcactgtttcacagatggagaaactttcctgtgtccacaaaactggttggtgacagagccagaattttaactcaggctatctggttccagagactatacttttagcctctatgttgccttttagtgtatattagtttactgtttggtatgtgcattgtcatgattcgtttatttgctcatgttttatctgtgtttgtatttttgtgtttgtgagtgttactatgctatggcaaaaagggcctagactttgaattagcggatcttacttaatattcacagaagcctggaagtgtaaacactgctatccctattttatagataaagagacctgaggtccagagatgtcatgtaacttgctttggtgtggttctgaacaaattatgtctctgtatctcaggtttccttgtatgtaaaatagggataactttcagttgttgtgaggaataaatgagcatttatgagaatagtaattagaaacataacaattaattgttagtacccttcattccttttcctctgctatacagtgatttcataagaacagagaaccgaggattcagttacacagtattaacctgtttatcttggcttactataagtacagagaatttttctcttctcttgaggcacccctcctcccccatcaccttctcaaaatggaaaaagttcagggggaaaaggcatcatgggactccagcattgttaagtatgggcagtgttcactgttatattacagttggaatttgttatgttgctttagttatgaatcatgtcagtaattaccctgagggtggtgttagttcactattcaagtacaaacaagaagggaagtagcaatggtagaagaatagctaggacatactctctgtacctaacctgtgggatggaagcacatatactcttattcagagaattttataaagagtcatgatgttagataattacttgaatttagttttagaattttcagtttgtaaacttacagtcaaatcttaactggaattgtgaggaagggctctagaattctggatatgcaagaaacaaagaagagaaataggagaaatcgatcctaattagtgtggcttctgaatttctgcagcaaaataaaaggctgttattaattattgagtttactaaaattttagaactactctaaggcaattatgcttcaatcatctaagcttacttacctttaattataaaatagaacaactttttggcatttcatttttccaactatttatagcatgttttaaaaactctgaactgtcacgacccagtctgtttcaacatacacatttgtggtccttggtgttgttactaatttacttaattgggtcttcatattttcagcttttctcagaaatggccaaatatcaaaggtatttttggtgtcttcctgtaagtgctagatttagaacatgataaggaaacgtagaataggaaacagctggatttgtttcttagccttttcaaaaaagccttttcttactttgctaagtttcagtggttcttatctccactaaatataacaacaaatttatctttaagattttgattatattccttaagaattcttcaaagactaacataaatctgtcttgctatcttttaagtctggtcattttatcattatgcccttttcttattttaagataatttaattgtctaaaagtttttaaatttacatattaagtaatgatagtttttatattaggttttatcatttagtttttttcttttaaacattaagatgaaaaaggtggagaagtgaaattacttgtcttttacatgagtcataaacaaaaatgaacataggatacactaatccaatactgaacttactatctgttcttgaaaatataatttttttgcattatctttttcataggaatatcagacacctttaatagtgtacacttttagattggcatctgatttagttgaacccacatattttaacggggtcttctgaaaataaacgtttgcacatttcagttccaatgaagaacaaatggcctggggaagggatggagagtggtaaagaaatcccttgtagaaaacctttttttttttttaaacagatgagtctcactctgttttcccaggctggagtgcaatgacacaatcatagctcactgaagccttgaactcttgggctcaagtgatcctcccacctcagcctccttagtagatgtgactacaggtgtgagccaacacacccagctaattttttttattctttgtagagacggggtcttgctgttgcccaggctggtctcaaactcctagactcaagtgatcctattgctttggcttcccaaagtgctgggattagtcatgagctgccactcttggcctacagaaactatttatatgtgtcctttgctttatttttctttaaatgcaggtccattttttcccctcgttttaggtagctaagattatattgaatcatgtgtgtttcagtctttgtcatctcaggaagtcttatgagaccacaacataaagtatagtaatttttgtccaataattttggccattagcaaaaattacctatatgacatataaatcaaatggtataattttttagtgctaagtcttaagtagtattcatttttatttaaataaattgcttctgttcgtaaagtactatatataaaacctttttaccttttttatatataaaacctatgattcataggttttatgtcctattaaaatatgagctaacaataattggtaaaattagttggaaaattatcagttttaaaagaaaattaaattgaaggttatgttgttagtaatttaaagatctcctgtgttttgatgtaaaaacactattttttagcagcagtcaaagggcttaagtagtatgactttttgtgtaacttggattgtgcaattgcttttaaaaatgaaactatttctcatttataatgagataatggaactcagtgtatcggaagagcagactgaacacacacttctacctcctttctccccgcaaaccctacagaagtgacaaaaaagacacatatcacaggggagtgaaacccagcagtactcagactgtgaagcagaaaaactgtggagggaagtggaggagttgattcatttttttagtataaaaaataaatgatgagtgtattgtggatacaataaagtagagaaaaccacagcacacaacacccccaggaaaggggactggtggaagtgggagtcttagagagcccccaagctcaaagtagcagatacagagagtggggcaataatcaggaaggttttctaaagtgctgtttggcaatggtcctcaaacttgagcatgcatcaaaattaccaggagggcttgttaaaacacatattacagattgctgggcccagtcacaaagtttccagtgtagggtccaagaatttgtatttctgatatgtttccaggtgatactgatgctgctggtctgggtactacactttgtgagcaacattttaagaacatgaaacacctggaccagtcccccatctaaggccatgccagcctatgagaataaaaaaaatgcacctctgtagtcccagctacttgggaggctgaggagggaggattgcttgagcctgggaagttgaggctgcagggagccgtgactgcactactgcattccagtctgggtgacagaatgagacactgtctcaaagaaaaacgaaaaaaaagcaccttcctctttactaatggattataaaaagatgccgtccggacacagcaaccctaagcttggtatgcagagtttaggctgaagccccatgctgttgtgcagtgcataaactgtacagatacaagcccgcgcccaccttcaaattttgtgtacacttacagacacggggctagggtttcctgatggtgccaaagagagaagcagaacagaaattgaagtaaaccgagacttctgtaacagacctaaagaaaaagaaataggaaaggcagttcttcctaggaggaaaatacaacaaagtattgtactggtaggttatgtagttccttactttggtattttcaggtacctcagttcaatatttattcattaccataagaaagaccagaggaaatggaggagagaaaataataaaaaagaacagaaaaaaaaaattccaaaactaatgaaaaccagggggcttcagatggaaagggcccatagtgccaagcatgatgaatgaatgtggatactttttgtttttttttaatgacagtctcgctctgtcgcccaggctggagtgcaatggtgtgatctccgctcactgcaaccgctgcctcctaggttcaaacgattctcctgccttagcctcctgagtagctgggattacaggcacgagacaacgcgcccagataatttttgtatttttagtagagacgggttttcaccatgttggttagcctgatcttaaactcctgacatcgtgatccgcctgcctcggcctcccaaagtgctggaattataggtgtgagccaccccacccagcaaaaaattcagaattctaaagataatgagaaaattataaaagcttccagagagaaaaagtaagctattttaggggaatgagatccagatcagcacagaagttctcattaggaatactggatattttataacctaaaatttgtcaaatatgacagcaaaatgaaatttggaaatgcaaggactcagaatgtttatcttttgactgcccttttgaaatgaaattactagggaatatgctttaaaaaaatgaaaaaagaatccacaaaagggaaatcataagacctaataaaaaaactgtcacaccagagcagagagaaaaatgcaaaaaatcctacgatgcaacaagcccagaaaatgtttgttccacatgagaaatcagatagtttcataaagaatgccttcaacaacaaaatggtttcttttaacaattgtataacctcatctaaatggtgggaatttaacaaatacagtttaaagttgataaatcaagtaataagagtaataatgaatttgtgtattaacaaaagaaaatttgccttttttcctcgggcttttgaagaattttaagattcattctaattattgagaccaattatgtgccagacactaaaataaatgaagttctagggtgtttttctcccatccttgttggcccatagttttgactgcatataacaggagatggcatgcacagcccacagaccataaattttgttttaacacagccgctttattcatttatatattgtctgtggctgcttttgcactgcagtacagagctgagaagttgcagccagaaagtagagcctgcaaaccgaaaatatttactatctactccttgagaagaaagtttgtcaatacccaatataaagcattaacatgtttcccaaagtcgtaactatacaaaaaggtataatctgaaaaatgtcatattctttgatattccttctatcccatttccaaccccacccttgttttttggtttatctttcctgtgtttctttttataaaaataagcaggtatgcacgttttattttgcctttttcttatacaaaaggtggcatactatgtgtgctcttttatgctttttttcatttaacactaccttcttgaagtcattccatatcaatttatagagatatttctcattattacagctgcatagtactgtattttgtatatatactacagtctgttcaactagttttctatgattggacatctaggtggtttccagtattttgcaatttcaactattaccacaataaataactctgtgtgtgtgtgtgtatgtatgtatgtatgtgtgtgttatgtaattgaaattgtgtcttgaggatcaatacctagaagtaagaatgctgggtcaaagggttaatgtgtgtgtgtatgtgtgtgttagatattgccaaatcccatccataaggtttgtactatttttcattcccaccagaaatgtatgaaggtagcaatttctccatgacggccactgtccaaattttgccaagtaatgacattaaaatattcttctcatctattatcaccatcatttaaaaaagaatttctcccattttaataaaggaaaaaggacaaatcagaaaaaaaggataagaagagccctttaaattgtataaatatagttcttgttgtgattatttttcttttcttgctgaagacaaatgcatctctaccctgtatcagacgaatctttatttgatcatgtctcccctaccttgaaattcttgaggactttccacagcttctcagcacttaacgtggtcttaacatggcatataagtacgtgtaagatgttagccctatttctccagccactttgaatgttttaattctttcagtatccaaattctctcccacagggcctttgcctgtggtgcttgccttgccaccattaagtaactagacaagtaaaaacaaagaatctgggttcagccaggtgcagtggcctgcacctgtagtcccagctgcttgagaggctgaggtgggaagattgcttgagcccaggtattcaagtccagcctgggcaatatagcaagacctcatctttctattaaaacaaacaaacaaacaaacagggttcttaccctggcgctacattaatttgttatgtgacattgtgtctgttgtttagtcttacagttcctcagtttccccagcctaaggtgtagttacatcagatgaccatcaggccctttctgttctaagttgtgaatgttccagaagccattttgataggacgataatggaacctagcacatttaccccatggctattaactgtaacgctgctgtaagtatacaacacataattgtttcttacaattatttatttttaaaaatcacttgaaatctattatgagtaaaccaagttttgagaaaactgattattaaatttttgaattataccccttctggggctctatcttttgaattctgtttttaacactgcttttccaatgaaagaggtaattttctacccttttaagaggttattgtagtaaatcttttgggagcaggaagacaggaaggtaggagaggcttaacactatcattttaaggtaataaaaaagagagagaagtttgcctggtgttaatctcctgttcatttattatctgatctgttgccttgtttaattgacattctttgtacttttataaaactgtctgacatcaagtaaaaatgataaagagaaaatagaaatttgagaattagagattttaggagttatgtacatgctgatctctggaaaatattgctaaataagtaatgctgttgatcattaagtactctggtcggtttagatattaatgtgtgttctacattcttaagtttgttcattagtcctttttaatttgtaatttatttcttagaagccatgttataaatgggtaattcagttttcaggaaagccccaaaaagctttttaaaaagtttgtttttggagtctttaagatttcatccctgcctaagcactgtttataaaattgtttctacacaaaaatttattcacaactaagaacatttgtgacatccagagttggactggcatttaggcacgaaaaaagtttaggtgctggaaggtagtgatgcttcttcttggaaatagtaatttaatatattgacaaaggacaaaatacttggttcatcaggtgtccaaaattgtaggaccaaaaagcaattgcttcagattcttgataactatgtaccattcatgaaccaaatgtttctcggatgggaatatgaagtttgctccattttctattttatatttctcaatttagtgactaatttctttaaataccaatatctataattaagatttctatttccaatttacttttcagcattttgaatgtagaatattaaggttcattgatagctccttaagtagtgtcttcagtttaattttctgtgaatataatatatataatacatatatttttatgctttttaaaataaactaggtacttgatattttctcagtaaagatgatttctaagttcagaaattattaggatgctggaaagccatttttccacacctgaaaaattttctcagcttactgtgttcctttgaagggagttaatgtgggaaggaagattagtcaaatcatctaccgttttatgaaaatgttaataacagtgggcacagtttttataggggggcttagtgctatcattttcaggtaatcaaaagtaaaatcatcagagttctaatattaatataggtttttctgaataaagggggaagggaagagaaaaccctcagaatatatgacttaccacaaagtacaacactagcaaaggaaaataaattttgttctggtacactttttttccatagttctagatgagaaaaccatgtttgttatctgttatgtattgctttatgaagaatcttacaaaacttttgattcatttatcttcctgttgacaagagacaccaaaaagtttctttatgaacatagtaataacaactatttaatgactgttttatttgcattttaaagttatattcatgttttatgatcttgccttaagttgagatctttaagctgaggagagttctgagaaatctcaaagttatacaattctccacccctttcccccagatcagtagattggtagttgcttctcaactcagtatgtttaagaaagagtgtatttttatttactgaagtgtaatatcaaataaaggaatttcaggtcaatggaagaaaacacatttatattatgtatatatttctcttgggatataaaggaccatggttagtatcttcactagttttttgggttttttttcttttctcttttttttttttttttgagataggatcttgctctgttgtccatgctggagtacagtggtgtgatcatatctcactctaacttggaactcctgggctgaaggcattaaagatgtattttgctttaggtttatctaaaggaaaccatggatccctaaagaaaaccccccactgttattttattgaaaatgggtttacctgtctagcaaatgattgtgatttttctgaaatcattacacctcaaacccagagaacagcaaaaatcaaatttatgtcttaaaagagttttttgtccaagttgtattgaggacttgaaagattaagacagtagaaatcagataggttggatgctgaatttaattacatgtccttttccttaaatagaaggcattcttttttagttaactttggagaactgcttgatttttttttttttttttttttttttttttgagatggagtctcgctctgtcgcccggctggagtgcagtggcgagatcttggctcactgcaacctctgactcctgggttcaagcgattctcctgcctctgcctcccgagtagctgggactacaggcatgtgccaccacacccagctaatttttgtatttttagtagagacggggtttcaccatgttggccaggagggtcttgatctcttgaccttatgatccacccgcctcagccacccaaagtgctaggattacaggtgtgaaccaccgtgcccggcctgaatttttttaaaaaaggaatatgttggataataaaaaagttttagtgtacttggtactttttttctaaagtatacctcagagccagacctattttatgtttagtgaaatgaaaatatagttttgtttagttatttggccttgtagttttgttactttataatgtaaggaactgtgtccttaattaatcattttgacgtacaataacatcttgcctacttgaaataatgttttgaacttcccaatatttggcttaaaatggccagaagagtgaaggaaaagaaaatatttacagtcatgcatcacgtaatagcattttggtcaatgaccgcataaacgatggtggtctcataagattatcatactatatttttactgtaccttttctgtgttgagatgtatttagatacacaagtaccattattttacagttgcctacagtattctttgcagtagcatgctgtataggtttgtagcctagaagcagtagggtgtaccatataagcctaggtgtgtaatagtgtataccttctagagttgtgtaagtacacactgtgatgtttgcacgacataattacctaagcaagcatcataagcaacacgtgacagtatattactttctaaatgccaagtactatatttcactatctctgatgtttctccgacctaacatacttaaaacataagttcttgactgtgatgtaagtgcacctttaaaatgtacctctggtagtattttatttttttgctaagtaaaaacttagcaaaatgacattttattagttttctccctctcaatttttgtggcatatatcattttgaaattgggtgcattatatacagaaaatcaaaatagtaacttcaaagcataccatatagatagcatctgctttctacaaattgcctacacagaccaaactcccaaaatgttatcaatgtgttactgctcaagatcttccaacaatgttaatatgtcatcatttctacagaagactacgtttttagttatacatatattttaaaatactcccaaaacatttatttcaaattactcttctttctcatttgttaatcatagtttaagaaatatgattagtagttttaattcaaaataaaaatggtatgttgaataaaatattacataaacataaattagtataaaataatttagtaaattaaatcatttaatataaaaaggaattcaaagacattacagattggcaccacataatttaagtcagtcacttttagacactaaataactttaagagattttttttaatgaaggaacaaatcaaaatggctcagaaaaatcagatggagtggatacacaaataaaatacatgttaatgcttaacacattgaatacaaattttctttatactaaagactttaaaatgtccatgtgttaatttcttttggaggtggaaaaatagtttgtccaaaaagacacttttcacagttgaaggaacttgaaagttctgtcccagtgagtcctaatggttttatttcaggcagcagattcattgtcaaatatcttactttttaaggtctgtaggttatgctgaataaaattctctgcaccatgaacttcagagaatctgaagtcacttctcctgacagaccagtttttcatttttattgaattctgaattgtgtccgatgtaaagtagtaaactatagggtcaaaacaacagttggaaacagcaatacagagagtgattgggtacattgtccttactgctgccactactgagcaattaacaaatgtttgtgttctcacaagagaatataaaataagattgatattgtaaggaacaaaacagaaacagaatatgatcaaatgtacaaaaatcatttttaaaaccttagttttgtttattttgcttctacttaatgtaacaggtttggttaaagtttttagcaccatactagaacaagttacatttaaaattagaggaataaaaaatcccactatttcgatgaaaattacaatccttgagagatatgttttccatgtggcttctggaaaattttcaaagcaggcttctgaggcattgttaccctgagagtgggtagactgaacaaaaacggcgggtgcacttcctccgatcacagttaaccacacgccagtgcaaacaatctttgcatttcttttggttcttagagtctttgacttaaatgggtagacaattgccagaaatcgatctacactaatacaggttaagaacagaatgcttccgtacatgttggtataaaacagcatcacagaaatcttacaaagtaaatctccaaatggccaattccgtgttgtgaagtaaaaaatcctgaagggtaaagtaaaaacaaaaagcaagtctgacattgccaagttaatcatgtaagttgtagtttcatttcggactttgaggacgcagatgaaaatgtatatggcaacacaattggatattaacccaagcacaaacaccatgctgaacatgcacccatacaaagtgtacttaaaggagtcattatagaagcagtgggagctgttaacgcttaccatcgtaaaggcacgtccaattttcagtttggaagcactttcatcagctgcagtctcctttgggattcagattataacctctataacctccaatttatttgcaaattatctggatctttggatggttttataaatatttcctttttctcagaaatacccaaaagaaacatgaaatttgttgctgtaaaatttccgctgggttcttcaacaggaaaatattttcatttgttagtctttagaaaatccatgaattccaaggctcagttaactgacgagcaacctttaaaaaatacagtcaacgagtccaacccataggattataaatttaaagaaaagctgtgatctgtgaccagaatgaaaccacttgtcttctaaacttgtatttcagtagtcaagatgaatactccaaagttaatgtttctttatgcctcagaatgttaagcttaagttatcaatcttattttcttttcagtgcagagtttcagagacttaaacattcccaatttgtcccattttacttcttgcttcttttaaatgaagttttccttttttgttttcctgcagtggatcccagattgtgggtaagcagaagagtcttttaaagattccgaaataaactcccaagcttgttagctcttgttgaattgaggccttttcctcagttgccagttgtatcttgaggtcgctttctctgaagtgaaaaagaaaggcttcctagatttgtaatatgacatcacaggaagaagaggctgggtttggacaaagaaactttcagcccagtttgtttgcacttcctttaatctgataatgtgtctgctgggaatatacctaggaggcttgcaaatggtcactggctgttgaactgcgtggtctgctcattaactctttttatgtggaaatgccttctgcggtgctggcaacctctcagagttgttttgatttgtttcagtagtaataattgaaagaaaaaaatcactattcagcctgttctcttattcgattgttttcgtgtttgggatatgacaatttagaaaagaaaatgtgtatgggtgtgtatttataaattgaaattgttagtgatatcttaacatagcatttcaaagaactgtttaatgactatgaaacaggggcctttaacctttaaggtataacaagcatttgactcttggtttctgaaaaatactcaatatttaattgttatcattatgagtagctcttatcctgggtctcattagtttttgataagcaattttctaacattctttcctctttcctatgcagttgtattaatattttagagctgtttaaatttttaaattactcatttctccaaaagaacaaactcaagaatgtttatctttggtgtggtgttaattttactttctaagcacaaaatgaaattgcatctttttaagcaaaatttttttaaccttaaattgattgaaataaggtttagagaataaaaatcctactacttggcaaaattttaggttcatagtcttatcttccttcttcctcccagctcttcccttaaccccttaatatgacattaactatatattgaaatatatttcagattttgtctccatctaaaagtttctatgaatggtttatatgtttatatttaaagtatactcatattttgggccaggtgcagtggctcacgcctataatcccagcactttggaaggccgaggcaggtggatcacctgagatcaggagtttgagagcagcctggccaaaatggcgaaaccccatctctaccaaaaatacaaaactagcctagggcaatagtgcgtgcctgtagtcccagctacccaggagactgaggcaggagaatcgcttgaacctgggaggcagatgttgcagtgaaccaagatcaagccactgcactccagcctgggcgacagcgagactatctcaaaaaaaaaaaaaaaaagtatacttatattttaaagactccaaaatcagaagaagaaagtgtgtgtaaggtgagggtacttaaatgtaggtgttatttcctcaaagattgaggatatcacaacctctatggcacatgtttttcttgttttaaatatcattttcttcagaaaaggctagatctagttatgccttactgttattatttttttaatttggtctagtttaagctgaaactcttcctcttgggtattaagtaatttaagaacaatttatttttttctcataaattacttagctagcttaaaaataacttattacagtaaaatgttttgtgttgttttgcaccattctttcacactcagcaatttttgtcatttgttgatgaactataatctatttctactgtctggactagaaaattcatctattatcaaatgacaaaaaaagatgagtattacttataaccaatacttaaaattttgaagggttgaatatcttttatatcacatttggtatagaaaagatgtatgtgtgtgttcttattagaaggctggtagaagctgagtgagcattaatgaaaaaaggagtggttaataagcttgtattctcattggaaaaaattttctgttagtagttatgtcttactgttattttttttttatttggttcagtatgttttaaaaaaacaaaatcttagtaatcttctttcaaattgatagtctcctctttagtcatctttaattaatgaaatatatgcagttgtatatgctgatctcatcctacttttactttcattttgaatatggcggcattttctcattcaaataattaaaatttattaattctacttggaatatttttctacatattgtcattactcacttgacttgttattcacttaagtcattcatctatagttttttcttttcttttctttttctttttctttctttcttttttttttctcactctgccgcccaggctggagtgcagtggtgcgatcttgtcttactgcaacctctgcctcccaggttccagcaattttcccacctcagcctcccgagtagctgggattatgggcacccgccaccacacccagctaatttttgtatttttagtagagatagggttttaccatgtggccaggctggtcttgaactcctgacctcaagtcatccacccacttcagcctccccaagtgctgggattccatgtgtgagccaccgtgcccggcctgttcatttatagttttttaatgtttgagttactggggcttaaaaatggatagatcactatttgttgaattaggcttttcattattatcagtatcatagtaaatgtttgtataattcttaccacaattcttggttctttgtagatgattctcacatgtttgctgatgaatgaatcataaacttgaattttgttgccagttgtttctactgaggaagagccatagcagagggactgtttgaacaggaagaagataattgaatactgcattttttccagatattaaatttggcctctaattaaggaaccaaaggggaatttagaaactttgaaaaattcttaggttagaattggaaaaatacagagtaactacttgcaaagggaggtaatgaatccatataatcaattatatttaatagatacttttgtatttgataaactcaggcaaactgttattttaatgtgagatctctacacttctggaacttaactctgagaatcaacttatttcttatatggattttttggggggagcgaaaattaaacagagccagatagatgttaaaatggtgaacacaggaacagctggagtctgcagctcccagcgaaatcaacgcagaaggtgggtgatttctctatttccaactgaggtacccagctcatctcattgagactggtcagacagggggtgcagcccatggaaggcgagccaaagcagggtggggcatcgccttacacgggaagtgcaaggggccagggaacttcctcccctagctaagggaagccatgagggaatgtgccacgaggaacgatgcattccggcccagactctatgccttttccgtgatcttcacaacccttagaccaggcaattccctcgggtgcctacaccacccaggccctgggtttcaagcacaaaactgggcagccgtttgggcagacaccgagctagctgcaggattttttctttttcgtactccagtggcacctgaaacaccagtgagacagaactgttaactcccctggaacaggggctgaagccagggagccaagtggtctagctcagtggatcccacccccacagagcccagcaagctaagatccactggcttgaaactcttactgccagcacaggagtctgaagtcgacctgggatgctggagcttggtgggaggaggggcttctgccattactgaggcttgagtaggtggttttcacctcacagtgtaagcaaagccaccgggaagtttgaactgggtggagcccactgtagcccaactgcttctctagagtcctcctctctgggcagggcatctctgaaaaaaaggcagcagccccagtcaggggcttatagataaaactgccatctccctgggacagagcacctgggggaagggtgctatgggtggctattggtgcagcttcagcagacttaaacgttcctgcctgctggctctgaagagagcagcagatctcccaggacattgctcgagctctgctaagggacagactgcctcctcaagtgggtctctgacccccatgtctcctgactgggaaacacctcccagcaggaatcgacagacaactcacacaggagagctccagctgccgtctggtgggtgcccctctgggacaaagcttccagaggaaggaacaggcagcaatctttgttgttctgcaacctctgctggtgatatccagacaaacagggtctggagtggacctccagcaaattccagcagacctgcagcagaggggcctgactgttagaaggagaactaacaaacagaaatgaatagcatcaatatcaacaaaaaggacttccacacagaaaccccatttgaaggtcaccaacatcgaagaccaaaggtagataaatccatgaagatgaggaaaaaccagcgcaaaaaggctgacaattccaaaaaccagaatgccttttctcttccaaagaatcacaactcctcgccagcaagggaacaaaactggacagagaataataaactcctccaagccaaaggaccatgttctaacccaatgcaaggaagctaaaaaccttgaaaaaaggttagaggaattgctacctaaaataagcagtttagagaagaacataaatgacctgatggagctgaaaaacacagcacaagaacttcgtgaagcatacacaagtatcaacagccaaagcagaagaaaggatatcagagattgaagatcacctttatgaaataaagtgtgaagacaagattagaggaaaaagaatgaaaagaaacgaacaaagcctccaagaaataggggactatgtgaaaagaccaaacctatgtttgattgtccctgtacctgaaagtgacagggagaattgaaccaagttggaaaacactcttcaggatattatccaggagaatttccccaacctagcacgacaggccaacattccaattcaggaaatacagagaacaccacaaagatactcctcaagaagagcaaccccaagacacataatcgtcagattcaccaaggttgaaatgaaggaaaaaatgttaaaagcagccagagagaaaggtcgggttacctacaaagggaagcccatcagactaatagtggatctctctgcagaaaccctacaggccagaaaagagtgggggccaatattcaacattcttaaagaaaggaattttcaacccagaattttgtatccagccaaactaagcttcataagtgaatgagaaataaaatccttcacagataagcaaatgttgagagattttgtcaccaccaggcctgcattacaagagctcctgaaggaagcactaaatatggaaaggaaaaattggtcccagccactgcaaaaacataccaaattgtaaagaccattgacactatgaagaaactaatgggcatcaactaatgggcaaactaactggctagcatcataatgacaggatcagattcacatataacaatattaaccttaaaagtaaacgggctaagtgccacaattaaaagacacagactggcaagttggataaagagtcaagacccatcagtgtgctgtattcaggagactcatctcacatgcaaagacacgtgctctaaataagggaatggaggaagatttaccaagcaaatggaaagcaaaaaaaaaaaaaagcaggggttgcaatcctagtctctgataaaacagactttaaaccaacgaagatcaaaaaagacaagaagggcattacataatggtaaagggatcaatgcaacaagaagagctaactatcctaagtatgtatgcacccaatacaggagcacccagattcataaagcaagtccttggagacctacaaagagacttagactcccacacaataatagtgggagactttaacaccccactgtcaatatttgacagatcaatgagacagaaaattaacaaggatattcaggacttgaactcagctctgcaccaagcagacctaatagacatctacagaactctccaccccaaatcaacagaatagacattcttcttagcaccacatcacacttattctaaaactaaccacatgattgggagtaaaacactcctcaacaaatgcaaaacaatggaaatcataacacagtctctgagacctcagtgcaatcaaattagaactcaggattaagaaactcactcaaacctgcacaactgcatggaaactgaacaacctgttcctgaatgaatactgggaaaataatgaaattaaggcagaaacaaagaagttctttgaaaccaatgagaaccaagacacaacatacccaaatctctgggacacagctaaagcaatgtttagagggaagtttatagcactaaatgcccacaggagaaagcagaaaagatgtaaaattgacaccctaacatcacaattaaaagaactagagaagcaagagcaaactaattcaaaagctagcagaagataagaaataaccaaggtcagagaagaactgaaggagagagaaacacgaaaaacccttcaaaaaatcaatgaatccaggagctggttttttgaaaagattaacaaaatagatagaccactagccaggctaataaagaagaaaagagagaagaatcaaatagacacaataaaaaaatgctaaaggggatatcaccactgatcccacagaaatacaaactaccatcagagaatactgtaaacatctctatgcaaataatctagaaaatctagaagaaatggataaattcctggacacatacaccctcccaagagtaaaccaggaagaagtcgaatccctgaatagaccaataacaagttctgaaattgaggcagtaattaatagcgtaccaaccaaaaaaatcccaggagcagatggattcacagctgaattctgccagaggtacaaggaggagctggtactattccttctgaaactattccaagcaatagaagaaaagagagtcctccttaactcattttataagccaagaatcatcctgataccataacctgccagagacacaacaaaaaaagaaaatttcggccaatatccttgatgaatatcgacgtgaaaaccctcaataaaatactggcaaactgaatccatagcacatcaaaaagcttatccaccacaaacaagtcggcttcatccctgggatgcaaggctggttcaacatatgcaaatcaataaacgtaatccatcacataaacagaaccaaagataaaaaccacatgattatgtcaatagatgcagaaaaggccattgatgaaattcaacactgcttcatgctaaaaactctcaataaacttcatattgatggaatgtatctcaaaataataagagctatttatggcagacccacagccaatatcatactgaatcagcaaaagctggaagcattccctttgaaaactggcacaagacaaggatgccctctctcaccactcctattcaacatagtattggaagttctgttcagggcagttagaaaagaggaagaaataaagcgtattcaagtaggaagagaggaaattaaattgtctctgtttgcagagacaatgattgtctatttagaaaaccccattatctcagcccaaaatctccttaagctgataagcaacttcagcaaagtctcaggatacaaaattaatgtgcagaaatcacaagtattcctatacaacaataatagacaaacagagagccaaatcatgagtgaactcccattcacaaatgctacaaagagaataaaatacctaggcatacaacacacaagggatgtgaaggacatcttcaagaactacaaacttcactgctcaaggaaataaagaggacacaaacaaatggaagaacattccatgttcatggataggaagaatcaatcttgtgaaaatggccataccactcaaagtaatttatagattcaatgctatccctatcgagctaccattgacttcctttataaaattagaaaaaactactttaaatttcatatggaaccaaaaaagcccatatagccaagacaatcctaagcaaaaagaagaaagctggaggcatcatgctacctgacttcaaactatactacaaggctacaataaccaaaacagcatggtattggtaccaaaacagatatattgaccaatggaacagaagagaggcctcagaaataatgccacacatctacaaccatctcatctttgacaaagatgagacaaaggattccgtttaataaatggtgttgggaaaactggctagccatgtgcagaaaactgaaactggacccctttcttacaccttatacaaaaattaactcaagatggattaaagagttaaatgtaagacctaaagccatgaaaaccctagaagaaaacctaggcaataccattcaggacataggcatgggcaaagacttcctgaccaaaacaccaaaagcaatggtaacaaaagccaaaattgacaaatgggatctaattaaactaaagagcttctgcacagcaaaagaaactatcatcagagtgaacaggcaacctacagaatgggagaaaatttttgcgatctatccatctgacaaagggctaaagtccagaatctacaaggaacttaaacaaatttacaggaaaaaagcaaacaactccatcaaaaagtgggtgaaggatatgaactgacacttctcaaaagaagacatttatgtggccaacaagcatatgaacaaaagctcatcatcagcggtcattaatgaaatgcaaatcaaaaccacaatgagataccatctcatggccgttagaatggcgattattaaaacgtcaggaaacaacagatgctggagaggatgtggagaataggaatgcttttacactgttggtgggagtgtaaattagttcaaccattgtggaagacagtgtggcgattcctcaaggatctagaaccagaaataccatttgacccagcaagcccattactgggtatatacccaaaggattataaataattctaatataaagacacatgcacacatatgcttattgcagcagtatttacaatagcaaagacttggaacccacccaaatgcgcatcaatgatagacaggataaagaaaatgtggcacatatataccatcgaatactatgcagccatgaacaaggatgagttcatgtcctttgcagggacatggatgaagctggaaaccatcactttcagcaaactaacacaggaacagaaaaccaaacaccgcatgttctcactcataagtgggaactgaacaatgagaacacatggacacagggaggggaacatcacacatcggggcctgtcggggttgggggttagaggagggatagcattaagagaaatacttaacatagatgatgggttgatgggtgcagcaaaccaccatggcacgtgtatacctatgtaacaaacctgcacgttctgcacatgtatcccaatacttaaagtataatacttttaaaaaatggtgaagacaagcctttttttaggactgttgccataatgaccttgtagactgatttgaaatatagtgtatcagctttggcaacatagggaaaccctgtctccataaaaaatttaaaaattacctgggtgtggtgatgtcaacctgtggtcccagctggttgggaggctgaagtgggaggattgtttgagcctaggaggttgagactgcagtgagctttgattgtaccactgcacttcagcctggtgacagatcaagaccttgtctaaaaaaaaaacaaaaaggaaagaatatagcctacatatacaaccaattcaaaatatagtgaatcttggccaggatctgtggttcacacctataatcccaacactttgggaggctgagatgagaggatcacttgagaccaggatttcaagaccagcctaggcaacatagtgacaccctgtttccaaaaattagccaagtgtggtggtgggcacctgtagtcctggttactagggaggctgaggtgggtggatcacttgggcccgggagattgaggctgcattgagctatgattgtaccattttactccatcctgagtgacagagagaggcctgttctcaaataaataagtaaataaataaaaagaatgaaatatagtgaatttcattatgtaatgcatcggtttttaaaatttaatgacatctgattctgattctttgaatactttcactgcttaagctgctgggttgggtttttgtttttgtttttgtttttgtgtttttgagacggagtcttgctctgtcatccaggctggagtgcagtggcgcgatctcggctcactgcaacctccgcaggttgggttttttcactctcaggtataatagatcaaggagtcaccttacactctttatgtttaaggatttctgatttttgaaacaggttgcacaagaaacatgtataagattaaatattctgtaaaaggcttccctttatgtttcaatagcattcttctttaaaagacctatttttttccacaataagacaccgtgttcttttactataaaattgatcaaagaggaatcgattaaaactttaaagaattctctcattaaaagtttcgaaggccataattgaaattgtacataacattgagaacaggggatatgcaaaaagaaaaaagaaaaaaatcaaatgagagagtatgtgagacttaaaacagaaataaattgatttaagttcaaaagaaagtgtgagccaggcatagtggtacactcctgtagtcgaagctactctagaggctgagacaagaggatcacttaaggccataggagtttggggcttcattgctctttgatgacacctatgaatagccacagcactccagcctgggcaacataacgagacactgtctcttgaagaaagaaagaaaaaagtatgggacattgatattttaaaatttaaaaagaattattctaaacttacttcagtcattttgcatgcagcaaatgtttgccatggtgaaatgtgacttccatctcttaatttacacttatgcaaaaagcagttttctcatttgggattcttttgatgctcattatgataaaattttctatttaggtatagaaacaaataaacctttttcaatttgagaaatgaacatttgtaatttatgttgacagaatatatttattttctataaaaatatcttttagcctaaggagaaaaaatcttaaattctagactagtattaccataagtctatcggtatcatttcgaagtgatttaccttcctttcattattgtaaacacttaatactttatgttactttttaccggaatgtgagtcatctacccaagttcaaagagttgaaccaacttttatagagttggatgggagtagaagaggaaagatttaaagggtgatgaatgatgattagagcaaagtaaaagttgatgggaatgatggttgaagcaggttcaaacaagtagggaaaggaaatcaagaggagtgaaaatgttattgtggtaagatttaaaacttgaataagcatatttatctgtgcatacacttgagttgtcccttcttccttatctttttttccgaactctcttgttgcttcttcatctccaactcttagaatcatatcacgtcttttctatggagtctccttaatctcatcagttccttttctgtacttccacagtacttagtttgccttttaagacatatacgtgcaattcaattaagaatgaaaaacaaggccatgtgtggtggctcatgcatgtaatcctagcactttgggaggccaaggcgggcagacctcttgaggtcaggagtttgaaaccagcctggccaacatggtgaaactctgtctctactaaaaatacaaaatgttatccaggtgtggtggctcacacctgtaatcccagctactcagaaggctaaggcaggagaatcacttgaacctgggaagcagaggttgcagtgacggagatcatgccactgcactccagcctgggtgacagagcaagactctgtctcaaaaaaaaagaaaaataaaagaatacaaaacaaagaaataattgcaatacaagatataacaacagctattagtaacacatagacatgagaatctacgaatttagtaaagagcttcttgaggagatgatgtgtaatgaaggctagcctttacagttgaatacaaattttaaatttcaggtcttgaaggctagagccattcctggtaataatgtcccattaatatagtcatgctgcctttctcatccaaaaacacagaaaactatttgagtgactattttctccattctctcaaggatgctatgtaacctagtcctactctgaattcctggaagatgttaattcttcacatacaatatatgccttgtggcataaaggctgaatttggtcataaaaccttagttgggtaaggctaggtgggttgtagctttcaaaaatttttcacctagtttagacgctgcaaagtgtaatgaaaggaccaatttcactaggtgttaagtgacttggattctaatccaagttactaaaaattaatgtgcgtctcctgagccccacctactcaggaggcagaggtaggaggatctcttgagcccaggaattccagtttagcctgggcaatatagagagtcctcaactcttaaaggaaaaaaaaaatgacatgaccttgagcaaataatttagcttctctattgtatatttgtaaaaggagagtattaaattagacctatagaattcttttcagctcttagctttctatctaattcagtctccccactaattttcaatgacaagaaagaacatatattattgtttcaattttacagaccaagaaactaaaattcagagaagttgtgacttgcttaggattacaaagtgattattggtggagaatgacgaagtcaaaactaaaaactgggtcctcacaagaagtacccaacccagttccttatacatgtttgtataatgaaagaatacaacttagtgagtgcatgcataaaggataatagaaagcactgtgacctagagatccagaatccttgatttctaaattttgaccttaccttgggcaaactctgccctgaactttaagatggatatgacatgcccttttgaccttatgaagagttttcagaataaaatgaaatgaaaacatattctgaatgtaaacctctaaaaagatactattatagatgacatcacctataatatcttaactttatagaaataaaggttatgttgtgggaaatcatggaacaataagatttgttttgttttcttgaccagataggatgcctgtgctctgtcagataaagaagtgatcatgtgatgcatttggtatgccttttttagcactgctaatgtacagccaatttaaatcaaatagacataggctttgcttataaaaaccacatatatttctaagttagtttgcttggtggttaacacattgcatattgcattagtcttaatatcctctaatgttggagctagcactggatcctagaaattcagaataaaagtccaccttacccctgttacaactagccattcatcttctttggtatatagtttagctctccttccagtcactcaagtacaacttaggaaactaaaaccatagctgattattgctggagcaggaactcgaatcctagtttcttgacttctagtcaaatgttctcgtagtaacaggtagctttcaccctttttttcttactgatgttgtgctagttcgttcttgcattgctgtaaagaaatacctgagactgggtaatttgtaaagaaaagagtagggtttagttggctcacggttcttcaggctgtacaggaagcatggcatcagcttctcctcagcttctggtgagtcctgaggaagtttatattaatggcagaagtcggaggggaaacaggcatgtcacgtggtgacaataggagcaagaggaaggaggaggtcccatgccctttttaaacaagcagatctcttgtgaactaactgagcgagagctcggttatcaccaagggggtggtgctaaaccattcatgagggatccacccccctgatgtagtcatcttctaccaaacctcacctccagcattggggagcacacttcaacacgagtcatctaccaaacctcacctccagcattggggagcacacttcaacacgagtcatcttctaccaaacctcacctccagcattggggagcacacttcaacacgagtcatcttctaccaaacctcacctccagcattggggagcacacttcaacacgagtcatcttctaccaaacctcacctccagcattggggagcacacttcaacacgagtcatcttctaccaaacctcacctccagcattggggagcacacttcaacacgagtcatcttctaccaaacctcacctccagcattggggagcacacttcaacacgagtcatcttctaccaaacctcacctccagcattggggagcacacttcaacacgagtcatcttctaccaaacctcacctccagcattggggagcacacttcaacacgagtcatcttctaccaaacctctcctccagcactggggagcacacttcaacacgagtcatcttctaccaaacctcacctccagcattggggagcacacttcaacacgagtcatcttctaccaaacctcacctccagcattggggagcacacttcaacacgagtcatcttctaccaaacctcacctccagcactggggagcacacttcaacacgagtcatcttctaccaaacctcacctccagcactggggagcacacttcaacacgagtcatcttctaccaaacctcacctccagcactggggagcacacttcaacacgagtcatcttctaccaaacctcacctccagcactggggagcacacttcaacacgagtcatcttctaccaaacctcacctccagcactggggagcacatttcaacacgagtcatcttctaccaaacctcacctccagcattggggagcacatttcaacacgagtcatcttctaccaaacctcacctccagcattggggagcacatttcaacacgagtcatcttctaccaaacctcacctccagcattggggagcacatttcaacacgagtcatcttctaccaaacctcacctccagcattggggagcacatttcaacacgagtcatcttctaccaaacctcacctccagcattggggagcacatttcaacacgagtcatcttctaccaaacctcacctccagcattggggagcacatttcaacacgagtcatcttctaccaaacctcacctccagcattggggagcacatttcaacacgagtcatcttctaccaaacctcacctccagcattggggagcacatttcaacacgagtcatcttctaccaaacctcacctccagcattggggatcacatttcaacacgagatttggaagggacaaacattgaaaccatatcagacataaaataggaaacttggtccatagcttaggtaaatattaagcaaagaactttgtctttaaatgagtaagctctgcagactttttaaaacactaaattctaacattatgatagaaatttaagattaagagattttagacattttcatccttctgtagattaaaatcgtatgatgaccatccttcatttttagcttcatctttatttatttaaaaagtttgcatttgtacatagtaatgtgccaagttttatacaaaagcaggaaatatctctgctgctttcaaataattagaacaagggttttctgtgaatagtaaatttaacaccttccagcatagattattatcagaaatccaagtactcttcagttaaagtaaacacttattgacttgtatcttttacctattactgaggggtagaagttaaaaaggattggtctctcaggatgctcctggaagctgcatgcttgtggctataaagctattctctgatatacctgaattcttttgctcccagtagtgaaattgtgtgtgtattaaaagtttaagcattgtttactccctgatttatatttgctgatttttcatattattgtaatgttataaaatggaagtgcaaaaaagggttgttttagtcaaaccaagttcggtgctttgaaatgactcagaggcaagttgcagaaaatattgtagacttagatgtagaaaagatatgagggggcaacgtaagaaactagaaaggattgctaggtgcagtgacacatgcctgtagtcccagctactctgtaggctgaggtgggaagatcactggagcccaggagttctgggctgtgcgctatgctgattaggtgtccacactaagttctgcatcaatatggtgacctcctgggagcaggggactaccaggttgcccaaggaggggcgaacccacccaggtcggaaagtagaaggattgtgtctctaggcctcagactcctttgcatttttctgtcctcaccctgcacatagtgaaaatcataaacccacattattggtgtggtttatagaagaaaaacaacttagaactaaaaaaaaaacaaaaaaccttgaccttacgtaaagagattttcaaatgaatacactttttgtgtttttaaaattaaaatgttatatggaattatatatattattttaaaatgatttcctgcttagctttttaaattaactggtgccaatctctcaaataagacaatttatgtaccagcagtaatcaactggaaaatgtaatgaaaaatattcaatttacagcaataacaaatagtacaaaataccttaggaataagcttaataggcaaagtgcaggatgtagatgaaaacaaagcaaaagactacaaaactttaataaaggccataagagaatacttgaacatgtgccaggcagtttttctgggacaaatctatacatttaatgccaatccagtaaaaatctcagtatgttttcagtgcatgtttttacaagtttgttcacctgtagatactgtgggttatatcacctagcagtttcatttctaagaaaaaaatcccctcctaatttgcattctccacaccttcacccaaaccagattattattagacttttaacaggtcaaagtagtatcttgtttagtttgcatttctttagttataaggagtccagaaataatcccatacccaggggaatttaatgtatgataatttatccacttcaaatcagtggagaaaattcaggataattcagtaaatgctcatgagttatcaggatagcaatttgaaaaaaagaggtagactttgatttattctttataccaaaataaattctagctagatcaataatctcaataaaaaatgactccatttaaaaaatgactccatataagttctggaaaaaaatgagcacgttagaaaaataacagtagaggccaggcactgtggctcatgcctataatcccagcactttgggaggcgagacaggtgggtcatctgaggtcaggagtttgacaccagcctagctaacgtggtgaaaccccgtctctactaaaaatacaaaaattagctgggcatggtggcacgtgcctgtagtcccagatactcggaaggctgaggcaggagaatggcttgaacccagggggcggaggttgcagtgagccgagattgtgccactgcactctagcctgggtgacagagtgagtctccatctcaaaaacaaaaaaacaaacaaacaaacaaaaaaaaaaaacagtagaggcctgctgtggctcacacctgtaatcccagcaaagaggctgaagcagaaggattgatttctggagcccaggagtttggggctgcagtaggccatgccactgtacttcagcctgggtgacagcccaactctaacaattaaaataaaataatatatttaaaaatagcagtagaggctttctaagtattatataaaatctagtgtttaaaaaaagataggtttgactaaataattttgttgcaagaacaacataaagtggaatgaaaacatcagtccatcatatgaatcatatgagttataacatttacagaatagttaaatgacaaattatggaaacaagtctgttagaacaaactaacaaaaaataacaacccattcaaaaaggtgggagatgcatctaaacaagcatatcattttgtccttaacttaaaagtggttctcagttttaggtacccaaatttaatatttgtattttttttaagttttggccttcaaaataaaaatgactatacatttgattagacttctttcttttctttttattatagatgattgatttttaaggactagtgctatgaacattaaagcaagtatgcttaaaaccaaaaacatattttgactttaggcatttatgcagataaatgtttcgctcttaacccacttggaattcaaagagactagctctttaacagatactgatactcaaaggtaaggaagaattattggtatgattctaagccactagtcatctattcccagagcaaaatttctgtggttacttttttttattggttttctagtgtgcttgctttaatcaactgttttcacatgtttggaaaatttgagggtttcctgtctatactagaagatacgagcactactccagaaaggttagaaacaaaagaccaaaggacggcttctacaaaaggccccctgttaaagcccagccgtttgttgttgttttagttaaacagaagtggactatttcaacctaaccgaaaaagattgctggatttttgccctggccatataaataggaaattaagacaggcatattaaaattttttcctgcttatgttgtcttcatctctgggtcaactgatacttatttttttttccagtagcaaaatatttattgagtgtaactgtgtaccaggtgcttttctaggtgctgggaatatagcagtgaataaaacaaaatccctgagcttatattttatttggagaagacaatcaataaataaacaattatacaactggtcatatggtgataagttctctgaagaaaaataatttaggaggaaaaagggggtgggcttttactgttctacatagggaggtcaaagaaggccttgctaataaggggacatttgaacagagacttgaaagaagtgaaggaatgaatcatgtggttgtctcagggaattaacctttaactgatcaacatctttaaaaggccttctccaatctgtatttccagctcacctcccagaaattcactcaccatgttcatgtccccaagatctttggggcaaatagaaatttctaaacagtatttcaacttggtaagattctacatttctgcttctgattcttatttttcatggcacctcataaaataggaatgcatgttttgtttttttgtttttttttttgggctacttgccagtgttctgaaactaaatacttctcggagagtagctgtctctcattaaagagccccagatcaacagttccatttcagtcacattccaccctgacttgtctcttctcaccattcggtgattaggttcatgtcttttactctttaatgctttggttagcatcctgtttacctcaagagactgaactttcttctcctgaatttaatttccctgatagcagggacatctgacagcctatgtcaactgtcttccttgacttctgtcaattatttgtcctaactatgcttgagtaagcgtacaggaatataaaattttatttccttggaataaaattttaatttataatataggagagatattactattaaggctcttgaaaagcaattataagagacagaataaaattaaaaggaaaaaagatagcataaccctacaactctaataaatctgctgtttatgattttccagatttaatttcagtctttgctattatgcttatatagttgaaatcagagaataatatctttaagatttggaatgggatactgctctttctttttatgtgctcttagataagaactctttctactgtgtcttataaactctgtcataccataagtttctcaaagtgattttaaccactgtacattttaaacaatatgagaaataaattaatttctgatatgaacatacatgtaagctactaaacctcagtattatgaaatatctaaaacgtgacttattagaaatagattcttttagacgttaatttttttttcaaaaagatacatatgtacttttctatttatgagtatacctgggtaaatatagaacataggaaaatgtactttgatgttttaaaacatttaaaattatttaaatataccactaactctaaattttaaaattatctttgattagaagcattaaaattcttatttaagatgtatactatttgaagaagagaattgggattctgttgccttgctttgtaacttaaaagagctttttcagggactccctcagagtacctgctggagatgaatctgtaaaaaatttttgttcagagaatttctgccactaaataagtcttaaataagtatgccacataggatagactgtatttaaatgaaaccattttttataacttacaccaaatattatgacaaaagcataattgtttcttgataaaactgttccactgttttatttgttttactgttaacaaaaatgcatttttttttttttacctttagtaggtatgcattgtattacaaaacaatgatatcttttggaaaactttcagttaaactagacaaataaggactttggcttattcagatttattccattcatcatctttgaattagtttcttcttgagaagaagcatatcttacaacttttgtctttattacctcaatatgttttatttatatgtatatacatatatactttttttcagatagggtcttgctatgttgcccaggctggtcttgaactcctggactcaagttattctcctgccttagcctcccaaagtgctgggattataggcatgagccactgtgcctggcctcaatatttatttaaaggttacaagaatatatgttcttaaaatgttgagaattaaaataaataatttctccaatcataatagctttgtattttattatattataaattgaaacattgaagttttaaaattcttcttcaatgagccaggcctggtggctcatgcctgtaatccttacactttgggaggctgaggcaggaggatcagttgaggccagtagtttgagaacggcctggacaacatagtgagaatctctctccatttaataaataaataaataaaattattcttcagtgaatctgtttttggattcagtcttgataataaaaacggagaaaaaaaattttaacagatagattatttcaatattgctctgtcagcaatatctggaaatagcattagtcatttttcttcaggtgcttttatccaacaagcctaagactcctaagattcccttccccattaggaagctccaggcaagcaagtgaaaccagcagaaggcacccagccacaaaaaacaccctggcccaggaagtctctttaaccctacagccgagactctttctcagcccaggaacaccaggcctgtagagagacactattcaggggtttccactatacaccattccaccaggcagcttgacctggtgaaaatgtgtaggtccatgtatccaccaccacaagcaattgcacccatatccctccagcctctctacccctgtccctaacacctggccactgctaatctgcccttcaattctcaaattttgtcatttcaaaaatgttatgtaagtggaatcaaacaggattagttttttttctcattcagtataattttctggagatccattcacgatattgcatgtatcaatagttcatacctttttattgctgactagtattttgtagcatgaatgtactacagtttctttggccagacacatgttgaagaatatcaggacaggttctagtttttggctatcacaaataaagctgctatgaacatttatgtttagtatcagtatgggttttcttttctctgggataaatgcctaatgagtaaaattgaagagttgtatggttattttgcattttctttgataaaagactgcaaaagtattttccagagtggttgaatcattttaaatttccgccagcaatatacgagtgagtgatccagtttctctgcattctttccatcatttggtgatgtctttattttttattttagtcattctgatagtgtaaggatatctcagtgaggttataatttgcatttcccatcaggatgatagctaatgatattgattaacctttccctgtttatttgtgacctgtatttcctctctggtgaaatttctcttcatgtctttgctcattttctgattggattgtttgttttttaccattgagttttgagggttctttatatgttctcaatactagtcttttttgttagatatgtggttagcaaatattttctcttggcctgtagcttctttcttcatcttcttcacatcatgtttctcatccaaaagtttttaattttcataaagtccagtttatcactttttccttttatggattatgcttttggtgtcaaatctaagaactccagatcctgaagattttcccttatacttaaaaaattatagtttcacattttaagtccatgatccattttaagtttatttttgtacaaagtttgagatttgggttgaggtttttttagggggtgctgagttgggcaccatggatgttcagttgtttcagcaccatttattttaaaggctatcctttttctattgatttgcttttgtatctttgtcaaaaagggaacaaagaaaagatgagacaaatagatgtagaatttaaactaattatattaataattgcattaaatgtcagtgctctaagcagcccaattaaaaggcagagattatcagagtggatgaaaaacaaaacccaactctatgctatctaaaagaaatctattgtaaatataaagacacgaatatgttaaaaggatgaatgaaaagattaggtcctggatggaactgaggttaactgaggataattttaagatttgtactatgggtgattaggtggttgataacacaattaaccaaagtaggtattgaaagaccatctcatagctggttggtgatgaaggaaatgagttcatgttaatgtttgaacctattatatttgagatgtttgccacatattcatgtggatatctttggtgtccagttggaaatatggatctagaacttgaaagcatagttttagtcagaaatgtagacttaggaataatatagatatagttaaaatcatgaggccaattgctgtggctcatgcttgtaatctcagcactttgagaggccaaggcaggcggatcacctgcggtcagaagttcgagaccagcctggccaacatggtgaaacctcatctctactaaaaatacaaaaattagctgagtatggtggcacatgcctgtaatcccagctactcgggaggctgaggcaggagaatcgcttgaacccgggagacggaggttgcagtgagccaagattgcaccactgcactccagcctgggtgacaagagcaagactctctcttaaaaaaaaaaatcatgatagtggctcagccagcatatgtattggcaagcagatctgcagaaatattagtattaaaggaccagcaaggtaaaatggaaaagatcttcagaaaggccaaggtctgccaaaattcttctattttctattctagtttcctcttgcgaggcaaaacagtcttagaatttagcttagggtggcacaaaaacatttcctgtaatgtagttctaataatattccttaaaatacccagaaaacaatagcaatttctgccttccacttcctctattgttaatttttctactagcactactgacttgtacttactttgataatcagaatctcttttaggagcaccttgacttaatagccttggagtcctttactttctagacaagttcatgcttgccttagaaatgtatgttagttatgaaaagtcatgtagaacagacttatagcttctactttttctatcaatattatttacccagtgaaatttatactaatcttgctgacagtgagagcctggtttccttcacaagactaagtagcaaaacagagtgaagcgttgttcagagagcaattaggctgacagttaatttgagtagataagtaataacatgagttgagtacaagagaaaactactgcccaagtcctggatagaaacaatgctttagaaagaaatatacatattttactttcaaaagttaagtattccatgaaatattttctttatagttaaaaaagatcaattgctatattaattatctgttagaacaactaacatttattatctcacacaaattctgaaagtcgggaaactgggagtggctttactgtgtgattttgactcatgtttcctcatgagagattcttaaattgtcaaccaaggctgcagctagtttaaggcttcactgggattggagagtctacttccaagttcactcgtgtggttgttggcaggcctcagttctttgctggctgatggccaggggcttcattttttttgccatgtgagcctctccgtagggctactccatagcagctccctgcctcaaccccagtggaagagatcctagagagggagagaacctaagatggaaactgcagatttttataaattcatctcagaagtgacatgccatcacttctgccctatgtcattggcccacagactaaccctggtacagtttaggaactgtctgcacaaggatataaatacccagtgtcagagattattggggtgatcttggaggctggctgccatagttatgacttagtgtcaattagaaaacaaatcctattatcagttttcttgtttgtgctttgctgtagttaatttgactcatgatatggctgcatcatatgtcaatattctagaaatatttaccaagtgtccattatatgcttggcactggaattttattttaagaactccctgaaagtcccatctgaaccctggtagtcacctgtctaaaatccttcagcgagtttatattttgctatttccttgctatgaaatctgtattttagcattatggaaagaaaaatttctgtctcaaaggcttgtgtgccaggtgcccttctaagcactttacatttattatctaacttagttgtcaaaacagccctatagtaagcattatttttcttatcttatagattagctgcatgaagtttccccagggccatattattttttcttctcttgcttctgagcacactattcttctgctttttacttaaaataatttgttctttctttaggattcaactcaagcataatctcttccaagaagttttctctaatgctcctaatctgagttagttgtctcttctgattttcatggcaccctgtgtattcttttattctggtacttagcactttgtattgctattttttatttacttatctgttttttttttcattagactgtaaactatagcataaaagttcaaaacaaaggctctgaaatcaaacagtttggaactgtgtcctggatccaccacttattcatgtgactggacaatttactccttgtctacctttcttcacttataaaatggcatttaaaaaataattaccttctttctagagtttgttgtgagaattaaataatataagtaatgtggttggtgctatgtctggcattcaataaatgttatctgttaagctctttgagggtagaattattgattgcttatcatgtgccatgtatcataccaaactttttatataggttattttattttcacaacaactctatgtagtgggtactactatgaatgtgctatttctcttagcatctctagatgaatggatcagtgaatgaatgatagatggaattgtggccagtggaactaattgtaggggtaaacagcaacctagaaacatggttaaaagcatgacaatgggcaaagaaagagtgaaagaggcagtaagcaaaggaacgtgactcccatactagtatagcagctaacggcacaagttttagaaacaggtagacttgggtttgaatcactgctccatcacttatcagccatataatatggggcaaaatttataatttctataaaatacacatatctactttatggacgtattttgaagattaaatgagataatatatgtaaaatatttagcatagaacctagcatatagtagatattcaataaatattaactagtactattattaaattaagataatcatgaagacagaattttggtagtgaggtagtgagagaaataaaatagaatcatgaagtataaggtaatgactttgaatcattaatcatagttatcgaaatcaggcatgatagaaagattacggttgttaatcttccttatagtgcaatatcctcaccagtccacacaacatttttgcccactgagtctgggataaagttaaaaattaatcctcataaactaaagttaatgaaatgttcagaatattctgccttcttaccgtatcatcactttagcccaaatgctgggaaaaagagaaacaaaagtcttctgtcagctattgaatgtgttatgatttagagaatttctgagattcacagtagagtctgtactttttacatttgatagacctcaaatttgcctgagtttttagtgttccagaaaataggctttggggaaggtttgaaagaaggcctttttgaacctaagaagacaagaaattgaactgttatcacaatattgctatttaagaaagaatattaagtcacttttcagaaatttatatcagaattagaaaaatgcagaaatatagtttatacttcttaaggaggtggtggaggagattagatagatacatgcatacatatatacataagtctaaatatttttatatgtatatgagagaagtatcaggaatagggtaggaaggagatagaatagtaggattacattagaatctgcttaggagcttttcttacatgtagatattctctctttttgggtatatcaaaatcttgggagtaaaagggaaacctggcatgcatgtttaataaagcttccttggggactctgatatatgctgcctcccaaataaattacaagccatatcaggaaataggagtttacagtataaaatataaccgaaaactaaagtcagatgttctacaaaatattaactatttttcctgagatagaagtggttgaaatttgggagataacttttgctatgttctgtgaggcaaagaggagggaggctagagttgatgaagacatctttcttttatgtatgatattgtctatgttgggccctgttaattttcatttacttatgtacaaatagctaatgcatattttttaactttaatgtttgttatttacatgcatagcctgatgggcacatgatccaaagtttaattttttggttgaaatttagtatttggcttcatatatataaagattggggtaaggcgatctgccttgcctttcttctactgtgtcaaagaatttatgatcaagggctagagtcagtattaattatatgattttgttttaaccaagaagaacttagttaaatttaaaattgtagttgcactcatagataaagggttttctttgttaaaaggtaaaaaagagacatctcttatacttgcttaacttttcatttaaaaaattaatgtattcataataaatagaaaatgaaaggagcttaaaaagcaaattgaacacatagttatcagagaaaacaattttaaaattatgattttaaactctcatctgtattgctaagaatgccctatattgtaatattcaaggtttgcttataattaaaatgtagggaagaaaaaaagaatcctgcagacattctaaggatgacctaggccattgatagtctaagcttgaaattaatcattagattttctgaactcttattacactggatctgttcagtctgctttaacaaaataccatagatttggtggcttataaacaacagaaatgtatttctcacagttctgaaagctgggaagtccaagatcaagtttccagcagatctgatatctggcggaggcctgtttcctggttcatagatggcaccttcttaccatgtcctcagatggtggaagggacaaggcagctctctggggtcccttttataagggtactaatcatccttttcatgagggatgtgttgaaactaaattgtgcctgaagacccttatgttacctttacatatcaaatttctattgtatctggccaacctttgattttaaggcactagggcaagaatgaccaacgggtttccaaacatatagaagtagtaacatgtgcatatcaacaaaaatcacttggtaggaacccaatactagctaataagcctactcctactgtcttagatctagttctgtttcagaattggaagctttaaggattatgaaattctgggaacttggagtaggtccacctagaagtagaagcagcaaaacccaaaaaaccaatacaatttttaatagtgttgtttaatttttaagtgttatttactagaaaataaaactatactgtgtttaatcatcaagcaatttttaacaaaaaagtttagcactaggaataggttaaacttgacacaatttgctatcatagaattatatatatgggtaaagggtaccagttagattcccattggcaaaaacctggtgattttcattctgtggtatagagatcctagttaagaggcaggaattatttaaaaatgactttaattttgatcatttaattataggacctatttattcacttgtttttaacttattcacaaatcttagtcatgagcattattaatagataatttgatgccttgtcacttagcagtacaagcatgtttatttctgacttttaaactcgaattcacccttcttgtgtttttctattcagtcgtaacccactccttctacatctacaaaatttggtgaggcatctttgactttcatcatattcagacatgctagcttcaagaactttcctattcctcttttaatgtctgtttctcacattgtattagttccttttatagtattaattcttcctacagtatgaattttattttttttttttgaaatggagtcttgctctgttgcccaggctggagtgcagtggcaccatctccactcactgcaagctctgcctcctgggttcacgccattctccttcctcagcctcccgagtagctgggactacaggcgcatgcaaccatgcccggctaattttttgtattttttgtagagatggggtttcaccgtgttagccaggatggatatagtatgagtttttattcattttgcaaatattcatcatagatatttttgtcttatttcagttagaacaggatttttttctttggattcagaaggtaactttcctactgtacttaggataaattccacaaaaactctttaacaaggtttttttcctggctattagaaaggaggaagaccctcactgaattgaagatagtaatgatgggtgaggactttgacttctgttaacacctcattcagataagtgactattttagtttaattacatgaattttgtcatctcccttggagctgcctcccagagctggtatatcagacatcctcaagtaaacctggacccaattttagaaatcttggctaattttgagttaggaagtcctttctttaaacaatattttaaaattaacagaacaatcacaaaatatattttacatattgcacttttcaaaatactttaaatatttaaaaaaatacccaacaccacaaagtaacttagtttaaaataaaataaaaatttttgaaatcagacctaatcaaattgatatatctctcattttctttgaaaattttgaccaagatatcaattaataaatccactttgaaagacattttaagacatttaattaataaatccatttgaaacacattttaaaatgtgtttgttcatgtgtataaaattatgtcattgatataacattactattcctttaaacattgttatgttcttaaaaatatctcctcttagtctataatttagcgaaaggattactgttttgaaagacttaaaaaaaatgcttagctattttttagctaagaaaaaagattcctttttcagtaaatggataaagctgaaaaataagaaattaataaaatgttttaaagaaagagtcataaatatcttaatatttaattctaggaagcttctctattcatttgcttttttatttttaaaaagaagtttaaaagagttttagttttaatatctataaacttcaaatgttattccacactcaaaaaatatttctaatgtattaagtcacagtttactaaaatagctaagttttctgattcataaaatgaataataacacttaattttaagacttattttgaagattaaatgaggtaatacattcaaataaaaccttttaaactgaaagtactttcattcttgtgtaaggaaaccatgaaagtaaaagacacatcattctattttgccagtgtatcttaaattaactagcttttattgtcagtttagtgttcagggcaccaagggtacatttcatactaagattgtgcaagtgagagtaaatgcctccttaaattttccatcttaggcacctccgttgcttttagacctggctatgttttatattgcttatatacatttttttttcttttggaaaaaagataagctgaaaaacatttttgttgatgacatgctattgctgaaataaaaacccagaacatagtgatgtgtaggaaaaaactctctcaaaccatgtttttcttctgctctcataccaccacaacagttgtcaacacaaaagacttctgtgacaaaatgtgtgggtttttttccccacacactaagcagcagataccagctgggcatcctccaactcagttctgatactgtctacttggagatagtgtcagatcccactggttggggtctcagtgcccatacctcatacccccagacaccatcctaggcctccagaacttctgacctactggcttcaaattggggttctcacaccacactcttcaggttcaattaatttgctggagctgctcacaaaactcaaggatactgggcacggtggctcaagcctgtaatcccagcactttgggaggtcgaggtgggcagatcacttgaggccaggagttcaagaacagcctggccaacatggcaaaaccccgtctctactaaaaatacaaaaattatctgggtgtggtggcatgcccctgtagtcccagctactccagaggctgaggcacgagaatcacctaaacccaggaggcagaggttgcagtgaactgagattgtgccactgcactcctgcctgggccgcagagcaagactgtctgaaaaaacaaaaagaaaaaatcaaaggaaacacacttaccggtttattacaaaggatattgcaaaggatacagatgaggagatgcgtagggtgaggtatgggagcaggggtgcagagcttccatgccctctgggggccacaccctccagaaacctccatgtgttcagctatccagaagctctcctaatccagtttttatgatgtcagcattgggatttttatgatgtcagcattcctcccctacactatagggcaaaaaccatctctggggagggtcttaaagacacacaatttacaatgatgggggaaaaattagagtcctgccttggaacaggttaaaggagggcaagagaaggtccgaggcctgcccctgaggcctaccacaccaaacgttataacaacacaacagtttttatatattttcagttttgcataatatgaagttaaagacttaagtaaattgagtaaatagtagtttttttttttttaatttcacagatcaatagagttaactcctgagttatatgcatacaaccccaaagttgtttgctgtctggagctgtgcctacacccgcctggcatattcttgagacattggagctaggaagttggaaattgatagaaaattttgtcacttgtaacagagctaaagcaatatggattatggtggaccctatcacttggaatactttcctgaaagcaacacaggtcatcattgccaaatatttttaggaccccaattctgtactaagtgctagtgatgtgataggaagccagacacaattgaactagctatctctatattagtgacttatcctaaaacagagtttctgttgtaattggtttactgtttctcttagaatatttaaacgttttaccatggtctttcagattctgcgtgatcatacagcaacctcttctttagcaacctctccactatcccacccgggtactttagttctggtggcctctttcattttctgaaagaacatcagtttcttagcatatgatctttcatcttttggaagatctctgccccttctcctttcaaagcacagcctccttctcacatttcaagactcagcgtccatgttaccttcccagatcagccttccttgaacccaccccatccacctggatctccctgtttattcttcatgagagaaccctgttctttcataggatttttctgaatttgtcatcacatacttatttccttgtttgtgtgcctcttctcaccagaccctgagcaccgtgtaagtaggaacaaagtattatttcaaagacccaagtctgaaacggtttatctgtttatacttaatggctaaggtatacatgtacacgtattctatttgactaacatttgaggtaaaaaacatgggggaaaggagcagataacacatatttttagaggatttagagtatatataactaagaaggttccctttatttgttattttttgggagggaatcctgctctgtcacccagactagagtacagtggcacgatctcagctcactgcaacctctgccctctgggttcaagcgattctcctgcctcagcctcctgagtagctgggattataggtgcgtgccaccatgcccggctaatttttatatttttagtggagatggggtttcaccatgttggccaggctggtcttgaactcctgatctcaggtgatccacctgcctcagccttccaaggtgctgggattacaggcctgagccaccatgcctggccccattttaaatcttattctcactttgaggtggagttaatctcagaaaactttgagattaagttatcttaatatcaaccttctcactttattcatttattcaacaaatgtttattgagcccttactgtgtgccaggtagttttaaacattggggatactattgaataagatagacaaagcccaagccttcctgcatcttgcttgctagtagcgagataataaataagaaaataaatgaatttataacataacctcaagtggtgatcaatactatgaaggaaatagagcagaggtaggagtagcaaataaatgggaattatggctgtcttaggcaagatgtttagacaaggctttgcttaggaggtgctatttgaggagatatgtgaataatggagtggggtgagtcataggaagcatggtcaaagagtattttgggcagaggaaacagcaagtacaaaaacccagagaaaggaagaattatgccacagtcatggaatagaaagatgaccaggatggctggagtaagaagagtgttagagcatgaggtctgagaggtatcaaggggccagaactcatgtagtgttttgtaaaccaagataaggcatttgaatttattctacgtgtgacaggaagctcttgcagggttttgagtgtggaggtgggttagggagtaacatattagctctatgaggacatctaggaggcagcaagagtagaagtatggaaaccagtttgtaggatgcttttgcagtgggacagaaaagagataagaattgctttgactctagcaatggtacaggtaatgaaaagaagtcaaacttggaatatattttgaatttagagccaatatgacttgcctggtgtcttggataagtatgagagaaagaataataatgatgactccttgtcttttttgctttgggcaactggatacaaggagtgatttaatgatatggtaaagactagggagaagcagtcgtttttggggggtggtagaggatgattaaagtttattttatacatagacatcaagtgaagatgttgagtaaggtcaaatagggcagatgcttctgaaatactccttcaaggctatttagtatctgacaaatggagcattgttacatttatggctctacttcctagcatagacatacaacatatactgggtggatggatggataactaggcatacagtcatacgtttgaggaaatagagtgttctttgtataatggcactcatagatgtaaataatcacaaccataataatatcaaatattatatattactctgtgtcaagcactgttcccaattcttaacattattaattcacttctcatatactatgatttaagttactactattatcattagtatctctgctctacagttgagaagcttattgagggtcatgtagctacaggtggccaggatttgaacccatgtactgtggctccagagtttgtgctcctacctactgcactatagttttcccgtgatcatgacatactcatcatcataaaccaatatctatatatctgtgtgaccatttggtttggggtgatggagtgataaaagtgatatttgaatgaaatatgaagactattggtgaaaaatgccaccttaatccttggaagagaaatttacttttagtataatcctattgggtgaatctgaagcacaactagattttatctcatatctgaaaggtatctaaaatatctaattagtgtacttaagtcctattaatcacacatctttgcaaggtctcaagagtctcctaaaatttcattgtttgaaagaaaaattggtagtaggccactcttgaatatatgtgggtttatactcataccattttagttaaagattttcaattcatccatggctaggaagtataaaatatttagtataacagtatgtgtattagctggaatgaatttcctaagtgttaattgttagcattactttgctcagatgaaagccattatttacactgcagtgcccctaatgaatataggaaaagatgacttgtcaacaaaaattatatgattggagttgtagagtctgcttctttttccaaagcatacatgccaccttctcttttttctccccgccataaaatccagctcctgtaggacaccttttcttctgatgcctccataggagacaactcatgctcaccatctccacctttaagaattatttctgtagtgagtcactattacagataataacccatctcctgttggtctgctgaaactgaaaaagggctgaaaattgttaaacttttgcagtgatatgtgtaatgactatatgattatcatgcctctttttattcacagcttatcaagtacctacttgacatgtagaaaggaaaagagtaaagttaagaaaagacagtttgtttctcctgaaagtttagagttgaaagcgcatctttaacacattcatacatacatccaagaaattcaaataaaataatcaagccaaatcactgaaagctgagaaaagagttgaatgttcaagtggctacttgaagtcacttcatgtgatgtatcatgtaatcctgcaaaatgagtgctgtattcctgtttttcaagtaatgaaactgaggttcagagagcaaaacgtttcattgctagtaaacttcaaactagtaaacaagaatttgagcttatatatctctaattccaggacctgtgcttttattgctaatggcttttttaaaacttgttcttcatgcttttttttattgagtgaattaagagcaggataaataagaaaaatagtatttagtaatgtattgcttaggcatgagtaacttcctatttgaaagaactgttgcgtaatcgccgtttttttttctttctttttaaatttcttctccctgcatagtttctgcatctcccagatcgcctttttgttattttgttttggcatatttatattagggactttctggaaatatttgattgccactcatataaaagagtaaatcactaaaaattagttagaaactctgagcacctggatgaggtttgggaacttcattgtatagttatttggtagagcaatttcttaagaaacccccattgcgtatctttaggttttttatcctgttactcagtacctcactgcccaaagtacctggtatcgccactgccacatccttttggtgggttaaaagtttatctggtttgcctgttggctttccttaatgctgagttccaattcagttttttctcacctactgagtaggttaccatttgtgtatctgccttccaagctttcaaaattttgtatctccagcctggacaacatagggagaccctgtctctacaaaaaaaatttcagaaaattagctgggcaccatggcgcattcctatagtcccagctactcaggaggctgcagtgagccatgattgtgccactgtgctccagcacgggtgacagagcaagaccctgtctcttaaaaaaaaagtgttgtatctgaaaggtttatgtcttttaaaataagtcagtttattgccgttttagtggggttttatgagagagagttaatgtctgcattcatttggcatctttaaccaatgttgtttatcttctgcagattccatttaatttagtttgttgtagttttagtcatccagaagtttccaatttatatgaattcagatctgttcatatcctttgcccacttttgaatggagttgtttgtttttttcttgtaaatttaagttccttgtagactctggatgttagaactttgtcagatggatagattgcaaaaattttctcccattctgtaggttgtctgtgcactctgatgatatatatatatttttttttttttgctgtgcagaagctgttgaatttaattagatcccactgtcaatttctgcttttgttgtgattgcttttggtgttttcatcatgaaatctttccccatgcctatgtcccgaatggtattgcctagattttcttctaggatttttagagttttcggttttacatttaagtctttaattcatcttgagttaatttttgtataaggtttacagaaggggtctagtttcaattttctgcatatgactagccaattctccgaggaccatttatttatttaatagggaatttatttaggaccatttatttaatagggaatgctttctccattgcttgtttttgtcaggtttgtcaaagatcagatggttgtaggtgtgtggtcttatttctgagtcctctactctgttccattcgtctgtgtgtctgcttttgtactaataccatgctgttttggttactgtagccttgtagtatagtttgaagtcaggtagtgtgatgtctccagctttgttctttttgcttaggattgtcttggatatttgcgctcttttttgattccatatgaattttatgaattttggttccatgtgaattagttttttctaattctgtgaagaaagtcaatggtagtttaatgggaatagcattgaatctataaataactttgggctgtatggtcagtcttacaatattgattctttctatccataagcatggaatgtttttccatttgtttgtgtcctctttgatttctttgagcagtggtttgtggttgttgaagaggcccgtcacttcccttgttagctgtattcctaggtattttattcattttgtagcaattgtgaattggagttcattcatgatttggctctttgcttgcttattgttggtgtataggaatgctagcgattattgcacattgattttgtatctgagagtttgctgaagttgcttatcagcttaagaatgttttgggttaagatgataatttgacctcctctcttcctatatgaatatctttgtttctttctcttgcctgattgccctggccagatcttccaatactatgttgaataggattggtgagagagagtatccttgtcttgtgctggttttcaaggggaatgcttccagcttttccccattcagtattatgttggctgtggatttgtcatagatggctctttgagatacattccttgaatacctagtttgttcagagtttttaacattatgttgaattttatcaaaggcctcttctgcaaccacagataatcatgtggtttttgtctttaattctgtttatgtgatgaatcacatttattggtttgcatatgttgaaccagccttgcattctggggatgaagccagcttgatcatggtagataagctttttggtgtgtgctggatttggtttgccagtattttattgtggatttttgcattgctgttcatcagagatattggcctgaagttttctttttttgttgtatctctgttaggttttgctatcaggatgatgctggcctcataaaataagttagggaggagtcccttcctttcaattttttagaatagtttcagtagaaatttgtacctctggtagaattcagttgtgaatgcatctgatcctgggattttttttttttttttggttggtaggctatttattactgcctcaatttcagaacatgttattggtctacttagggatttgatttcttcctagttcagtcttgggagggtgtatgtgttcaggaatgtattcatttcttctagattttttagtttatgtgcatagaggtgtttatagtattttctgatggttgtttgtatttctttggggtaagggtggtatctcccttgtcatttctgattgcgtttattccattcttctttctttccttctatattagtctagctagtggtctattttattaattttttcaaaaaataagctcctggattcattgattttttaagggttttttgtgtctctgtctccttcagttctgctctgatcttggttattttttgtcttctgctagctttggggtttgtttgctctttgaactggttttagtatcaatattgtactagcttcataaaatgagatgaggaatgtttctagtttttccattccaggaagaaaatctgagtaaaagtggaattatctgtcccttgaatgtttggtagaatttactggtaaaaccaaatgagcttgatgttttatttatgggaagattttaaattattgattcaaattatttaatagttgcaggactatgtaagttattttatttcttttttattgagttttggtaatttgtatttttgtagtaattttccacttggtctacgttttccaatttattgatataaaattattcataataattccctattatctttttaatctttgtgattttgtcccatttttcatacctaatactgcctatctatctcttttctttatcttgatcaatctgactggagatttgttagttatttcaaagaatccatttttggctttgttgaccaaactgtgttttatctttgttttcagtttcattaagttctgctcatgtcttcatttctttctctccactttcttcgttttttttctgtctttcctcctaacttctaacttattttctaatataagcgttgaaggttatacatttttctacttttttgtgtgtgggaagtacaaaaattgtcaattgggaatttcgaagtagagaaaaatatttcattctgacttttaaattgccactgtcaattgtgcctaaaattcatagtacttaccatgtcaaacaatatgattttgatatgtacctgggaaaattatgcttactaatgtggttttaatttcatcatgtttcatataggattcacctttatttgatcttattaaacaatcaaaggaccgagaaggaccaactgatcaccttgaatctgcttgtcctcttaatcttcctctccagaataatcacactgcagcagatatgtaagcaaaatatatgttatgttgaccattcaaactgcaaatagattttaagcataagtgcaatgtaacattctataaagaaactgtagggaatagaattttgaataagaatagtttctgtttttaagaaattagtaataaaaggtacatgacccaaataaagtcatataaaagagtacagagtgctactgaatcacctaggatttgcataatgagagcagttttcatggcagagttggcagtttaggtggaataggatttcaatgtggaaactggagagaatagaggagacagaggagtgtgttccaagagtcagaatggcattaactcaaaaatgtcaaaggaagcagaaaacatttttcagagtgtgcaggtcagtccatttggagtgaagcataggataagtgtagggagaagtatgggatgtggactaacacacagttgattagtgtgtgctggtgatgacgatgggaaaagaaaatgtaaacccaaatgtatctgaaacaggtctcaatcaatgtagtagtttattttgccaaagttaaggacgtgcccaggagagagatctgtgcctttctccagtgatgattttgagggctccaatatttaaatgggaaagtcagtctggaggggaaagaaaaagggtatggtaatccacatgttgcaagagaaaaagagcaggtagaggaatcgtcaattatctatccatctcatgctgagtgaatcgacattttacataagataaggtgaacatagagtcactgtctgtggaggtatttaaccttttatctgtatttatttgtgtgggaacaaaaggaaaggcagtttcttgcatgactcagatttcagcttaattttttccttttggcatagtgaattggggtcccaagtgtttattttcctttcacaaaagcaatcactaactgtgtgctgggcaatggcctaagtacttaagatttattttttcatttaatcttcataacagcccataaggtaacagatactgctgtcagcctgttaactataaaataggaattagagaaataagataacttgcctaaggtcaatagaattcaaacccaagctatctaatcccaaagtccaggctcttaatcactctaactacattgcctttcacagaaatgtgcctaatattttgtttctgtttaattctgtgtaggaactgacattacagtattctgtattagtgcaggggccattttccagagatgtcattttcatgctaacttgtacccaaagtgtttctggcatatggagaccctgccttcatgtatacatttgtttcctaagtaatgcattgtataaataagttaagccttgtttttttaaaattcaagaagcagtcatctgtaaactgccaggaagtggtgtaggcactgggaatacagaagtaagatggcctgggtccttcccctcatagagcttacattctggaggaggaacacaggcaatgaacaagtaaaccaagatgtaagatgattttagagtataataagtgctacaaaggaaataaacagagtggtgtgaaagagagaaacggagaggctgatagaatgcttagtggcactttcctttctctgataaagtgatattttgacgtcacacctgaagggcaagctgatgctagctaggcaaaaacctgcatgatgtgcattccaggcagaacaaacagcaagtgcagtggctgtagggcagatcaaacttagctggatttaggaacagaaagaaagaaatcctagtgtggctggggtattggaagaggagaatggtgcaagatgagactgaagagctaagctggggtagatcttgtagagatctccactctctagctgctatctgaagtacaggtgggtttggaggaaagggacagggcaaggcaaaaagcgaggaaaccaatttggagactatttctgtagttcagatgagggatgtaggtgacttggtctaaggtatggtattagaaatagaaatggagagatctggggtgtatttagagataaattaataggttttacattggttttatgttggatttcaggaatttggaaaatggagaaattaaaaataaccctaggtttttgacttaagacactagatgtaatgtggagctattctttgagatgggaaaataaatccagagctctgctttgttcttattaagtctgagattcgagtagttatatccggtaggtaattggagatttacacctagaacttcagagactaactttgcccaagttaggccagtttacgatactgtcagtgaactgaatgaaaatccaaagtggatactagaccagacactggtccttctaaaatcattgtgataatgggtcgcttttcttagtgtactggttaatatactacgtgttgtagaaacatccatagtaaggtacaaattctacttcctgttctctttgttcttaaagtttgtctttaaaaataagttcatttgccagctaccaaaagaaaatcagaaagtagatctagattattctgttaaataggggcagcacagaacgataatatttgtaatatctctgccttgagttatgcctgacatatttagtatggtgtaaatctgtctgaataatgttatttgaagtattaattcatagaattctgtactgtgtaatttaggtgtgtgtaaatctgtgtgtataactgaaatcttagatatgaaccatagttatcgctaaaaaaatttttagaaggagaatcacaaaaacaagataacagtatttaatatcaataaattgttttttaagctggaatcaccttatggtctcaataccactataattattaaaattgtacattatacatatatagctatttttttctaataaggcagtaatccccaggaaaagccatttattaaaatagaattagatatgatgatgacaagcagttttcctattaatatatctttcccagcttgcatttaaatagtctgctataataccaattaaatagacaagatgtatctgggtgtacaaccttgaagtgtatgtataatctgtgattcttagccaacttgaaatgaagacttttcctttaaatatatctaggtatctttctcctgtaagatctccaaagaaaaaaggttcaactacgcgtgtaaattctactgcaaatgcagagacacaagcaacctcagccttccagacccagaagccattgaaatctacctctctttcactgttttataaaaaaggttagtagatgattattttcaagagcatggactctgaaactaggctgactgggttcaaatcatgtttcttctactttctaggtacattactgggcaagtcacttaatatctctgtgtctcagtttcctcatctataaaatggaaatgataatgttgcgagatctttcttgactattcagagtcgtttttctggccggaaacctctgtgaccggtggcgcccttgatcaatttttgctcaggcccaccgggctcatttcagccccttggtctgacaggctgcactcggctcacactaccggcctgggtccatgccagccaggagcaagtcagacatggaacggagaggggtgtgtgggcaagcatgagatctggccattgcccacagtcagaaatgctggctgctgcagcggggcgggcagctccaggtgctggcacaggtgccaactctctgtgaggctgcacctggaccagacacaccacaagcggtttccacagctggcactggggaacaataaaatggctcccagaagcttggagacgccagaaaccacagggccccaaagagggagtcacagccctggctcaaggagctcccaattctgggctccccgaagggccgcagctcttctctcttctttacccacaacatggcgagcaaggggcatgtttcagccctgtttgtgttacagccctttcagcctcgccatttggtgggtcctgagttcttgtcctgcagccaggaagaatgaggtacacagacaagtggagggtgagcaagatgaagaggagatttattgagcaatagaacagcttagagaagacccatagtgggcagctcctctctgtaaccacaaagtcccgatgagtgttcagctcctagcagagaaggtagctcctctctgcaggcaggtcgtcccaacaagtgttcagttctcagcagaaagggtagctcctctctgcagctgctcgtcctgacaagtgttcagctatcagtagagagggtagttcctctctgcagctagttgtctctccatcctctgctctgctctggctgagactcgggcttctgtgggcctcagcgggaagaaagtgtgcaccgattggtacatgggcggccactagtgggcccagaaaaggtaccacaagtcctcactcctgtccgtgggactggcagcgcccacccccagccttcaggcgctccctggcctgaaggtggggcctcaacagggactcatcctctactgctcaggagcccatctgcctcctgccgccatccatgcgtcaaggggcacctgtaggccagtgccaagctgccctcagcccccgcctcggcttcccccccgtgctcgtcagcgcccaaagtctggagagggctgaggcggcagggggctggcgtgtcagcgctgccttgagcgtgcgcacatctggctgggctgcagcagcacccaggctcagccctgactttgctccgagattggagtgggcgctggcagcagggagaaaccaggcagtgggagcaggcacttctgagcctgcgagggcggtggcagttggggggtgccttccccggcccccaagtatacagagatgcctgggtccacagccacggtttgggtagctgcagctgcactggggagggtgggactcctacctgctccccagcccagagagcacagggatgcctgggtccgcagcggtggcttgggcggctgcagaagcactggggagctcctgtcccaactcggaaggggcggggttcctgcttgtccccggctcctccgggcttcctggagcgtgccgccccatccacgcctctctgctgcagcaggtgtgatgtacatacaaaagtagtgtgttgttgcctactgcagacacatttcctggatattttcaggacatttaagaaggccagtaaccaggtcatgtagcattctctgagtgtgtatatatggtggggtggggaggttgatttgagtgtctgtgcatgcgtatatacttcctagtgcatatccacttggagctctttgaaagacagtaaaaggtcatgttcctccatgataatctttttcctgattttattcaagtaagaattatgctgagctttacaggcatattgtcagatattatccttaggttagagcagtggttttcaaagtgtcgttcccaaccagcagaatccacatcacctggaaattgtagaaatgagaattctggggctccagcctagacctgctcaatcagaaactcttaagatagggccctcaaaaccttgttttaacaaccctccagctaagtctgatgtatgctaaagtttaagaccactgagataaattgttagctttaaaaatttcaaattacctcatgcaagtcgttgaaagagatatataaaaggtctttatatgatatttaaagtagatgaaggaaaattcaattttatggattcctttttgccaaatttgcattttcagtagtattttttataaactaaataaattacatattgcagtcattttacatataggtaatctacaagtttaccatttttcaacagagtatgttccattggtattttatagagaaatgtgtggtttaatttttttaggattggaaaaattcatagacactggcaattatataatttaaaaaaatgattattcctctttaatattgatagtgggaatgaccagtggtgagtgattattaatagaattgaaacaaaccctattgggtttgtctaattttacagtgtcttatgacctttcctccactacttcccacctctgccccaatttcatgccataatagttaattcagcaagtatcattctgccttatatgtacctagaaatgtgctaacacaaggaatcaattatttttaaggaaaatagtggtagaaaaatcttaaacatcaccactaaagaacttattcatgtaaccaaacaccacctgttcccccaaacacctattttttaaaaaaactcatgcctacataatgaagcctccataaaaactcaaaaggacctggttctgggagcttctggatatttgcccaactggaggttcctggagaatagcatgcctggggagggcaaggaaaatccatgccccttctcacatgccttgccctctgcatttcttcatctgtatcccttgtaatatgcctcataataaaccagtaaacatgtttctctgggggaaagaaaagagtggtagaaaagaggtttctgttaaaatgctacttaacagcattataattagagcgatttcatgatttgaaaaaaatctacttgtaattcaaaatgaacagtaaaaatgactaatttttcttattcccacagtgtatcggctagcctatctccggctaaatacactttgtgaacgccttctgtctgagcacccagaattagaacatatcatctggacccttttccagcacaccctgcagaatgagtatgaactcatgagagacaggcatttggaccaagtaagaaaatcaagcacttcaccttctctcctccctacttacttgttaactgattctttctttctttctttctttctttctttctttctttctttctttctttctttctttctttctttttctttctttctttctctctttctttcttttttttgagatagagtctcactctgttacccaggctagagtgcagtggcgcaatctcggctcactgcaacctccgcctcccaggttcaagtgattctcctgcctcagcctcccaggtagctaggattacaggcgtgtaccaccacaccttgttaatttttgtattttagtagagacaggttttcaccatgttggccaggctggtctcaaactcctgacctcaggtgatccgtctacctaaggcctcccaaagtgttgggattacaggcatgagccaccgcacccagccttgttaagtgatttctaaagaaaatattagattcaaatgagaaactagatcaatttattagacttaatatatgttcactttttggctaccatttacatttttgttgtaattcttacaaattagagctttaacactcaagagtatattttagtaactgcttatttaatgacacaaaagatcttacctgtaaaaaaaatagctgaagaaccttcttatcactggctttttctatgtagtagtgagctagatatcattttagtgtgaaaaaagcatgagacttaagaatcagttgatttaaaacaatacctattgaatgaatgaatgaagtcaattagtttacaatgagagaatcatttttcatctcctcctttttctctataaaataggttaataagaacaatatacttttggctgggtgcagtggctcacgcctgtaatcctagcactttgggaggctgaggtgggcagatcgcttgagctcaggagtttgagaccagcctgggcaacctggcaaaactctgtctctacaaaaaatttaaaaattagccaggtgtggtgacttgcacctgtggtcccagctacttcggagactgaactgggaggatttcttgagcccaggaggtggaggttgcaagtgagctgagatcacaccactgtgctccaacctgggtaacagagcaagaccttgtctcaaaaaaattttgttaattaaaaaaatatatacatatatagttaatagctttactgaaataattcacacaccataaaaaccacccatttaaaatgtacaattcagtggtttttagtatattcacagttatacaaacatcaccataatcaattttagaatttgtatcacaccagaaagaaactccataccctcaagcagtcaccccctattcccctaccccctcagcccaaggcaatactaatctattttctctctatggatttgcctcttctagacatttcatatacatggaattatataatatgtggtcttttgtgtatggcttctttcatttagcataatgttttcaaggttcatctgtattgtagcttgtatcagtacttcattccttttcattgccagacaatattccattgtatggatatacaccacattatgcttatcattcataaagtgataaacatttgggttgtttccactttttggctattatgaataatgttaccgtgaacattcatgaacatgtttcatttctcctaggtacatacctaggagtagaattgctaggtcatatgataattctatgttaactttttgaggaatgcccagatcattttccaaagtggctataccattttacatgcctaccaataatgtatgaggttctaatttctctatatcctcaccaacttttttatcttttttttttaataatagccatcctagtgggtataaaatggcatctcagtgtggtttgatttgcatttctctgatggctagtgatggtgagcaccttttcatgtgtttactggccatgtgtatatcttctttagagaaatgtctatcagaccgtttgcccattttattttttatttattttttttatttttgacacggagtcttgctctgtcgcccaggctagagtgcagtggcacgatctcggctcacggcaatcttcgccttctgggttcaagcaattcttctgcctcagcctcctgagtagctgggattacaggtgtgtgccaccacacctggctaatttctgtatttttagtagagacggggtttcattatgttggtcaggctggtctcgaactcctgaccttgtgttccacccgccttggcctcccaaagtgctgggattacaggcatgagccaccatgcccagcccattttgttttgagacatggtcttactctgtcacccaggctggagtgcagtgacatgatcacagctcactgcagcctcgaattcccgggctcaagtgttcctcccacttctgcctcctgagtagctgggactataggcacacaccaccacgccgagctaatttttgtatttttttgtacagatagggttttgccgtgttgctcaggctggtcttgaatggttgagctcaagtaagccacccaccttggcctcccaaagtgctaggattacaggcatgagccaccatgcccagactgctcattttttaatagagttatttgtcttgttattattgaactgtaaggggtcattatgtagtctacatacaagtcacttatcacatatataatttgaaaatattttctcccattctgtgagttgtttcactttcttgttagtgtcctttgaaacacaagttttttattttgatgatgtccaatttatgtagttgttttcttgttattgatgctttagtgtcatatctaagaaaccagtgccaaatctgaagttgttaagatttatccctgttttcctccaaaatgtttataattgtagttcttacatttaggttttgctccattttgagctaattttttaatatagttgaggtaggggtccagcttcattcttttgtttgtggataactagttgttccagcaccattttttgaagagtttttttctctcttcattgacagttgtcaaaaaatcagttgactgtaaatatataagtatttatttctggactctcaattctgtttcatatgagatctacataagctattcttatgtcaggactacactgtacacttggctgtaggatgccaagcaaaaatgattatttggcattcttggcaatagtaggtaagagcaagaatgttgcagaagcaatgagtacttaaattaggctataaagttcatacaaataaagaaaatctgacattttaaagtcacagggaatcattttcagatcttatttttgcatttaaaatatcttttattgaaatgtaatacacatatgtaaaaacctgtgtatcaaaagtatacattctaacaaaaattcatcaactgagcttagttatataaccagcatccagatcaagaaacaaaacattgtcagcaacacataagactctcttacatgctcttccagtcaccatagcctccttaccaccaccaccaagtgtgttcaatattattttatctaatagtttgaaacattttcacacctggctttttaaagtgctagttatacaaaattaactgattctactttcaacttttctgggaaacatttaagggacaagagccaaagttagggtaatttacaaaccaggtgatcagtcctgaataattgagccttggtgatttgcattttgttctttaaacacactttgggttaaacacttcatgtagactttcaaactgagctcagtatggaaagaaataactctgtagattaaacctttcttttttgaggctaaaagaaagaaaatggtattttttaagaacaaaaccatgtaataaaattctgactacttttacatcaatttatttactagattatgatgtgttccatgtatggcatatgcaaagtgaagaatatagaccttaaattcaaaatcattgtaacagcatacaaggatcttcctcatgctgttcaggaggtaggtaattttccatagtaagtttttttgataaatccatatccataacataacataggtaattcatttgatctcatttattcattaatgagatcatatattctgtctgaccttattatgtaaattcacaaataaaaacttttatattatttatttgtaacttaaatagaattggaaagataagggtaattatgaaattacccatattcatagttttttataaagttaataaataatattttatccctgtaataagcaggtatttgtaataaacttgacatgagtcatagaacattagatattctttgaagttatttttattactttataggaaaagccagtataaatgcagccttgcaaatcaataatacaaatgttcagtataaacacattttgtgtttccggtttaccttccctttagagaaatagtagtagtaaaatatacttggtatgacacatttcatattgttctgtggaaagtgagttgaggggtatttttcccatttattattggagttttcaaaagtaatacaaaccaagtcatttttgtttgtatgtttgaagttattttctaaattcaatcattttaattgtatatatcagaggcatctgatataacctctgtgtttttccctaaaatttgagtgaaatctaactatcactaaaatatagtgcttttactaaatgtctacttcttgcaattgcgtaatgtatactgaaacccttatagattgggggggataccgggaggtacaggccagagaatgtagtccaaatattggtggataatattattggctttcgctcagctctggccctttgattcccatcatgctttccattctaccagtctatctactcctctcttcccagtctatatactcttctcttcttggatggccagctcttccatctgctgctgcctggctatttctctcaatcattctgtgacatttcacttctagaagagcagctataatccaagcctaagaagtaattttatttatttattattttttcctttataatatgtgcttcttaccagtcaaaaagtattataaactattagaaaagaaaatctaaaggtagaaattttaaaattcatttaacaagtaaattttacttttttttttttttttttttttttactgttcttcctcagacattcaaacgtgttttgatcaaagaagaggagtatgattctattatagtattctataactcggtcttcatgcagagactgaaaacaaatattttgcagtatgcttccaccagggtaggtcaaaagtatcctttgattggaaaaatctaatgtaatgggtccaccaaaacattaaataaataatctacttttttgtttttgctctagccccctaccttgtcaccaatacctcacattcctcgaagcccttacaagtttcctagttcacccttacggattcctggagggaacatctatatttcacccctgaagagtccatataaaatttcagaaggtctgccaacaccaacaaaaatgactccaagatcaaggtgtgtgttttctctttagggaagtagtaaagaatgagagggggattattttgatccaagaataaaaaatataaagcattcttcatttcaaataagctagactcttgaaactctatttgcttatttaagtaacataataagaatatgggggcggggtgaagaaaatctatttacgacttaagcaacgcaagatggccgaataggaacagctccggtctacagctcccagcgtgagcgacgcagaagacgggtgatttctgcatttccatctgaggtaccgggttcatctcactagggagtgccagacagtgggcgcaggccagtgtgtgtgcgcaccgtgtgcgagccgaagcagggcgaggcattgcctcacctgggaagcgcaaggggtcagggagttccctttccgagtcaaagaaaggggtgacggacgcacctggaaaatcgggtcactcccacccgaatattgcacttttcagaccggcttaagaaacggcgcaccacgagactatatcccacacctggctcagagggtcctacgcccacggaatctcgctgattgctagcacagcagtctgtgatcaaactgcaaggcggcagcgaggctgggggaggggcgcctgccattgcccaggcttgcttaggtaaacaaagcagccgggaagctcgaactgggtggagcccaccacaggtcaaggaggcctgcctgcctttgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacaaggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacacagttcctcaccagcaacggaacaaagttggacggagaatgactttgacgagctgagagaagaaggtttcagacgatcaaattactctgagctacgggaggacattcaaaccaaaggcaaagaagttgaaaactttgaaaaaaatttagaagaatatataactagaataaccaatacagagaagtgcttaaaggagctgatggagctgaaaaccaaggctcgagaactacgtgaagaatgcagaagcctcaggagccaatgcgatcaactggaagaaagggtatcagcaatggaagatgaaatgaatgaaatgaagtgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctctcggcagaaaccttacaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctcggataaaacagactttaaaccaacaaagatcaaaagagacaaagaaggccattacataatggtaaagggatcaattcaacaagaggagctaactatcctaaatgtttatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacctttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacacattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaggaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacagccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacatatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagatgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagagatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcgatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactcaagagcttctgcgcagcaaaagaaactaccatcagagtgaacaggcaacctacaacatgggagaaaattttcgcaacctactcatctgacaaagggctaatatccagaatctacaatgaactcaaacaaatttacaagaaaaaaacaaccctatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtagcgattcctcagggatctagaactagaaataccatttgacccagccatcccattactgggtatatacccaaaggactataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcacaccagcatggcacatgtatacatatgtaactaacctgcacaatgtgcacatgtaccctaaaacttagagtataataaaaaatataaataaaaaaaaaaaaaagaaaatctatttacttggatgggtttacagatttagttatcagctttcctgactgttaggtatcttcttttgagaacaatttgagaaccagtttggttatatgtttcaaaacacttttatattttttaaatagccaatctgctaaacaaagcaggttactttaggttgagtacttttagtttgcagtttattggatgtcctgtaagttttgcttcctgtggatttttttccttttgcttgttatattaaatgtagattactgtcaattaagtctttagaggtccatccctaatcctgctggcggcctctttaccacctcaccttgggcaggtctctatctgtacttcacaagggtgctgtggatcagggaaatgatgagtatgaagctgttttaaattctcagatgaaaggttgtatgcaactacaaatcattatattatcttccacatccaaccacaagtgctctctagctttgaagtgcttcagttgactaattatatgttatcatgggctatttgaaactgactttatttgtgtgaagtaggaggcagattagctagtatagttaatgtagtctcatctcagaaattatcagcccatatggttgtacctaatgggcaagaaaagggggcatatgttggcctttcagaaaatatttgcatggtatatttaattatttaagtagtacgtactcattataaaaatttcaaactctacagaaaaatatgaagtaagaaataattggcaatatgatacaaatgctctcatgtgtctctgtatcatcctttatttatttggtgttcttgtagttggatatctgtgtactgatatctactacttgttctaagctgctaagatgccacgtcatgtctatttaagaaaatttacattgttccatgccactatatgaaaatgtatacttaggtagttttttttaatagtgataattagtccatattatggtgataatgatggctacttgctgatccttagtgaaataaattctgtgttggtattcttcagcaaaaacgtcacattctgaacatcctaactaataaatcattgaccaggcattaggagagcatcttaacactctacccagtacatttaggtactctggttaatcaaatattatatgtagagtgatggccacttatcaaggaattggagggcaaaaaaatctctatattcactagttccatgttcatgttttcaaatctttgtcgagtcatgtcaggctaatgatgttcttcagctttattataaagaacataaattatatggttcaaataaagacagactaataaagatttctgactctatgatatatgataaatagcctttactatatcaatatagatgctaattagaattctgattattacttaatattctaagttttttccaaatataacttgaattttaaatgagaaaatatgaaagaaatttgataacttacccattgatttatgaagaactaagtaggggtaaccttgaaacttgcctttgccctccctaaatatgggcaatggcagaatatgttcttgcagacctataacttttgctttaaaactaagagactaggtgagtatatgattagacgggcactgttagaataattcccaaatgaatatagtttgtcagtggttctagggtagaggtaacctttaatttggtattcctaatagttcagaatgatgtatttatgctcatctctgcaaaattgtatatggttttttattactaattggtatttcatcttaacttgacagaatcttagtatcaattggtgaatcattcggggtgagtattttctttctatgaaatataatagtatgcattgtaagtataaaagaaattaaagctttctataatttgaatttccaaatgcagttattcaaacacctcatccaggcatattgcatagaattttatgagatatatatatctcagatttactttcaaatcaagtttaatctcaaatcatactcctaattggtgaacttcaaaacttttctaaatatccacttgagattatataatacatatatacatttgtgtatatacatacatatatacgtgagctgtttttgctcacaacatttctatcaccaaatgtgtgagatttttttctcacccaaatctattcttcaactctctggtgttctacaattcaattcaattctgacactaattacccagagtcagcatcagactccacaggttcaagggctcagtcccacaaaaatggtctcactgcagacaccagtcacaagtgtcaggtccccaggctacaccacacttccgtctgacttgaatacgaagttggggggttccgatagtgcctcttccttacagtttgatccactgccagaactactcacaaaactctggaaaatattctacttactattatcagttcatcataaaagatacaaatgaacagccagatgaagaaatattatatagggtgaggtccagaagagtccctagcacaggggcttctgtccctggggagttggggtgcaccaccttcctagcacttagacatgtttaccaactccaaagatctcccaaccttattgttgaggggtttttatgggggtttcattatataggcataattgattaactcaatttccaaccccctcccctccctggatagagggtggggctgaaagttccaagcttctactcaagacttggtctttctggcaaccagcttccatcctaaattagctaggtacccaccaagtatcacctcattagaacaaaagatggtcccatcacccttatcacacatgaaattcgaagggttttaggagctctgtcccaggaaccagggacaaagaccaaatatctttcaatgataccatgtatgtatgtacataacctcacaggaatctttataaaacaattttgaaattcactcattatgagtgtgatttgaaatgagatactccaaaatgtaagcccgatatccaaatgtcaccagcctgtccctgcctactggtctccttccatacatatgcactttttgcttgtccttcctctcagacttctaggatattctttttctggtacactgattaggaattgtttgcatgagatcctgcctcagtgaaagtggcagagcttcattctaggagatccaagggaaagctttgctttgaaacatttattctaggctgcaaatccacaaccctagttggccttccattaaagtcactaattcagcagtcccatattcaatatgcattactgttaatatgttgcaccatctccattcccctgagagcttatatttttaatttttaaatttttatttttagagacagtgtctcactctgtcacctacttattataacctcaaactcctcggcccaagcagtcctctcaccttagcctcccaagttgccaggactacaggcatgcaccaccatgtccagctaatttttaaattttttgtagagacagggttttctatgttggccagattggtattgaactcctggcttccacgataccccgtctcagcctcccaaagaactgggattacagatgtgagccactgcacctggccagagagcttatattcttataggaatgggaagactgcctatgttatgtgttgctacataatacattacccccaaacttagtgacttaaaacaaacgcttattatctccatttctgtgggtcaataatctaggcatgacttagctgggccagagtttctccaaagtctgtgatcaaggtgtcagttgggctgggcctgcagtcatctcaaggctccactagaggagcattcactggcagacttattcaaatggctgttggctgatcctcgatggctattggcccctctattggtttcttgcccttgggcccctccatagtactgcttgctattcacaacatggcagcttgctttgcccagagcagggactctgagggaggcagggaaataaagagcaagagagaggtcacagtcttattgtaatctaattctggaaatgacagcccattacttttggcatattattttggttagaagcaagacaacagtagatctagcccacacacgaggggaggaggatcacacaaggaggtgaataccaggaggtggggtcattgggagccatctgagaggctgcccaccacactgcctcaagtaactagggagaggtaaaagtttatatgccagatgaccaaatattaaaatgtgtgttacaaatagttcacgatgggctcagctgtcagactttacaaaggagctatgggaccttataaggacagttggaactggctaggtatcacatagtggtcttcaaacatttttgcttgccataacctctaaaataattgggaaaaagttgaatgtacttccatatcttaaagctgataatttaaaatattatacatttaatagcagcacgggatttagtttttgttaaattgtatatgtgctccaaatagatttaccatcaaaacctgttttgaatttaatattgggagaattcgctagtttaatttttggaaaataaagtataattggcaaagctaatcctcactgttgaatctatccgtcaaatcagatataatttctatcagaaagtctatatgacttgtcaacataatacccataaagtgaatcaaaaattattattcattgaacacatcatctcttatcaaattcttgtgaccttccttctggttgtataatagcctaaaaaacaaaaaaaggacaaaagcaagtttccagaaagctgttctgacttgcctacttctgaaaagtagtcctgtatggtgggttctgaaaatgaggaaccaggacttgcagagtaggcagttgctggaggaagaatgtgagctgcatgggaaaagacaggaggatttacaaagagtgggtgtttaattggggatggaattaggtagttattctgatttttagatttttcatatcttttatttggtccaatgaagcagaaaatttaaatgaagttattacctttgcctgatttttgacacacctcaaactataacttgaggttgctaactatgaaacactggcatttaatgatttaaagtaaagaattctgtaatttgtagacttctgagaagttccagaaaataaatcagatggtatgtaacagcgaccgtgtgctcaaaagaagtgctgaaggaagcaaccctcctaaaccactgaaaaaactacgctttgatattgaaggatcagatgaagcagatggaaggtaggaaccagttttgaatgttttccagtagccgagatggtcatctggggaatccagagtctcagcactgctcctggcttataccaatttctttcatgccaagtttatttggaagttgtgagaatggctcaaaataatagatatgagtgtagtgcaaagttaaaaacatcttacaaattgcataccaacattcagtgaagatatctaataaaccctgatcttttttacaaagctattgataaaattttgttattcttaacattaaatttaaaaatgtttactcttgaaaaatattaaccactgtattttgtgagaaccactgaaaaaatacatagcatcataaatttgtgacatttatgttttagatggttagtttttaaattttaaaattaaaagctactcactaaaataatagcataaagtaagtcatcgaaagcatcatagttactggaaatttgagttttccatttataaatacacatgaaatgttttgcatttttttaatctgcagtaaacatctcccaggagagtccaaatttcagcagaaactggcagaaatgagtaagtacttttttcaccttgtgtaaatgaaataaacaattgtttacactgcaagaagtcttttcgttatataaaagaatgtataatttcttcagttggcaggtttgtttatgcatttaaaatataattcaatcaaggttatttatctacaaacatttgtggattaaatgtatgatgtaaaatgaaggtcatttttaccctttctatgatctttcatgcaggaagactaagaagtgaaacattgcttgaccacattcaacacaaatggctacagttagaaaatactttagcagaactacaaagaggagctatttgggagtgttagatatagggaaaagttttataaacctagcatatgtaaacatcatcacccttatttaaggaataacctttgattctaccatttttaaactttccttatttgcaaatcttaaaacaatttcaaacaaaagtttccattactggaaatcagaattttaataaagaacacttatgtcattttccaagttatacagagtgatatcatgttagggtaagtggaattctattcaaaactactctgagactagacaaaaaaaataatccaaggatagtagatggaaagcacattaggaaagagataaatgttcactaactactattgggttgtcttaggtagttatggtagtgagtgtaacatttcccagtatctgctgccagatccattgataggaaaaggaactgggattttgaaagaagacaaatattcaggagataggtgttaaaacaatcattcctaggtcacaggacacactaatgagaacaataccaattaaaatgagaggctttcttttaatacatctttgtagatactaactttgaaaataagatatttaaaaggatgctttttttctatgtatttttttaaagtgtaattaaaactaaataactaaaacaaaattttctagttataaatgaatctctttttggattttatgtcaacttacatattcctattttaactcttaaatagttgcatcttttcccctcagtacatgaaaatagacaagaggctcataaccaaaatcaggccttgaagacatatggaaacattttggaacccacaaatatgcacttaaaaaggagctgaaagctgtaaaaacatgtatattttcttagagaagtgttcagttgctatagttagtacatttcccagtgacacacttagctatgatggcgagcttcctctgccaggccaaagttcaggacctttgtgcatctacaaaattgtgacaaagcaggcagaattttaacccctgaggctaaggcatttctttaggatgctcttcagcttttcttaaagaattacatttagaaaagatcatcatacaatgctggattgcccagaatggaagggcattccatttttccaaatgtgcttctttataaagaactcatgcctacctctaaaatcaagttaagaatttttaagaaatttaataagtatcccggctttgtctatattgtaattcataatatgcttttaacatggccatgccccgggtaggcatgatggcttatgtctgtaataccagcactatgggagggcaaggtgagaggattgcttgaggccaggagttcaagaccagcctgggcaacatagcaagaccccatctttacaaaaaaatccaaaaattagccaggcctggtggcatgtgcctgtagtcttggctactggagaggctgaggtgagagaattgcttgagcccagaaggtcaaagctgtagtgagccatgatcatgccactgcactccagcttgggcaacagagcaagaccttgtctcaaaaaaaaaaaatccatgcccagtttaaatgagctatgatttgatgtatttgcagtacctgcaaggcatctgcaaacataagggaacctatagctttgtaaagaataccaccactcactctggcagattcagtctgggccagccgagtattctagtctgctgaagtatatgccaagcatcaaccacctcatctctagaatagtggcctacaaaatggggcatacctgaagtatgcaaagtcatcttttggggtacataaagtagaagttctatttatctcattttaatgtttgcttggggtatgtgttttataatttgtacatacatacgtatttttgtggtacaggcttggaaaaaaatttactcacagggatatatgatttttaaagatttggagaccactgtttttttggggggtggggagggaattttttttttaattgatatatcatagttatacatattttaggggtacatgtgatgttttgatacgtgtacacaatgtgtaatgatcaaatcagggttattgggatatatatcacctcaaacatttttctttgcattgggaacattacaattctagctattttgaaatatgcagtaaattaactgtaactccctacggtactgtcaaatactagaatgaagaccactgcttttgcaaggtcctgagcgccatcagtttgacatgagcataatatatatggcagccacttgccaacttacccagtaccatcaatgctgttaacagttcttcatcctttttccagcttctactcgaacacgaatgcaaaagcagaaaatgaatgatagcatggatacctcaaacaaggaagagaaatgaggatctcaggaccttggtggacactgtgtacacctctggattcattgtctctcacagatgtgactgtataactttcccaggttctgtttatggccacatttaatatcttcagctctttttgtggatataaaatgtgcagatgcaattgtttgggtgattcctaagccacttgaaatgttagtcattgttatttatacaagattgaaaatcttgtgtaaatcctgccatttaaaaagttgtagcagattgtttcctcttccaaagtaaaattgctgtgctttatggatagtaagaatggccctagagtgggagtcctgataacccaggcctgtctgactactttgccttcttttgtagcatataggtgatgtttgctcttgtttttattaatttatatgtatatttttttaatttaacatgaacacccttagaaaatgtgtcctatctatcttccaaatgcaatttgattgactgcccattcaccaaaattatcctgaactcttctgcaaaaatggatattattagaaattagaaaaaaattactaattttacacattagattttattttactattggaatctgatatactgtgtgcttgttttataaaattttgcttttaattaaataaaagctggaagcaaagtataaccatatgatactatcatactactgaaacagatttcatacctcagaatgtaaaagaacttactgattattttcttcatccaacttatgtttttaaatgaggattattgatagtactcttggtttttataccattcagatcactgaatttataaagtacccatctagtacttgaaaaagtaaagtgttctgccagatcttaggtatagaggaccctaacacagtatatcccaagtgcactttctaatgtttctgggtcctgaagaattaagatacaaattaattttactccataaacagactgttaattataggagccttaatttttttttcatagagatttgtctaattgcatctcaaaattattctgccctccttaatttgggaaggtttgtgttttctctggaatggtacatgtcttccatgtatcttttgaactggcaattgtctatttatcttttatttttttaagtcagtatggtctaacactggcatgttcaaagccacattatttctagtccaaaattacaagtaatcaagggtcattatgggttaggcattaatgtttctatctgattttgtgcaaaagcttcaaattaaaacagctgcattagaaaaagaggcgcttctcccctcccctacacctaaaggtgtatttaaactatcttgtgtgattaacttatttagagatgctgtaacttaaaataggggatatttaaggtagcttcagctagcttttaggaaaatcactttgtctaactcagaattatttttaaaaagaaatctggtcttgttagaaaacaaaattttattttgtgctcatttaagtttcaaacttactattttgacagttattttgataacaatgacactagaaaacttgactccatttcatcattgtttctgcatgaatatcatacaaatcagttagtttttaggtcaagggcttactatttctgggtcttttgctactaagttcacattagaattagtgccagaattttaggaacttcagagatcgtgtattgagatttcttaaataatgcttcagatattattgctttattgcttttttgtattggttaaaactgtacatttaaaattgctatgttactattttctacaattaatagtttgtctattttaaaataaattagttgttaagagtcttaa

SEQ ID NO: 23 - DNA, 79446 bp, Homo sapiens
ggcgtggcggcgctggagccgggaagggggcgcgggggagagatggtcgcaagatggcggcgctgaaggaggataggagctacgggctgtcgtgcgggcgggttagcgacggcagcaaggtgtcggtgttccacgtgaagctcaccgacagtgccctgagggccttcgagagctaccgcgccagacaggtgagtggcatggcgcccggcgcgccagtggggaacgtccggacgcgggccggcctcgcgctcccctcactgaggcgtccgggctcggagacgctaggtctgtggtgctgctcgcgggtccctgggccggcggggcgcggagtgggcgccagtccggcctggagcgctgagaaccgcgttccttctcagcactaggaggcaatacaggcgggtggcccggggctgctgaggggcccagactcgcgcgccgggcccggggggcgtcggtgtcggcacctggcggcgtccggggcctttctggcctgctgggcacctgggcagggtccagtttgcgcacctggcggcggggcgaggaggcggtgggccgcacggtcccggcaccgtgatagggggaagctgggggcttttccatctggggccggggcagcgccgttggtgggggtgactgtgtctgtcctcctgggaagcagcgatcgtctgggtgcccggcagggggtggtcagcgaggcacttgtgggggtctgttctgtctgggtggaaggctttgcagctgggggctggctttgacgcgttccgatgaagccactcaggttgggccactttggttcttgggacggggagtttgggcagaaactgacagcttgtcccagctttctgctccccttacccccaggtgaccctctctctccggagagaggttccttggagagtggaagtgttgggggcggctgtgatgttatcctcagggcacatgtaggggatccctgccacccaggaggaagctctggctaccacatctggccgctgactctggaacttctcagaggccgatttgggcccatctgggggaagtttgaggcgtttcggttctgccacctggctggtggtggggaggggaggctgctgtgtatgttctcttgggcctgactttggggcgcatctggggccgtggtcagaaacctgcctttttcatttctgtttgtgtcatggccccccctccccccgtctgtgctgggtcagaagttgcagatgaccagtggtcaggtcccgaggggaagtggtttaggaaccttgtaactccttttctggaaattgggggcttcattgccctaaagggagtgggggtgggtctagtctcgggctcagagagccctgctccctgcgtgtgtgtgtgtttgtgtatactgttgatggtgggggtgggggggtgccgcgggcgggggaggagggagactaactaggaaggaatgtggctttcttcctgccccgaacttgttcagctccattagctaagccgagaatttcttccccctgtttcgtttccaccactctcccggtgcccaccccttccgtgcttcttcccatgtctttgggcaatttcctccctgtcccggtgtcgcagttttccccttcatggaatgaggatttcatttttttttgaaagagcaagttcgcaccttgtcaaaaagactccccaagatgaggctaaggcgcccctgcaggtgaggaggagacagtggcagcgacagcagctgctggcccatgaccagccagagcctctcttcctggtagaattctggccctgggtctttttccctgagcgattctgacttgtcctgcaggaaggcaggctttcctagaaacagctgggggagagctcgtgagtcatataactacgatggacttggtacctggtcaccactgtcttctgtgctttaggaaccaggagctccgccttctctctgatgctgccctcgcttgcttttcagtccagaaggtccgcctgtgtgtccacctcatgctgtcacactgctatttttactttagggtattggttacatcccctctctaagctggatcttcctcatgttagggtgaaggtaactgtggactgttaaactcctctggctcggagcccagctgtgtagggcagtgtgttgaccagccaggaggggcttcctagaagaacttttccaagccatccagagcaacttggctggctggattatattttggggtgattcaaacttggatttttctcaaaaagctgtctggtaatttaagtggcttggccactttctttctttctttctttcttttttttttttttttttgagatggagtttcactctgctgcccaggcttcattgaggtggcgcgatcccggctcactgcagcttctgcctcccgggttcaagcgattctcctgcctcagcctcccgagtagctgggactacaggcacgtgccaccacacccggctaatttttgtatttttagtagagacagggttttgccatgttggccaggctggtcttgaactcctgacctccagtgatccgtccttctcagcctctaaaagtgctgggactacaggcatgagccactgctcccagccagcttggctactttcgaatttaatcttgcccatggggcagtatagtggatggacttttctaaggcacggcagctccgtgctctctgtggttttgggtagtgagcttgaggaaggtggcttgaagaacttgattgtgtaaccagagaaatatactggttatggacaaactctcatgtggacaactctatcacccagaagccagagttttgtattcctcgatgctgtggttatatagtttgccaattgcaacttgtggagagggcttttatttttaatttcttttttttttttttgagacggagtcttgctctgttgtccaggctggagtgcagtggtgcgatttttcgtgttagccaggatggtttcgatctcctgactttgtgatctgcccacctcggcctcccaaagtgctgggattacaggcgtgaccaaccgtgcccggcctatttttagtttttaattgtgaagaggcttttacaaattcaggtgtggcaggggctagaaaggaacttgctgtggaactttctctgtggctcccaggagcaggtaatcctagctctgggaacagcccaggtagaagccctcctgttttctctccccagagggctctggtgttgacctggtagccagctggagcagcgtggtggaaggtaaaggcgcagcagtacacatagctgctggccttctcactctaccttggactttgtgcagtttttctttccttttttttttttgagacagggtcttgccctgtcgcccaagctggattgcgctggcgtgatctcagctcactgcaacctccgcctcccgggttcaagtgattctcctgcctcagcctaccaagtagctgggattacaggcacgcatcaccgtgcctggctaatttttgtatttttggtagagatggggttttaccatgtggtcaggatggtctcaaactcctgacccctcaagtgatccatctgcctcagcctcccaaagtgctgggattataagcttgagtcgccacgctgggccccctttttttttttttttgagacagggttttgctccattgtccaggctggagtgcaatggcatgatcatagctcactgcagcctcgaactaccaccctcctgcttcagtctcctgagtagctggggccacaggtgtgcaccactgcacctggctaagttttaaatttttttgtagagacggggtctcactatgttgccaaggctgatttcaaacgccggggctcaagtgatttccctgcctcagcctcccaaagtgctgtaattacaagagtgagccatcgtgcctggcctagtttttgttgttgttgttgttgttttttgagacagagtttcactcttgttgctaggctggagtgtaatggtgttatcttggctcactgcaacctcagcctcccaaatagctgggattacaggcatgcaccaccatgccctacaaattttgtacttttagtggagacggggttttaccatgttggtcaggctggtctcgaactcctgacctcaggtgatcctcctcccttggcctcccaaagtgctgggattataggagtgagccttcgtgcctggcctagtttttctcttttcttttcttcttcttctccttcttttttttttttttttgagacaaggtcttactctgtcacccaggctggagtacagtggtgtgatcatagctcactgcggccttgaactcctgggcttaagtgatcttcccacctcagctgcccagagtgccgggactacaggcatgagccattgtgcctggcccagtttttttctttttcttttaattaaaaaaaatttttttttgtagagatggggtttccccattttgcctaagctggtcttgaactcctgggcttaagggatcctcctgtgtcggcctcccaaagtgctgggcttacaggcatgaactacgtgtctgtttttctttgaatataaaaacctgcatgggatggccgggcgtggtggctcacacctgtaatcccagcactttgggaggctgaggtgggaggatcccttgaggtcaggagtttgagaccagcctggacaatatggtgaaaacctgtctctactaaaaatacaaaaaaattagccaggcgtggtggtgcatgcctgtaatcccagctacttgggaggctgaggcaggagaatctgggagatggaggttgcagtgaaccgagatcgcaccactgcactccagcctgggtaacagagggagaccctgtgtcaaaaaacaaaacgaaaccttcatgggttgtgaggtggctgttcttgtggatctcccggtttgctctgatgagtgatttctgggagaggggagagtggaagcatggacacaccccctccttccaggacagtgttactcacctgcttggaaaagtagcctctggtcagtctgaggaagtgaccctcccaggggcacttgggttgtagttcatcattaggtgtttgcatgggctctgttgctgagtgacctcttttggatcacaagctccttggtggagaggagcacaccgttgttcagaaaaaaatgagggcccaggaagtgcttcaggaggcctggggattagagcctctctccatttgaatctcagctccacctgcctcctgaggccatgggtgagtgcctgacccctcccatctccgaatccttctcagaactggggtcagcagtacttgacctgctccctcaagttccagatccttctctcagggctgtgaggatcctggtgcctgaccctttctgagttccagattctcttcctcttgggaggagaataacctgacccctcttgtgctctgagcccttagtgaatggacccagagctggctcctggggggctggtccctgcctggaggttcgtacagagccggtgggagactccagatcactcatctaacctggtatgattgagcctctggtcagtgcccatggctcagggcgggatacccaccagtgattgagatgggcccctcatgtcacgagctgacattctagtggcaggagacagaattcatgaacaggaaggatggcacagaaattagcaagagtaactcaccggcggtcaacgttaatgatggtgaggggtataggtggggcagtcagtgagtgcttccagcaggtgacacggagctgcagtctgctgggggaagggtcccaggcatggccggtgtgctgtcgcagggaagggtgtgaagggagtggaggtagaggggtgctgtgcctcaggcctgtggccagtactcagctcttctgggtggccctggagctgtgctgggggctactgtctgctgctaagtgggtgggctgtgtggatgtcacccttggcaccggtggcaggaggagccttacttcagcctgtgatccattctcacagcagggccccagaggcccgacttatcttcccttcccggtgggcaccccccttggttctgagcagggcagcttcttgccagccctgcctgcttttcagagaaggccttctttagagacctagtgctagtgctgcccctgttggccctgggctagacccccatcccttcccatgggtgcacatcatcttgaccacttgccgggagaggaagtttatggtcccccttcacgacagggacagatgaggctctgagaggcggcatcacctgtccaagggtgctcggctgtcctcactggcccatactgcctcttgagtgctcaagccaaactatcttttgaggttgcaggggtcttgacctgaaggggagtcacactggggtcctgagcctcacttaaatgcaactttccgcgtccccaagaggcccgaaccttggtgacgtgagtgactgagcagattcctccggttgctggctatgctggaccccctcccccaagaaagtggaaaggtgatgggcacctacacctgtggagggtgccccaccccgccagtgctggctgtgccacccacagtactgcatttcatcccatcttccccgtggtgggagcagttcccatttcttaggtgaggatatgggtggagactctggaggaggctgaatcaccaggcaggatctcccagctgggaagtagctgagaactcagaatccaagtgtcatggcctgggctctgccacctctgaaggactgtggccgctggatgggctggggtggaacaggtgggctgccaggaggcatcaggagtggcccactggtgcaccagggtatggtttgcctgtgtgtttcaaggtgagcatttggtggttctgggtggattctcccagaaggtgctagaagaggacaagccagcttgagtctgtgggcccgagctggcagtctctgcaggaggcaggcaagagtgtgtgtgagggactgagctctgcactcggcatcgtgacccttgactgtgctttcagctggttgccgtggctgtgattgtgtgtaaacagcaggcagcgctcactcggaaacccacccctctgttgactcacggccaaggccgtagttcatcacctttgaagcagttttgacatcacacccggattgtgacatcccgactgggagaccttgagggaggaacccgccagcctgacaaacaggattgcctctctgctccacgtagccctgggctcgaagcagctgcccagggaagagaccctagttttcagaggtctgcttctcagggggcatcagccttgtttaaggcacctggcagggcacagacttgtgattgatactgcacattttgggtttggcctcttctgtgtcctttgttttagggtcttgctccccgttgtgctttctgccttgatgaattcagttgttacactttctccttggtctctgaatctcatggacagggttgtcttcaatctcacctgtgtagtcagccacagagtccaaagggaaatgtagaacaatgcatccaaatggcctgtgacctgcaggtgcagtgaatgacagagatggccatgacatgtggttattttgtcactttgcttttttttttttttttttttttgagatggagtctcactctgttgcccaggctggagtgcagtggtgtgatctcagctcactgcaaactctgcctcccaggttcacgccattctcctgcctcagccttctgagtagctgggactacaggcgcccgtcaccacacccggctaatttttttgtatttttagtagagatggggtttcaccgtgttagccaggatggtctcgatctcttgacctcgtgatctgcttgccttggcctcccaaagtgctgggattaacaggtgcgagccaccgtgcccggctgtcactttgctttttaatgaaaaaagctggtgtccaaataaaccatccgcagggagactattctcccagataaaagcgtcctagagacctcccgcctccatctgacctggcagtgggccccagagtctgatgctaattatatcctccagggctggaccctcctgaccaagtggagacacggctcctgactgaggcagccaggccagcagatgtgtttgtgaaggggtagggcttcgagttctggtcaagtttgtggaataactgaattccgatttttttgttttgttttgttttgtttttgagatggagtctcgctctgtcgcccagtctggagtgcagtggtgtgatcttggctcactgcaacctctgcctcccaggttcatgccattctcctgcctcagcctcttgcgtagctgggactacaggcgcccgccaccacgcccggctaattttttgtgtttttagtagagacagggtttcaccgtgttagccaggatggtctccatctcctgaccttgtgatccgcccgcctcagcctcccaaagtgctgggattacaggcgtgagccactgggcccagcctgaactcctgttttaaaagcatcctgtgaagttttttttttcctttttactatataagcagtataactcagggtagaaagcctgcaatgtacctaaaattagcaagtctgttctcattgccccaggtaatttctgttgacacctttgcaccctcctctgtctcgcctgggtgtaccgtgttgtcatagtggcacaatcatatggttttgcgtctcttcttccctgaacactttatgttttaatgctgcaccttctgtgcatcgtggagcctgacaggtcagtattcttcgggcatttttgtgttcttggcactatgcttggttctggggatgtccggatgctgcaggccttgtgtgtgtacaggccagtccactgtcccgtagtgaggctacatagagcgatgaggtgaggtgaggcaggtgacccagcacaggccacggcctggcatgcccatgtgtctgtgagtggagcctggagtatgaggctgcgattttgaggccagggaaggcagctcagccccgcttggcttgctcctctttggacaaattgagctgctggtgatggagggctgtggtcagtccttctcaccgttcttcagatggggagaccgcaagtatataccctactgttaacacccctgtccttcccccaggcccatcgggggcctcagctcttcatgagatgctgttgttgcgccccgtgtcctttttatatgttggtgaaaatgttttcacaaagaggcgtctctcttgaaggatgctgagaactgcatattggggatcaggtacattggtggcgctgctcccactgacaatttggggctccaggctgctggcaccctccctgagcctcaacttcccaattcaggtgaaggtgttgtcctagaggtgagacaggcttgttctccctggctgtgcacgaggtgtcagctgctctcctcgttgacccaaaaaatgatcccagaaagcaaagcctccaaaatttaaaatagcttctcctatagctctgctgttagggttttattgttttttttctgaaatagagaactggcttcctagttttggctcattgcaacctctgcctcccaggctcaagcaatcctcccacctcagcctcctaaatagctggtactacagacacccatcatcacgcctggttgctttttgtatgtttttgtagagatggggtttcaccatgttgcccagggtggtcttgaacttctgagctgaagcgacctgcccgccttggcctcccaaaatgccgggattacaggcgtgagtcaccgcacctggcctgtttctttatttttatttctttatttttgagacggagctttctgctctgttgcccagactggagtgcaatcacgtgatcacagctcactgcagcctcaacatcctgggctcaagcgatcctcccacctcagcctccccagtagttgggactacaggcatatgctatcacactcaactaattttttttcttttttttttttgagacggagtcttactctgtcgcctagactggagtgcagtggcatgatcttggctcactgcaacctctgccccctgggttcaagcgattcccctgcctcagcctccccagtagctgggattacaggcatctgccaccatgcccggctaatttttgtatttttagtagagacggggtttcaccatcttggccaggctggttttgaactcctgacctcatgatccatccacctcggcctcccagagtgctgggattacaggcgtgagtcactgtgcccggccctttttttttttttaatttgtagaggcagggtctcactgtgttgcgcaggctggtctcgaactcctgggctcaagcagtcctccaacctcagcctcccaaaatgctgggattacaagcttgagccactgtgcctggccagcttcctggtttctttagcaattttcccactggaaagcccacagcactgtcagagggagctggggccccctgtacttccaccttctccatcaggccccctccggtggtatggtgggtggtgggcagtgggcagggaaccagactgatgtcctgtggtgtggatggaccacatcgtgctcatccattcctctgtccatgggcatttgggttgcttccacctcttgactgtagtgaaccatgctactgtgaacagggcatgtaagtatctgttcaaacccctgctttcagttcttttggatacatacccagaagtagacctgttggatcgccgaggctggagtgcagtgacgtgatcttgactcactgcaacctctgcctcccaggttgaagcaattctcctgcctcagcctcccaagtagctgggattacaggcgcccaccaccacgccaagttaattttttttttttttgagacggagtttcgctctgtcacccaggctggagtgcagtggtgctatctcagctcactgcaagctctacctcccgggttcatgccattctcctacctcagcctcccgagtagctgggactacaggcgcccaccaccatgcctggctaattttttatatttttagtagagatggggtttcaccatgttaaccaggatggtctcgatctcctgacctcatgatctgcccgcctcagcctcccaaagtgctgggattacaggcatgagccaccgcacccggcccatgcgtagctaatttttatatttttagtagagacggggtttcaccatgttggccatgctggtcttgaactcctgacctcaggttatctgtccacctcggcctcccaaagtgctgggattagaggtgtgagacactgctcccggcctcatttggtcattctgtgtttaattttttgaggatttgccagattgttttccacagcggctgcagcattttacattcccaccagccgtgcacaagggttgtggtttcgccacgtccttgcccgaactggttattttttgatggtagccatcttaatgggtgtggggtggtcttggagccatttaaatgccctcatgtatgtgactgtcctgtgagagctaggacctgcagggcctctgatgcccctggatggacccaggagtcacctggtcacaggtgacagaggaaggtctcgagcaggatcacctgggctcaggtgagagaaagggacagggagagcccggtgtggctctgcagtgagggaagctggggctgagtggagatgacagtggctacgtgccctgcttctgcatagccagtgtgcggttgcccggcctgtgttgggatgcaggtttctctttttgttttgagaccgagtctcactctgtcacccaggctggagtgtgcagtggtgtgattcttggctcactgcaacctccacctcccaggttcaagcaattctcgtgcctcagcctccaaattagctgggattacaggcttgcgccacaatgcccagctaagttttttgtgtttttagtagagacggggtttcaccatgctggccaggctggcctcaaactcctggcctcaagtgatccacccaccttggcctcccaaagtgctgggattacaggcgtgagccatcgtgcccagctgggacatgggtttctgtaagcagtgagggttaggaagggccttgggtgaggttggccagggtggttgagcctctcagtggcaggacttctgagccctgcaggtactgaggcttcagggcccttctcaggcaaagagctcagatgggtgcagaatctctatttttagccctttttggattaagcttttgtggaaaatgaggtctcttccaggtgagaagtggcctggaggtcctgcaggtcagggacagcccactggggggcactggctgggcgggggggtccagctgctgcccttggcctagccctgaggcatttgctgaaggtgggtgggagggaagaggaggagcagagttttcttaggatcctgtgggcaggtggaatccacctacttccaggaggagccccaggcctccagttggggaggggagtgtgtgtgtgtgtgtgtgtgtgtgtgtgtgtgtgtgtgtgtgtgtgtgtgtgtgtgtgtatgtgcgcgcgcgcgcacgtgcattggcctgtgtctccatctgtgttcaccctggagaccttaggttgggcccctctatccagggtaggctgattagtgggggcctgtgggccaaggggccgggtgggggcggccaccccatcacattgcccttctttcggaagggtgactccccaccaggaacccaaagggcttggggtggccttgtctcctcccacaggcctgaggagggtaagctgggttgggaagttcctttttcctttctgaaaacagtgacttttcggggtacaatgagcttcctgctgtggatcttgtagcccctacacctggagggagtgaccttagggtctcagtgggcactgtgataaggatgcctgctggattgcatcagggcgcctggttcacaggacctccaacctggctgctgtggggaagggccctggtgggtgcctcctgctcacggctactctgaaatattattcccgagatcttgaggggaacctgggctgcgtccacctcatgtttgctccatttccccatggaattagtggtagaggtgactcacagggtctctttttgtgtcctcaaggaaactgaggcctataggctctgcccagggtcactgctatagttgcttatccccacaacaaggcttgctgccttgttaggacgcggacagagtgggctgtagtgtgatctttttcagcagcaaccctagagactatagcgtgttggtaaactgtggccaaagggctgggtctggcctgccacctgtctttgtaaataaagttttatagggacacagctgcccacttgcttacctgtaatttatggctgctcttgccctgtgacggcagccaaggctgcaactgtctagctcacaaagcctgaaataccaactctttggcccttcataaaagaagcttgctggccgctggtctagggtgtccagctgggtgtgtggcaggaagagttggtgtgttaatggaaccactgtcgtggggccaggctcgggccttgggctcccaggcccctgtgcagtgccaggcagccctgtgaagccttgctgttggccagggccagttgagactttggagggtccttttgttctggcccctttatttcactaatgggacatctagaagataatggctaacttgagatcacacagttagtgcagatgatgtcaaaccttgaacctgagggcatccactctgggacaggctaccctcctggctgctgactcttgtattgtattttattttattctatttttgtttttattttttagagagagggtcttgctgtgctgtccaggctggagtggagtggtgtgatcatagctcactgcagtctgttaactcctggcctcaagtgatcctcccgccttggcctcccaaagtgctataggcgtgagccaccacactcagctgtgactcctattttgatctcatgcaaactcaaaatgtttctcagcccgcatgggagtccctgggttttccgggagtttttctcagggactgcatcaatcctgacatagcctccagtgggaaccggcctctttatttgtgacctgtatgtgacctttgaaacaaaacacagtcatgtgcagcctggatgggaagggctggcttgtgtgtcccttgtggagttgggagcagctgccgcatggagtcagcctcagcctgctgcatcctcatctctggggatggagctgggggtcaggcgtctgcctccagatgggtagtggggcccgcagaacctgtgtctgattctagttgggctctgaatgcagtctctgagctgagcctcagctgcgtggttgttcggcggggcacaacctacacagtgcaatctcctacacagagggattgcacccagtgagggttcggctgcctccaggagtgtttctccagtaagaagcaggagggatgaagcccctgcgctcacatggcccacttcttcgcagcggggaggtgcaccataaaccagcaacagccagatcatggtggcttcagactggcttggtgtgcagtggtggtggacatgggcaggcaggcatctccctccacagaagcaagctcaccttgggctggggagacctaggagacccttccagaactttcttagctcggggcaagtgccgtgtgcagattagattctttgttagataccagtggcttgaaagactcagaggaggacttcctgagcagttctctgccaaggggctgtgggtctgtggccaggctctggcagcagacttggcctgttttcactcttcttatctggggatgttatctctcccttttcagagttgggtgtgacccttgaactgccacaggccaggcacagactgtgcagggaggtatctgagggcagggagcgggtgcagctagaagagcgtgttccttcctctcctggtggcactatttttggagttggatgctctcagacgcctgcttgttccagtgaaatgtgctcagctcacactggatttggcaagtgggaggggacagccagtgctggcagcctgtgtccagctcatctccaggctgccctggctctcttacctgtgcacaggctcccactggtcgagggccatgtgcctggagccacatgaccccataatgtaggaatcgcttccatcttgtaggccagctccttgtagataggaagtggagccgtgttgagaaggattctgaggcgatgtctggcgtagagcgtaggatcaatgagacagggtccctggccctctgatcatagcatctctgtggggagagttccctctaatctctgagctgaggagggtaacgaactcctaggtgtgcaaggtgaggttcacatgctgttgaacggaagtctgcttttgttttttcagacgaggtcttgctctgtcatccaggctggggtgcagtggtgtgatcatagctcactgcagccttggctcccgggctcaagtgatcctcctacctcagcctcccaaatagctgggactacaagtgcgtggcaccacacctggctaattttttatttatatggagacagagtctccctgtgttgctcagcctggtctcaaacccctgacctcaaacgaacttcctgccttggcctcccaatgtgctgggcttacaggcgtgagccatggcacccagccgagcagaagtctgggctgatgctgcaccccagaggcacaggagctttggatccctttccccctgggggagagggtaacttgccacagtctgctctgaagcagcccgggtgtccctccactgtgggaggcggcttaggagcaggcgcaccttgagggtggcccaggcaggtcgctggagggtgcgggagacagggcccaggcctggggcggtgccagcagggctgtctccatgttgactgtggggggctggttccaagccaggcttcagacccagctgctgcgtgtggcatggcctgagtgccaggggcagcagcctgggcacacatgggcacccagggcttggagggaggctgggtcagtgggcctaggtgcagagcttctgggtgtctagactgttgtcccagggatggctgagggccagcatggggggcccaggctgccacctttgcctcactggtattggccacatgtgtgctgggtggtctgtgtagtacagagcaggacacagggtgggggtacctgactgtacagtggtgccaccctctgggcctcagtttctccctctgctgtgtggggtcatcctgtgggtgggaggtcaggtcagtgcctgcagcccctcctgcaactcacattcacctctccttactttgctttcctgtccgtggggtgttttggggttcagggagctgtgtcccaggacatcaggggaacacaagccgcatcccgtggcccccactcctctcccgtcctcttctcccctcccctgtgtgtgcctggtgccttaggtggcttgcaaggcgccagtcacacactgtttcctttcccggcttagccctttcccatcacagaaaccccagctctctcccaggctatctcatagtaaggagcctgcgttactgagggctgttgaagcaccaaaacctaggaaactctggatgaggtgaagagcatgtgtgtgtgtggcacaggtactatggccctgcccagtgctctgcacacctgccttcctgcctgcctgggaagtgggatgagtaatggcagtagctggggcttattgccgggtgcccttgcccgtgggagggtgtgactggccacagcatccttaggatgaagaattgagtagagaagaatagcaaaagctatcttcagtcctaacaagagcctaactagttgggattgcatttgctgttgggtgagctgtggcagatgcagaagaaagcacaccacagaggagaggggaggggaggagaggatgggagaggagtgggggctacgggacagtggcttgtgttcccctgatgtcctggtatgtcactgccctctggcacacagaagttgcccatcgttctcagtcgcctgaggtttggccatgatggcaggagggtgagatgtcctgaaccttgacctgctgctcccacagccctggcagcccagaatagtcaaagcctgggttgtctccacaaggcaagagttttttcctctgctggagctgtgggctgagagcctcctgtgcgcaggcatcacacatccccaggccaggtggctcctcgggtgctcagggctgtgggggctttgtgtccctcaggccctgtccactggacaggtggtggcagggctccgtggagagtgtcccagagtaaatgggttctggtatatgcagtgtttctcatgacagcccatggggtgtgttggtggggggagatatagctcatgtgccagtgtcactctcgggccttggcagggatgcagctgggagagttctgtttatttaaagtcgagcctcaggttttctgctgtgacttattaacccgttgatccaccctgtgggcggtgccaggctcttctgaggcctgacaggtgggcctaacctctgctgaccaatgacagagagcatcactgctctgatgaccggacccaggctgcaggttctggagtctgtagccacttccccttcctcccaggcagagatgaacgtgacagggatgagatgtacatggcaatttcagatgggagttgaagaatgctgagctctgtagaaaatgtaggggaaatttagcaaagcaagccacgcgtcatggatttcaatcaggatgtgacttgagatgtgggtaatcccgagagtcacagattgctttggaaaaacagagcaggagtggcctctgtgcgtcagtgagcacacccttaggtagatggctgacagatgccctttgcccacctcccctcctcctcagcctcacccctccagcctctctgtgccgtccctggcctgttggcacaagtggctgaggaggccaaaatgaagtgatgcatgcttagcagaggtgccagcacagttgacccctgcatccgccgtgacagcccgcagatcctctgcacgctgcagccaccaggcgaggcctccctggatgccgaggagtcagtgcttcagtgagccccttggatcaggcggggggatgtgagtgagcgggttgtccacatggataggagtggggtcagacctagcgtctggccagagtgtgtgtccttaaccttggccaggcagcagccaggcccccacgtgtgactccagttagccaggtgcattctgaacgggagtgatgagtgacagtcccgtgggccctcatccagcctgcagcagggaaggctccctgaggagggaagctcggcaggacccaaggaagggtggtgtttctgagccctaggcgggtgcttgggaacagcccattctccactcccgctggctccaggtggccagagtaacaggtcccgtcccttcccaccactgctcagacatctcctcacagcccctgagtgctcagcagccgtggctctgcacgtaccctgagctctgggtgtctggggccacatcagctcacttggtgaactgttactagatgaacatgtggtggggccgggtgaggaggaacgtgtgtcctgcaatagcctgttctgtctgttccatcacctccaagagcccacatcctgcctgggattcccagtacgggcagctcagttcctcagagcctggccagacgtgccccccacttgctggggctccctcgctcctatgggtctgcttcactcccttgctgttctccagctttgccagttgccttttccagaaataagacagaaaaactctgtcaccttcttttcatcccacttatcaccccagggtgggggtgctccctcccagatgccataaagatacccgcggccctgactgctgggcgggcggtgccactggacactctccagaccacggatgcttacagggatgtccctgcgctgggtgccagcctggcacagtgcgagttcccttttctttttaagccaggttcctgttttaccacattaaaccagctgtaaagtgccactttataaaataagcaagtgatagggagccactctggcagggcccagggagccgagcagtgcctcccagccctgtgcctgtgtgtggtgggtgtgcagccactggaagtgccgagctgcctgcctggagcgctggcctgccctgttaataaccgaagctctgctgggcattggcacacccggccaggtggccccgtggtttcccaagacaggggcttttggattccgcattgatggcccaaaactccttccctaagttgtctcagaagcaaaaacaggaaggtcattgggtttctttgcagaacactaacccatgctgccaccccgtgttcccactcctcctcctggcatctgcaacatgacaagtggcaggtgtctggtgtccgttgtcattgggccctctctctcatttaaacaccgtctcttcctcctcggcttcttcagttgtcatctctcagagatgggattttgggaagtcccatgtgtggattactgggacttttgtggttggggatatttgatcttttagttataaacgtctgctcctgatgcggctggttgcaggatttccctggtggtgggggtgcccgctggcagaattgactaaggtgagctcactgctgggttctggcagccctgcccactgcgaggcacagtcaccacaggcctggccctcacctgggacacctccctcccctcctggcctgcccacaactcagaagacgtagttggtgctctccacggatgatggctccagggagcctttgtgtacccacagctgttccatggtccaccctagggtggtcatgtgtctcccttgctgtcctggaatccttcattcacctctgggtgctggactgggggtgtgcgtcctcaatgggctatctggctgtggtggtaggagcctcccgggtgctcctgccccgtggagctgtggggcaccaggcagcttagcgtagagcaccagagcacctcccacttgctgtaagctccttgtccccatgccaggtgctgctcatgcctctgtgggacgcactccagcagcctctgggggtgacgcctggttcctgatcgtgtgtcttctgaccccaaaccaccctcatgaggccccaggacctgcccgccaggccccagtgtttcttcctcttcctcttgactgtgttcagggccttcttttggaaagggctgtcctggtcactggtgcccatgctgcctcccctccttcctgcccacccgcagacacgtagctggaggttgaggatgtgggggagatgctccccaaggatggaccatttgtgggagagtccgaatttgcctggattggtggtttcaagtttcttttgcttttatgtgatgccatcacctcttgggcccccaggtgtgtcagatggaccagtgggaagtgcctgggattgggcagatcctgtcctagtgaatcctggctgtcctcgtgtgcactcgtgagtagccggcccctggcttggcccccgtctcatccgcctggctctgagctggctgtgccgtggaccagtgtcttgctcccttctgccagtggcccctcactccaaggccccggctggcctggaagagctgccttgaagtgtgaggcacgttggagggtccgcctcattgttgaggcgtgggcccctcctcgccaacagtgggcccatcccaggccctttcccacgttctctcgctcagcagggtttttgattcctcttaatttggtgttggtgctgggcacacacagtattgctctcatccgggtctgcttggtggcttctcatgtgttttgcccacttgcgttactctctgtggtccatggctgtgctcaccactgtttcccattgggtggtttggcgtggagtggggttcactgtgtcacaggttgtctacgtggcccctggaggtgtgctgcttgctgcccacaggcatagctggcgagaacagtgtcgtggcccgctcgttcttctcctgggtgtgcgcccacatgcttgggatgggacggcattgcctctcctgctgtgagttttggcccaagttcggtggttggaggttggcctgcttccctgcaggttctgctctgtggagtcacagagtcaactctgtggagttgaatttggcgagcagccgccatgtgttcactttcctgagtgtgatctgtgtgcaaattggctggtattttttgaagcactcaaactgtattaggctgtttttgagagtcttgggtatgcttcagtgtacctcagtgacgtattaaaaagctaaagcagtgtttttgagttgaaaaatagtgagctttgtatggcccctgacagttcccagagctattttgcacaatggtatgttccagcccaagaccaccctctgccatgctgcccggggcctggcacagggagagctcgccaagaggttgcagggcaccagtgttatgccgaccttcccaggggaccagtcgacctctccatcggccccaacacacagctgcttccttgagggaacctcccagttcccgtctctccttttgtgagaatggactctctgggaacaaagctgtgccaggtcctgcctggagaaaactggattctgtgtgtaagatttcaaatgtcacaagcagccagttgatggagcggctgtgaaggtggtaggagaagtggacctcttgaagggcacttggtacagcccagtggggttcatttacaaacccacgatatgcacaggaagcctcatggtcacacctgtctcaggagtgaggaaggcgggaacaggaacgtggctggtggtctcactttttttttttttttttttgagacggagtcttgctctgtcacccaggctggagtgcaatggcacgatctcagctcactgcaacctccgcctcccaggttcaagcaattctcctgcctcagccccctgagtagctggggttacaggcacccgccaccatgcccagataatttttgtatttttagtagagatggcattttgccatgttggccaggctggtctcaaactcctggcctcaagtgatctgctcgcctcggcttcccaaagtgttgggattacaggcgtgagccaccacacctggcctcgtgttttgcttaagcacttaatgggtttgctctcaccttgctaaatattatttggggtcattgatgcagttttgagaaaggtcactgagcatgttctgtggtcagatggctccctcggccccgctcttcctccatttgtggggcctgtcccatcagccatccctggtgggttctcctagagacccagagagccccccagtgtcctttctcccagcccttgtcccctgtgcccctctgttcctctgtctcgggagcagatgccgtgaggtggtgtggctgtggctactcatgccctgactgtggcccctgaaagggaggatggggttattcccattttacagatgagaaaactgatgagttcagatgtcaagtccatcattcacagccacacggtgggctgagggaccatctccccaaccctgggaagtctacaggggcccgagaccttgcccccttcctcgtggcaggatttgtatttgtgttttgttttgttttaaagaatgttgctttatttccagcatttagaagcttacaggcagatgctggaggtcacgggtatgttagggtccagtttgtgctgttaatatgttgtttcagcagccttgcaagttagatcatcaccctgtgtgacaaagcccagagaggttaagtgtcttactgaggtcacacagcttttaaatggcagatcataagttggaagtgaatcttctgatctcagttcttgggccccaagatagaagttttgctttcacttcccagcagctgctggtggcccttgtgtcattcctgttgagccctcccatccctgctgggatgagtgaagtgtgctgctgggatctccagctaggagaggtcgttgacactgcctcaagagctgcctcagctttaaggctgaggccaggcttccctcctggcatcctgggcttgagaatgagtggcctagggtggcgtgcaggagggagccagcctttagctttgtccctagtgcacacatttgtgtgggtttttgttgttgttgttgttttttggagaaggagtctcgctctgttgcccaggctggagtgcagtggtgtgatctcgactcactgcaacctctgcctcctggtttcaagcgattctcctgcctcagcctcccaagtaactgggactataggcgcctgccaccacacctggctaatttttgtatttttagtagagacagggtttcaccatgttgtccaggctggtctcgaactcctgagctcaagcgatcctcccgccttggcttcccaagtgccacaggcatgagccaccacacccagctttctgtgttcttaacccagcctgtctacccatccgggggcagcaatgtcctgagaggccagcccagctgctggtcattggggagggtctcacagggtccctgaagctaaaccggaccttctgtcctggtcgtgacactgccgattctgttttcccagaatcatagaaatccaggagtttggatggtactgtgcagtctcacaccgttgagtgcagctgcctggcatcagaaagacagttttgttttcccttcctaactgaatagacctcctggttgtcttctagctgaggcgactgccctagggtcccgtcaggtcctgctactatgaagcccttctcgaaatctaattttaggtcagaaatagttttagtgatccgggttggctctggccaatactgagcaaagttgagtggaaggtagagttcctatatacttctccccgcctccccgcacctgcagcctcccccattctcagtgtcccatccaccccacagagtggcacatttgtttccaatggatgagcctgcactgacatttttttttttttgagaccaagtttcgctcttgttgcccaggatggagtgcaatggtgcaatctcggctcatccaacctccacctcctgggttcaagtgattctcctgcctcagcatccctagtggctgggattacaggcatgagccaccacacccggctaattttgtatttttagtagagacagggtttctccaagttggtcaggctggtctcgaactcccgacctcaggcgatctgctctcctcagcctcccaaagtgctggaattacaggcatgagccatcacatctggctgacatctttttttttttttttttttttttttgagatgagatctcactcttttgcctaggctggagtcagtagcataaccatagctcactgcagccttgatctcctaggcttaggtgatcctcccaccccagcctcccgggtagctgggaccacaggtgtatgccaccatgcccagctaatttaaaaaaaatttttttagacagtcttgctgtgttgctcaggctggtctgaaactctgggctcaagtgatcttcccacccaggcctcctaaagtgctgggattacaggtgtgagccaccacacccagcctgacgtctttatcatctggagccctgagtttccactgggacacactcttggtgctgtacattctgtgggtttagacaaatgtataatgacatgtccaccatggtagtgccacacagtcatgtcactgccccaaaaatcctccaagctctacctactcatccccttcctcccctctgcccgctggcatccaccgatgctcttactgtctccatagttttgtttttctccagcgtgttctgtagttggaactgtgcagtgtgcagcctttctagactggctgatttagtcgtatgcttttaaggccccttcatgtctttgcatggtttcctagctcatttcttgttatatcctgttgtctggatgtgacatggtttatttatccattcatctactgaaggacatcttgtttgcttctgagtttaggcaatgacaaataaagctgctgtaattagtatttttcatgtggacgcacgtttccagtgcctctgggcaaataccaaggcgtgcaattattgcattggatggtgagagtatgttagtttagtttttcaggaatctgttgaggccgcaccattttgcatgtccaccggcagtgaatgaggttcctgttgccccatgtcctcaccagcacttggtgctgtctgttctgagttttgggcattctaataagcatgtggtggtatctcattgtcatttcagactagacttttccttctggattttttatattattgaagtgatgtttgcccatagtggaagacttggtatgacgggccacagccacaggttcctgtgctacccgcctggccttggcaaggacctcccccagtccgcaccacctgagtggacagcagcagcctggagctggccccacctgctggcaggggacactggggaagggcctgtgcctggacttgtgccaaaccccaaccctactccacgcctccaacccatgatctctgtagctcctgccaaactatatgtttctaataaggtaaaaaaaaaaaaaagttgttacctgcacttgacctggttttatttattctcgagcccaggaagacaggctctgttaccacaggaagtagaggaagcactctgggtgcagtgtgaggctgagtctggtcaggtctctgtctcctgagtcatccctcagggagattttgagctctttcctcacccagtgtctctgcacagcagcccttgagctcttcctgcatgcaggggagttttctggatgaggcagtggcccggccacctcttggggctcacgggtggctcttttcacaaccacgcccacacactcaggcatggccgtcacagctctggtatcaagttctaatgtttggcccagtagtactgaaaggtgcttttgtggggcgcagccatggcctcacctgagcctcagtttccccatccataaggagggagtaaccccatctgtccgggaggttgtggggaccgagtggagtgtcggtggcactgtgcctgcatctccacgccctctgcagtccccatataaacctcccacatcacctccaaacgcccactgtgtggagcaggtagggtaggggctcacggaggctagcccctttcaggcccatgtggcgggagcctgctcctcagccctccaccctaagcctcatagtccaaggtaagatcagaagaggcctcagtgggcctgccctggctggcgctgtccatgtccaagtctcccctacagcccaggtcttggtcagtattgggaagctgaggcgcgtgggacctgcctgcctccccatccctccactgcagtgcatactgccccagagtggccactcgtacagggggcagggggactggcttctgctcactcagccagggcttgtggctcctcctcttctcctcagtggggcagccactgccgcctgtcactctgcctaccagccctgtctccgcaggctctcggccctcctccttcagctgcagtgggagctgggcaccctcatgcggggcgctgcttccaagaagcctttagggtcctcctgacgcctgaagcaaggaagttgcaagctgtgctactcagggcagctgggtgggtgttgtgccctccctgatggggatgcgagtgagtgggtgggaatggtggggcccaccaactcctgcttgggctttttgctgctgttgccagttcctctccacaccccagcagcccagggtgctggtgatgtgcacgtggggccaggccctcccccagatgctcccgagccttgtcatgccagacactgaccctccccactcctccacagaccaccccacaaggcctgcagtctcctggggtcagctcgcctcctgcacttctgctctcggctctcggctcagtggtccctaacccttggcagttagaacagccctgccaggggtccctgtgtcactctagtttttgtctactccaacatttgtgcccaggggctctgaatgggcagggccacatctgtctccttggctgatgagttcccagggcctaacatgttatagcccacaccttgattgagttagcgccagccatatgccctggacttctgccttgctgtctttttcaactctcaaatcctgggcacatggtggttctgagatcacatctgcctagaggtacagggtagagttgtccagatgccacccggctagggaagtggaggaaggtgaggctccagctcaggtacgggtggggcctcccaagctctgaaggcagagacaggaagatgccccacctggtcagagcccagaaggctggacagtggggtctgtcatcagcacaggtggggagggggaggggagggcagagagtgggaatcagaaattaacttctggcctggtgcggtggctcatatgcctgcaatcccagcactttgggaggccaaggtgggcggatcacttgaggtcagattatcgagaccagcctggccaacacggcaaaaccctgtctctactaaaagtacaaaaattagtcaggtgtggtggcaggcatccgtaatcccagctacttgggaggctgtgacagaattgcttgaacctgggaggaggaggctgcagtgagcagagatcgcgccactgcattcccatctgggtgacagagcaagactccgtctcaaaaaaaaaaacaaaaaaacaaaaaagaaactaactttcttcctttccttcctacgtgggctgggagctgatgctgtcatggctggcaccgtctacatccaaatctctcctttttctctctctctctttgaccctccccttcccttcccctccccttcccctcccctctttttaaaatttttttcgtggcagggtcttgctctgttgcctaggctggagtggagtagcttgatcacagctcactataaccttgaactcctgggctcaaacgatcctcctacctcagtctccaaacagaaacttttttttgtggcgattcactctgggcagtggagaggaggagtgaggttggaataagggagaaagacctggagatatcttgggggcctctggtctgtgtggacctgcctgtccttggatggatttctggtactgattgttgtttctgtctacctgcttgggacaagaggccatgaactcactttactgtgccctcgtaggttagatcacctttcaattgtcttcaggattgtccccactggtggacatctgtgtgtgcagacaagagagcaaagagctatgaggagtggtcagtgacccagcaggcctttcccgggccatgagaaagggatggggttgctggtgggcctgtaggccactttcttccctagcccctgttagggagctgggcacttctggggcagggcctgaggcagggccaactgagccttgggagtccaggtggagacagctggacacacgcctcccttccaggcgtctgtggagtgtggggccgtctggctgcagtcgttctgcgtgccttgcctgtcgggttgccggtatgggtcagaggttgagagtacaccatgttcatgtcactctctcctcccaagtgcggcagctcactcccagttcagggtctctgttttccacccaagttggagcaccaggccctgcatttggggagccagccctccctgccctggccagcagtgacagcacagccctggcttcagaggggccagatgcattgttatgctgcccagggcccagggcaagcccctcagggccgcagcacagagcccatcttttctggaaggtgtgggcacagcttccccctggcctggtgggccactgtggtgacagcggcccttcttttcaccagggtttctgaattgccctgatgggatccccagccccattcctttattatctcagacaaatccctggacttgtagaagtggcttgtctccatgggataagctccatctttccttctcggtcacccttgtggtctggtctcggaggggaagatgaaggcagcctgctcttccctctgcttgtcactgttggctttagaagccacctggggattaggagcagcaggtgacaaggtcatggtttttcatttggagagtgggaagcaaatgaaatggcttttcatttggaggggaggaatcatgagaggagtgggggaatgaacttgtcctagcttttcctggtgtcatcgcagcctggccagtgggacttcacggccccatttttccagaagagaaaactgaggctcagagaggctcactcatccacccaaggccatgccgcttagagggcagtggagctgggcctgggcctggctgctggactccagccctgctttctgacttgagctgccctctgccagcttcagcttctgtcacctcccctccttggtagttgagaggtctggggatgcctttggcagagaggaggagagggcacacttgtgtgtcaggagagttatcagtcgctcaaaagaaatatgtgacccagtaacagattgactcttttaacacattaataatgagattgagtagcgagtctcactgccataattagtggtgagctgaagtggcatttccagatagcagcacagccatcgttggatgcactaacagcacgtcagaggcacagatagtgctgataccactgtagcttattgcttatgtttcaaatggaaggaaatgctacgttttagtttatgaaaaacagatatgttccttcatcccactcaaattcaaggacacccctaggctgagccatgcaggaatggccgtccttgcacatagggcagtggggagctgtcccgtgcaggagacctctgtaagcagcgtcaccatgacggatgaggaagcttccaggtcaccgaatgtggcctcctcacagaggtaggtaaccccatggtgtggccagaacaggccgggtggagcctggatcctctcctagtgtcatggtctcagtgggggctcagaggaggttggggaagagccaggagccagtacaaaaagccagcctgggacaatctgaacatgaagactttaagggcagtgtcgtgctccaggccatttgcaaaaggtagcctgtgagtctgtattggtcagggctctcaaaacagaatctaaagggagtgtgtgtatatgtatatttagagagaagagaggtaggtaggtaaatataaagtcatctttattttatttattttttagactgggtctcacactttcacccaggctgtactgcaatctcaacctcccaggctcaagcaatcctcctgcctcagtctcctgcatagctgggaccacaggtgtgtgccatcacacccagctaatcttttgtttttttttgtagagacagggtctcactatgttgcccaggctggtctccaactcctgggctcaaacgatcctcctgctttggcttcccaaagtgctgggattataggcatgagcccctgtgcctggtccatctttattttaatgaatcggcttaagcatttatggggttggggggacaaggtcaaaatctgcagggcaggacggcaggctggagacctaggttacagtggatgttgcagctcaagcctagagtccttctgccagaggccctccaggccttcgactgattggacgaggcccacccatacgttggagggtgatctgctttactcaaagtctactgattttggcctggcagagtgactcacacctgtaatcccagcattttatggggctgaggcaaaaggattgctaaagcccaggagttcaagaccagcctgggcaacacagtaagactccatctctactaaaaaaaaaaaaaaaaaaaaaaaaaaaaaaaaaaaaaaaaaaattagccaggtgtggtggtgagcacctgtagtcccagctacttgggaggctgaggtgggaggattgcttgagccagggaggtcaaggctgcagcgagctgtgatcacaccactgcactccagactgggcgacagagcaagaccctgtctcaaaggaaaaaacaaaacagtctactgatttaaatgttaatctcatctgaaaaataccttcatggcaacatctagactgttgtttggccaaacagctggatactgtagcctaaccacattgatgtgtgatgctagccatcctgctgctggtggtgagcatgtgtgagaatgtcacctgctgccggtggtgagcatgtgtgagaccggggagagagggggctcctccccaggccagtggagatagaaccagggttttatggccaccatagccaaactgcagatggcaggcactacacctggggctgcgggtgtgcagtgggtacctgctgggagatttgaggggaggagggttgtggcacggggcagcgctgtctgggccgtcagagctcacggctgatgagggtgggatgccttccgagggccgtggtcactgtgtggctcttggccgggaagataccatgcatttggtctcaggagacaccaagcagacccaaaatccagcacactctgatgaagaaagtgaggaggggtctatgttacccaaaaacattgaatgttgaagaatggccaagaaacttgcagattagaggcagctgatgagggcagctgagtgcagtgtgccactgcccatgggctcccgctgcggggaggacaatgtgaggtcaccaccaagtcaggcaatgacctgggagacagacggtggcttgaagtgtcatattaataataaatgtgaagctggtccctgctgtgtcggcccagaagagtatttttactctcaggaaacatgctgcgtttaggggcacagtgtggcaaagtctccagccggccctcaaatggttcaagaagcaagtgtgttgctacatctaagtatgtggataataggcgtgggtgggggggaggggcaggtggcagaaacgtcacagaatatggctgttctttgtactgttcttgcaggttttttgtaagttgagattgttttagattgcgtccaggagagaaggcgacagcagggttctctgctctcagacgcagctggcgtgtaagcaaggctgtgtctcacctggcctggctggccccgcgtgcaggtggctggaggcttgagggaccagcacgggctccacagcgtggtcagggccagctccatatctctgctcagtgcgcgtctgggcccttattctgttgtcctagtgctaggccatcagccccaggggtcagcagaaacaggagggactgctcctcctggaactcccctttaggtgggaagagaccaacctcgcaccccaatcagtgagatgctcacagccagaggccggggccccagtgagccctcacagttggaaagcctctctgatgacgccttgggggaggtgttggccaggtggatcccaggaggatctagactgcagtaggcacaggggtcacacagcactgagtgtgagtaccatgaaggggccagcgtgggctgctgggggctgcagggctaagcctgccggccttatcaggcagctggggtgtgcagggagtgatccaatagatacttgggtaagattcccctctgaggaaactagagaaggtgccagagctggctgggagaggctcaggtcttggatggcagcagccaagaacctggggctcttgacgtcccagcaggagtgagtggtggttgggggaaccaggggctaacatgagggggatgggagcacccggggcggccagcccgaggtctgcccaggcctgcatgactttctctaaatctgtccgcggtcaagtggttgtctgacctggctgaacttcagcattctcttgaaacttctggaattgtgctagcgttcctgggaggacgccccctcgctcacacctgcaccatgttctgacctagatccacagcacacttggcagagctcctgctgtctcctgctttctggtgtgtgtcagctgctaggcaaatacccaatccatgtcaccttgagccgaaattgggcgcttttatttgaaggcaggtgacaaaacgttctgtaaaaagagcagctgagatttcagactccagctccctccggctgtcaggcaaggctcctccacaccccctgcaggtgggatgacggaagtcggtctgcagatgcagggacccgcgcctgcacagcttcagttcaggactctggtcagccggtccaggacgcatgacctgcgcctgtgaagagtcagtttgtcagtttggaaggagaaaagacacattctgacatagcagggtgccattgcctcgtcattttgggagagtcctgtgtttcagctcaagccctgccacttactgagctggtggccttaagcaaggcacctggcttccctgagcctcagtctcctcctttgcttaaagttggcccccaagatgcgcagccctgtccatagaaggtccctgtgatcaggctttcctttgcttgaagttggccctcaagatgcacagcccggtccatagaaggtccctgcgatcagacttttgagggtgtgtgggcgctgagcacctggcagagcatgttctgttctagcccccgccccgtggatgctgggagcatgcagcccctccctagagccctggatcctgagccccagggcctcctgggtactctgaggtttggggacttgccctgggccagccctggccagcacatgccctgctggtcacaggctgcctctgcagctcctatccagcttggcagtgccacgtgcttcctgctgtgtggtctccttttggctctgtgggagctgtgctctgggttctatgctgctggtggggaggagtccagtttggtgacatttcttgtcaggccgtttgctctgaaggacgggcatctttctgggaagaagtcagttggcggatcttggtgtacgcttacccacgacctaacccaataacagggccgatccttttgtgagataagacccaggtggagaggcgggctgggacctacctctctccctgctcacctgccgggtgccttcaggcatgtttctcaggatgggcccaccaggtgaggatgtccacaccataccacactgctgaggttattactgggcagagaccacggtggacacttgccagcctggttgtggccagagtgaggtggggccggcaggcacagggctcctgtcagggtaggttggagtctggtggctgggaccacagctggatggggcagagcaggccctgccagccaggttctgagcacagctcctgagtgttcggattctgaaagtacagattgtaccgggaaggctctactttgtttttctgggtaatagaagatcccgttgttccgaaggtaagcacctgggcctgttagaagccatgtgctcaactttcaggaggatgaggatctgaagggactgattcattctctccagaggaacaacttggtgctgttggtgatgaacctgagcatcaggcagctgcacgggtcctcgtcccagagatgttcctcagtggaagatgcaggcagtgcttatctggcctggggcctccctgaggggctagtgcagcctggccgtggccacatcaggttctgtctctaaagttaaaagtgggctggtttcatgcagctgcctctgtcagacccagcaaggtggaggattttcctgagacagcacattcagggatctgtgcgcatcctaagcactcaaggtggtttatggccatgctgagggcaactgtcccccaaacccagctgctcctcaagcacgaaggaagactggggcctggctctcgtggcacctccttgatgcccacctcaggacacatatgtaacgcttgctctgtcctcactgggcctgcccatttgaggggtgaccctactctctggggtggttggattgtccagatgttcccagaagcctctggagccctcaatgggtttttatggggaatgccagcccatatgggcaatggctcagaagcagttactcctttctcagggggtctcctggtggggggtagcggggtctgagcagcagggtctacacgcacagggccttctttgtgttcctgagtgattaggatttacccactgcgtggtggtggaagcatcggaggtgtcagcatggcatgtagctgacggtggaggccagcatcttggaaggctttggttggctgcagaggcgcatgtgggtgaggtggcaggcaggacccgatgccaacctttgtggctggcaaggtcacatccctgaggtccagatgtggcagctcccaggttgcaggttcaaactgggaaggggacctaagagcacccttgcagtgagtactggctggggaccacgggtcatgccttgaagggtgccagattctcttggcatcctcttatttttctgtgatctttgcctatcttctgggacaggggtttgggtgctttgcagaggttgcagtgagcagacaatgagatgaggcggtaagagccgagtccggtgcggagctgtgaatcatccaggcggctgacgtgacacaggggccccgtgaaagggcgtggtttctgcttcagagacaggctcccttctcagaaccgcctgggtctctgagggcctcaggggcagccttggtgagtgtggccgaccaccggaggaggaaggacggtcctcctgggtcctgagtgtgtgccttggtagcttggcaagctgccatctccttctgacctgggtcacatccacagtggacactcccaggaccgcacccccactctgggtcacagagtacatcttgggtgggtctgttgtacatagactgttagaaacggggcagagtggcctgaggacgaggtgctcagcagcctctctcttcctgcccctgttgagccagtgcctgacactgaccgcccttggggccctgagctaagcttcacacagaagcccctccccagattccttcccaggttgcagggctcccacccgaggtggagccccctctgcagggcagcctgggggtgtttgtgctgtggggcttgttgcttcctgccaaggtcagcagggggtggctgtgctctcagggagaaacagtggctgaggggcttcgtgatgcatccaggagagtgccttaactgttttcatccccgtagcttgctttcttttttttttttttgagacagagtctcgctctgtcgcccaggctggagtgcagtggtgtgatcttggctcactgccacctctgcctcctgggttcaagcaattctcctgcctcagcctcccaaatagctgggactataggcgtgtgctaccacgcccggctaattttttgtatttttagtagagatggggtttcaccgtgttaaccaggatggtctcaatctcctgacctcgtgatccgctcgtcttggctctcaaagtgctgggattacaggtgtgagccaccgcgcccggcccatccccgtagctttcccagtgactgtgaatgtggcacgaatttgggcaagggataccctctgcctccaaccaccaggcctcatggggcaccctgggctgggcctgaatctcgcctctaagatgagccttagagttgggggccagacctggtctccctggtctccctggtctccctggccctgggaggagatgggctcccatagtggagtgttagctgttttcaggggagaggtggaggcagctggaaagcttgggtgcactggggctcggcagaaggggccagtctgctctgtggtgaggctgaggacgggtggccttgggagtgtggcagagaggaggcgctctaatagcagttgagcttggaaggcccaaaagtgaggtggccctacagactgacaggtcgaaggcacacacatggccttgtctgcaggggagttgagatggaggcctggaggggcctcctggggagaggagagcccatgggccgcttctgctgggctccaaatagtcccatggaggtgaatggggtttgggacctcctagctgcctgagcaggaagcacagtggcaaggcagagctgcattctcagggacccaacccccacagaggcctggcctgggctctgatgaggggatggcccatgtcaggccctagagcgttctcattcacctcagaaacgtcaggaacccagggctaggagaggcccatgctgtgccctggaggaccccagtgacctaggtcagtcccttagcttcttccattgtcagatgtgatcagatcatggtcactgttgtctgggggaaagcagttgttatctggcaccgcagaccatgggcagaaggcaggtttggtgagagggcagtttctcgaaggccttccgttcaaaattcctaggtccagtacctgttgttggtgagttttagtgaatgattaaaaagaaaaacaaaaccccaccaaactcttgcactcctcttgaggagcacaggtggaggcaaaagagcattggttgtgaagcctcatgtgcttccttgccggttttgttatgttttgttttgttttgttctaaagacagtatctctctctgtcacccctgccggagtgcagtggtggaaccatggctcactgcagcctcgatcgcctgtgcttaggtgatccttctgcctcagcacctgagtagctgggactgcaggtgcgcattaccacacctggctaatttttaaattttttatttttctttcttgagactgagtctcactctgttgcccaggctggagtgcagtggtatgatcttggctcactgcaacctccccctcccaggttcaagcgattttcttgcctcagcctcccgggtagctggaatttcaggcacctgccaccacgcctggccaaagtttgtgtttttagtagagatgggggtttcaccacgttggccaggctggtctcgaactcttgacttcaagtgatccacccacctcggcttcccaaagtgctgggattacaggcgtgagccaccacagcgtctggctgccaaacgggattctgtgcccatcacactggcacttgcagatttgctctgtttcagacactgcagagtgcgctagaggggacagaggggcctgacactgtggcccaggtgcccatggagtgtacttgtgcagcaggtgcccacatacgacagcgtctttccctgtttgaagaaaggcagatgcaaaaggtggaataataagggggaaaggcaaagttaaggtgttggcaggagggcttgtgccaggcatgggttgcatggctctgagatgcactgtcctggaagcaggcctgggccatgcctggagattgacccatggaggtgcaggcagggtgggcagggcaggcagggtgcttgtccctcccttggagggagacttctgtctgtctgatgaagcagggctcagggacatagaagcactgtaacttgaagaattgtgtagtaaatgtttgtcatatcctgctaccctgggatcatgtgaggttggataagttgtgaaatcttcatggggaccccagggctcagttttcctgtgaggttgggatgaggtctgctgtgacctcgggcagccctgtcctctctcagtacctcattttcctcagttgtaacaaccggaacccgatcccatgcagtttaggatgagagtgggttagtgatggaggctggccgtctgtggtaccacgagtccttgcgtgtgatttggctgtgatttctacggacagggagtccaagcagctcccccacccccagctatgacgcaggaatggacagacatctgaggggcttcccatgagacacaggccactttctgctcacctgctgagcgccttctggaagaaggacctggatagtgtccaaaaaccctgcactgcaactgccaggtgggcggtggcatccggggaatatccagggagcatctgtggtcatgacccagggtgcatgcagacaaaggaatctgagagacccttcactgggggctgtggcagccacgggtgtaggcaggagttacccagagctgctagtttgggaggggagaggggagttggtaaagaatggcagtttggaggattttcctaaaatagagctatttaaaaaaaagatgggagtgtgatggctcacgcttataatcccagcactttgagaagttgaggtgagaggatcgcttgagcccaggagtttgagaccagcctgggcaacacagggagacccccacctctacaaaagagttaaaaaaacaacgtagctgggcatggtggcacagctgcttggggataaggtgggaggattcttgagcccaggagactgtggctgcagtgagctgtgatagtgccactgcccactgcctgggcaacagagtgaggccctgtctcaaaacaacagcagcaacaacaacaacaacaacaacaacaacaacaaaaaccaaaaagatgggaggaactaagacacaaaatcaagacccacccataaaagaaaaaaattgaaaaattccactccatcaaaattaagaacttctgtattttgagagatactgttaagagaatggaaaggcagtccaggcgcagtggctcacgcctgtaatcccagcattttgggaggccgaaatcacttgaggtcaggagtttgagatcagcctggccaacatggtgaaaacccgtctcgactaaaaatacaaaaaaataagctgggtgtggtagtacgcacctgtagtcccagctacttgggaggcagaggcagaggcagaggcagaggcaggagaattgcttcaacccaggaggcggaggttgcagtgagctgagatcacaccactgcacttcagcctaggtgacagggcgagaccctgtttaaaaaaaaaaaaaaaaaaaaaaaaaaaaggaatgaaaagacaagccatggactaggagtaaaatgtaaaatttatctgataaagctcttgtatataaaaaaaaaaacctcaaaacttagtaagaaaatgacccaatttttaaaaatgggataaagatttgtacagcttcaccactgaagctagaagaatggcacattagcctgtaaaaagatgctcaacatgcttaatcagcagggaaacccaaacatgaacctccacgagctgtcactgcaccacacacctaccagaatggctgacattttaaataagctgacagcactaaatgttgacgtggatggggagcaacaggaactctcattcgctgccggcggcagtacaaaatggtacagcaactttgggagccagcctggcagtttcatattaaattaaatgtacacctactctgtaacccagcagtcgggctcctgggtgttcaccaagtgaaatgaaaacacgtccacagaaaaacctgtccatgagtatttatagctgcttgattcattaattctccagactggaaacaacctgtgtccttcatccagcaaatggatgcacgggaaggtggcgtatttatactgcggggcaacacacaggatggatctcaaaggcgtcatgctgagtaggtggttggctgaatcatggccacagcagattccaggaacctgtgagtgtaaccttctgtggaaaaagggactttgcagatgagattaggttaaggatcttgagatggggaggttaccctgcattatctgggtggtccctgtttgtcatcacaagtgtcctcgtaagagagggacagatttaatgtagacagaagaggacttgaaggctgcatgaccccagtgggcagagattagggtgatgcagccacaagccagggagtgcctgagcctgcagcaggtgaagaggccaggaaaggtcctcccctagagcccccaaaaggagggagcctgctaacacttggatttcagacttctggcccccagtccgtgagagaaccagtttccattgttttaagccacaagtttatgctcagttgttgcaaggaccacgggaaactcatcttatgtgattccattgataagactttctggaaaggcaaaaccatagggacaaaaaaacagatccaggattgctgagggtgcggggagggtcagtctccaagtggggatgcaggaaattgggcagaaaggaaggtggcctgctcagcgtgctgtcctgggaaaagcaagcaaggtgcgtggagcgtgtagaggccacagttttgggcaatctgcatatttttgtctacaagatttctgaaaaacccttttccataagctttctatgcaccttcgtgaatgcagatagaaatatctgctgcgggctgggtgcggtggctcacacctgtaatcctggcactttgggaggctgagtctgtcgagttgcttgaacctaggagttcaagtccagcctgggcaacatggcaaaaccctatctctacagaaaatagaaaaattagccaggtgtgttggtgtgtgcctgtggtcccagctactcgggagctgaggcaggaggatcacctgagcctagaaggtcgaagctgcagtgagccgtgttcacaccaccgcactccagcctgggtgacagagtgagagcttatctccaaaaagaaagaaagaaaaaaaatacttgctatgccggccactgaattacacttggcttgtagccagttggagtccctttcctgctcttacaggcccacctggcctgctgaacacaccatctgtcctcccaggctggcagaggagctgccgtgggtcctgccctctgctctgccctgaccgtggccacctggttccctaggctggaaccagtgaggtccacaatgtgtctgtccaagttccctagctcgtccctgagccaaccaagctcactgggcagatcttcctttgttttgtagttcacggagacagccccactcagtcactgtctaaactctccgtggcctcaatgtcctgctccagtcctgccaggaagtctcaaggaggattcctgaatagcgtttcccaatcatttgtgctttactggaaagggggggcctgttgtggggaggccaccgtccagggctcttcccgggacttcaccttccctctgctggaccacacgccgtggcttggcagggtgacccagctctgtaagatcaggacgtgtgtgctgacactggtgcttgggagagtcagcaagatggacttctgaagaaggaacagatgcattcctttctgtcatttcctgcatcaggggtggggtggcaggccttgcccagtagacagcagggagaacgtgctgcctggggagagtgggcacttctgctgagtgggtgcttctggagggtggtgggaaggatcatgtgtctttggggcagccttggcacctgctgccttgggcctcattgtccccaggctggtagcaggtatcctgggacctggccagattgggccccgtccatctgtctgtgtgtctcatctcttcactgtgccctctccctagtttctgtctttgctggagagtttttaaaacaatcctagatttttttttttttttttttttgagatggagtctcactctgtcgtgcaggctggagtgcagtggcttgatctcagctcactgcaacctccgcctaccgggttcaagcagttctcctgcctcaggctcccgagtagctaggattataggcgtatgccaccatgcctggctaatttttgtatttttagtagagatggagtttcaccatgttggtcaggctggtcttgaactcctgacctcaagcagtccacctgcctcagcctcccaaaatgctgggattacaggtgtgaggtaccatgcctggccaacaatcagatacgttcttcttcacccgtaacttttccatttatattttatatttgttgaagggagcaggtcttttttcccatagatttttctgctttctgctctgatggtcgcttcccgtggcagggtcagcccagggcttctcagcccctgcactgcttgacatttggggcaggaggttctgtgttgcctgcagtgtgctgagcagcatccctggcctcccccgagccagatggtggggactgtccccgccctcagtggtgaggaccagaaatggctccagacattgcctcgtgccctggggaagattcacccaccacacttcctgtaaactggtcactcggcctggaggtggatttcgtaagccacttcctgttgcttcatccccggaagtgctctttgccggaggggagaggatcaggggattctggccctggagaggttcctcctcaccctttcctctgtctcagcattgaggactctcactgcctcccaggctctgcaccctcgacccttttcccaaaggcattgctgtctttacaggagtgtcctcattgagggggagctgcctacaggagtctcccagtctgtgttcagtagccccagtgggcgcccaggccaagtgaccgcagggcgcaggcatcactgccctgctgtgttgaggtctgttctccgagtcagggtctgaagtccagttgggtctggggagcaccagcctcggcacagctcagtgcctgcctgtccggccttgaagacccagctgacctgctgactgtgtcaggccagctgtggcggccctaccaggctccccagctcccacctggggccctggcctgaagtacagcagcgggggtgactttgtatctcaggagctcccagttccatacctcatgctgggtaatgaaagttggatttttgccactcgagggcctgagaggacttgtgggggtgatgacccctcagagggtctacagagactgggcaggcggtggcctgaggcatggctctcccctgctgggtgttcttgggtgtgagatgggcagtaccctgcaggtgtcatgtgctactgagttaccccgttatttaattaatgcagcctgaggccaaccccaaagcttctaaggcagcagggaaatcacctgtgctacagtctgttcctgaccctctgtcctgcttcatagatgaggtaacgaggcgcttggcccccctgacaagggttcggccatgacaccacgcatgttggctctggagggagcagccagaagagggtgtggtgggccacatgctgtcaggcgtccccaccaggccaggctggtgagcacagagggtgacagctggtcccaccgtgaagggacctagctggctctgcctgtctgcagccgacactcacctcctgggcccttgattggcttgtcagggcactgcaccccagctgctttctgtgttttttctcatcccccccacccagtccttgtgttctcatcaccatctatttagcaccccacattcaaaaccccagcctcactaccgtaatttatgccttgaatgatcttttgcagaaacatcataagaaaaaagccttttctattcatgcatgctcactgtgcccgcgtcatcctctgcaaatccataggtccatttagggtcactctccctccttctgaagaacttctagaaccttcctcacagtgcaggccagatgctgacagaagattctctcagcatttgtttgagcgaatctttatttccctttctcttttcactgggcatggaattgtggtctggcggtgtttctccctcagcactttgaagatgccctcccagtgtcggggctggctcctgatgtgcagtgtcggcacctcggcacttggggcgactgttgtggctgtgctgatttgctcatgatgcgccacgacctggtagttttcctgctgggggttgacaaggcttcttgggtctgtggatttatagcatttgttacatttgggaatctctggccactcttttctcagatcccccgcctgccctcaggactccagttacttgcacgtgggatcccctgctgtcgtccgcaggtcaccgaggtggtgttcgtttcctgtaggcttcttactgtgggattcatctaggtggctcctgtggctttgtcttcaagttcgctgcccttttcttctgtggtgcctgctgtgacttccacctagtggccgtttcattccgatcctccgtgtctcagctccagaagcccctcgtggctctctcacgatacccgtacgtcttcctcttcagctgttttcctttaggcttggagcattccaagttcacagtagctgtcccaaagcccctgtctgttcagtcggcatctctgtgcttcccacgtctttgtgccgactcattttccccctggcttaggagtctcgttttcctgctgcttcacgtgtctgtagggttctgcttatagataccacatggcgttcttatgaggtgggtccctgcccgatggtccgcacagggctggccatgatttagacgggagttagccttagtgcccgtgtctgttaatggctgggtgcgtcctgtgtctgtcaccctcatgcgtgcgtgatgttaggagtgaattgctctgttgttaacaagggcctggtctcctgctggagggtggggatacagtgtgagccagagtggctgggagcctggccatgatgacggccacctctcatggggacaggcacttgaggttagccctcctggcatcatagagaaaggctggctctgtggcccctcagcccttctcctctgaggcatgaagtcttgttctccatacccttgggggataagcgacttggcaagaaaggagtcttgaaggtgacccacctgacagtcagctaccagaacctggttaaatgcctcactggatggcgtggcccacagggagcatggagccacggggtgggtgggagggccagtgtgttcaaggcctgtcaccctcagccttgcacagctggggctgccctggcacagttccttgggggggttgtgcaccctaactggttcctgtcccttgtcaccctaactggcctcagcatcatcactgttttctgagccctcatccctggctcacagctgcacatgcagaggcctcgcatggacagtagacagggtgcttgtgttagccccgggccgacccctctgcagaggtttgcaccgcgagagacggggcccacctgctctctgcagctgctgcactgagttcctgctccagtcccctgctgctccctcctccagaatacccttcccacctggccttggtcgtgtgctcctggggcccatgaggactggtgccatgagtttgtgggggctccctgagtggggtgggctgggccattctgccttggtgcttcctttgctccgtgtggttcttgtgtcttacgccagttccctttcactcgtgcattgaaaatggttaacggacaggactctcctccgtctgttccagaactcgccgtgtgtgtgtcagagaatgttgctcctgtgccctgagtcaacaaagacggcccctgtgagctcaagggcagttgggaaggtgtagcgaacatcctgtaaaacgtcccatcttgtgagttttgaccctctaccctcgcccggctgcagccactccccactcccacctccagccctggacacctgctggtcggctttctgtctctttggttttgccttacctggggatttatagaaatggagtcatacagcctgtggcatgacgtgcagccttctttcacttggcatggtcctctgtattccattgtttgattctctctccaccagttgacggacatttgggctactgccgctttttggattctctaaataattctgctataaatgttcaggtgtaagtttttgtacggaagtgtgtttttgtgggtgtatacccggggtggaattgctgggtgtgtttaaccctttgtttaaccttttagaaaactgccaggtggcttccacagtggctgagccttgtccactcccgcccacgacggcagaggttctgggtcctcgccaacacttgctcttgtcagcttcttttagattagctgctctgatgggtacagagctatctcagtgtggttatgtttttttttattttttaaaatatttttatggctatcaatctaggtcactatggttacagtttgcatttccttgatgagtaatggcatccggtgtcttttcacaccttaattggtccctataggtctctttttcatgtctgtgtttaaccaaattcttttttgttgctgttgttgagacaggatctcactctgttgcccaggctggagtgcagtggtgcaatctcagctcactgcaacctccacttcctgggttgaagtgattctcctgccttggcctcccaagtagttgggattacaggtgcccactgccacgcccagctaatttttgtatttttagtacagatgggggtttcaccatgttggccagactggtctcgaactcctgacgtcaagtgatctgcccacctcggcctcccaaagtgctgggattacaggcgtgaaccacctggcctgtttaaccaaatttgtagcaaaggtcattcagatgctgcttccccaaggtcccagccaggccgaggtcccctgttctctgcagtagcagcacaggctggtggttgagtcgtgttttggggtacagggctagcccttcctgagctgctctagacgagccccccttgtcgcagtagcacagtggcccttgtgactgcagcagctgtttcctggtcttggaacaggacaagggagtgggccatggacgtgttgcaccatggacagtggtggcttgcgccgtgaatcgtgctcgctgtggagtgggcccatgtatttgttgaggggtggcgtgtttgagaagcatggggcagtttctggggcatcacggcctgggtggtgttagcgtgcaggggcaccatccctctgttctcccctaaacagcagaatccttggggagtcttggcaaaatccttggagagacttggcaaagaagggggctcctggtagaccaaagtgaggcactcggtgcctcccactctgggcactatgcatgtcatatgtatacagctgcgtggtctaagctggccaagcagacccatggctcagggcacacatggagcaggtgctgaaaggccagccatctctcatgtcccaggcggcttccgctgctcctagcagctcctgtctttcccaactgatgggcactggatgtgagcagttggagggccctgtgccatctcaagctggagtcctggaacagtgctgagtggctccagagggcggaccctgggctgacccatggggtaggtgttgtctctgatactgtcgcaggtgtggagctgctccgcttaccccgggtcttccgacaggcctctccagactcaagtagtgctttgccctctggggagagctatgggcagaccagggtgggagggagtgagacctgagcagtggagacggagcccaggacggggtactatgaggacaggagcaaggcctgggtgggagggcatctcagtgggctggacctgagtggggcagtggggccaggtggtgcaggggtgggtttggggaccaagaatcatggtgatcagccagggctatgctgtggggtagcatctgggacactgagatctacgcttagggccccaggttgggaagagggaagaagatgcagaggtgcagtcctcctctggctcgcagttctttctcagatactgccagaaggctggtctctgaatagctgaagcgtcagtatttattttgagctcttttgtatattttttccttggaaattccactgctccaagctcagtgaccagctgtccagaagccatgtgactgccccaaggccgtgtggtggagctgtgcaggcctcaggctcccaccccaggctccaaggtggccccaccgcacctgctctgatagacagtgctcacccacctggttgttaaaagccagtgtttgtgagacaggacttagcctggttggtggtttcaggggatcagctggggctgtgagagtggagggggctgcttttgcctgtatgggtccttgggagagtcatgatccagggtcaaccctgacctgtctttgctttttcctggcagggctgtgagcaccttgagccttgcccttctctcccggtggattcacaggctggtggtggctttccaaggatggcacactccccgcccctgcatcctgggccttccgccagcctgttgcctgtgtctggaggccccattcttacctgtcatgtgtccccagccctctgtccatctgaggaactcctactgatccttctaaaaccctgctccggtgaccttgcctataattttcagagtgtgtgcatttcctttcccctctcctgagaacaccatcttcaccctgctccttctatacctggggagggagtctttgggtttcccaatgtctttattgatgttcccctcacctttttttttttttttttttttttataggattctgtttcactgaggccatctatccgatttcaaggaagccaaggggtaagtttttgtcttaatcattcatatttggaatcttgggactggtatagtctcaggtctgtccttgctcgctgggtacagcagcagctcatggcagtgtttgggccctgtctgccaccatgcaaggctgggttctaggcccccaggatagccccttggctggggccacaccaggacgtgtcgggtgcacgtcacaggctgcttgggcaatgggcggctctcctctcccagtggctcccttcatgcagcgatgtgcacctagcttccactctgatagggcaggggcccccaacccccagcactggactggttaggaactgcccacacagcaggaggtgagctgtgggtgagtgagcacgaccacctgagctctgcctcctgtcagctgagcctgttattagattcttacaggagcgcgaaccctattgtgaactgcgcatgccagggatctaggttgcgtgctccttatgagaatctaatgcctgatctgaggtggatcagtttcagccggaaaccatcctcccctatggctccctgtcccccttccaccatccatagaaaaattgtcttctggccaggtgtggtggttcacacctataatcccaggactttgggatgctgaggcaggcagatcacctgagagatctggagtttgagaccagcctgaccaacgtagagaaacgcgtctctactaaaaatacaaaattagctgggtgtggtggtgcatgcctataatcttagctactcaggaggctgaggcaggagaattgcttgaacctgggaggtggaggttgcagtgagccgagatcgcaccattgtactacagcccgggcaacaagagcgaaactctgtctcaaaaaaaaaaagaaaaagaaaaattgtcttccacgaaactagtcgctggtgccaaaaaggtaggggactgctgcattagggcacacaaggaccttggacatttgtctggattttggttgggagagaggttcatagaaactcagcaccctcatttttttgaaatatgttttcttctaaatgaccatcttatagaaaaatcagggaatgagagaaagggtgagtcatctaccttctttgaccccctgttttaggactcttcatctcccctaacctacccgatatgccttagaatggtttgatttttcttctagcctttattgcaggttcccctgcatctaggctggagtgcagtggtgcaatcttggctcactgcaacttcggcctcctggattcaagtaattctcctgcctaagcctcccaagtagctgagattacagacgcctgccaccatgcctggctaatttttgtacttttagtagagatagggtttcaccatgttggccaggctggtctcaaactcctgacctcaggtgatccacctgctgcagcctcccaaagtgctgggattacaggtgagccaccacgcccagccttgttttgttttttaagagatgagtctctctgttgccgaggctggagtgcagtggcacaaccatagcttacttcagctttgaactcttgggctcaagggatcctcccacctcagcttctcaagtagttgggactactggtgtacactaccatgctaggcaaattttatttttatttttgtaaagacggagtctcattatgttgtccaggctggtcttgaacttctaggctcaaatgatcttcccaccttggcctcccaaagtgctagaattacaggtgtgagccactgcacccaactttttttttttcttttagagttaccatgttgtacctaaatcaatttctgtccacagcctgagagctctgcacagctggatgtggggatatggacatgatgatccatgggcttccaggtgcagcccagggttctgcagagacatggagcctctaggagacgtgtgtctgtgtgtgctgataaaaagatgcattgcaagcagtgggctcagacgactgtgggctggggagtctgtaaccctcagggctggctgcagacctccagtaggagctgatggagcagtcctcaggcagagtttcttcctcctcctgccaaaccccagccagtttccctcttaaggccttgggctgattcgatgggaccacccagaccatcgagggtcatctcctttacttgctttcagtatctggtttgtggatggtaaccatgtccacagagtacctccagggcacccctagacgggatgtcatggaataatgaatctccaggggctgcagcctagccagttgacacaaccccacacttccatcagccccagttgggtcttgtggtcaccctttggccacctcctttttaccttccccaggacattctctcaggggtcagaggttgggggcaggggcgggctggcctgggcttgctgccagagcagccccacagtgccctctggtgtcctacagcagtcactctgtgccttctgctgctgcctgaccacccatgcccctctaccccaacctgagcagtgggggggcccctcatccccaacccccatctcagcgagcccgtcagatgacacactgcagcctggccatggccgaagcacacagtggtgtccttgcgtgcagcatgccatgtgccttgacctggagcctaataacatgtgtagcaggggcccaagtcactgagagagacctggggtggctacacagctaacctccttctagagacagggttttgccatgttggccaggctggtctcgaactcctgacctcaggtgatccacccacctcagcctcccaaagtgctgggattataggcgggagccaccgcgcctggccagctgcttcactttagtgggctgttagctttggggctcttggtcctgggccatgctgccggcagcctgccacagagcctgcactgggctcatcgttgtcggaacgccccctggatggtgttccttcatggatccagtcagccagcatcgcccaagctcctgtctggggtcaggtggggagtgcagcaggccccaatttgggatggatttcaaagggaagagatgaacggactctggcagggacttgagcggtggtggaagcaacgccccctggtggccatggtcaggtcagcgggaagggcagagcgggcctttgggccctgcggaagcgcctaggatgagcccctgtggcctgggctctgtgtctgtgagcatggactagtgcttaggtttatggcaactcctccccacaccctataacctggagccgggactgacctcagacatacccagacctgctgtgcgtgggccatctgagggccccatggcagcccactggtacgtgggtcactgggcccatgagcagtccccaaggagcaaccaagaccccattcagaaggctgagcaggggctgcgtttcaaaccttgtcccagaacccgggcaagctcttggctagtgcgaagaaagtggccgcattcctgggctgctcccatcccgctggcttccccacggtcccgggctggtaaccattaaccagcagcaaaacagcccgttaatcagagggctccatagcgcttcgtgtgctaggggaggcagggcctgtgagaacctcggtgtctggctccgggaaacctttcctaacactctccccaccttctcacccctgcatcctgaaggacgccaaccgccatgccctctgtgtgtcttccccttttcgccagcagcacgacactctcccgagcatcagctttgaggcctgtgtcaccccccttcatgcagcccctactccccgccacagctgcacacctggccctgggctctgcacctggcccctgcttctaggatggagtttggggggcagatgtctacacctgtgtggaaaagatccaagcagggtgaagggccactatgaagcccctacccacagagaagcaaggttgctgggcaggctcaggcaggggggccctgtcagtgctgactgggtgtacagctgccccaggccacaggcagtggcctggtctcactgccagctctctgctgagtggcatctcccctgaagccagggtgacagaatgagtcctgccaacctgggtggagctggggttttcctgggacagggctgcacgtgagggtgcccagcccttagtcactgtggggcaggagccactggcaacttgggcctcaggccaggaccacagggggcagtgggggttaaagagatgacagaggagggcgggagagccacccaggccaggctcaggttcccacagccactctttttggtttccctggacgtgtggtccccagcttccctggctggctcattctgggtcaccatgtcacctgtgcacctggccaccacagagcctctcacaaacttgagcttccctcatcccagcagcgtgtttccagtttcttgtatgaacgagaataaaagtcacatctgggaagggaggtgcaggcagggcagggtggcacctgtgtgtgttgggtgaaaaaacacctcagtggcgtcgaagcaggacagatctggatggccagggtcacccacatggctctggctgaggcttcagggcgtgtgtggttgtttgtgtgtgggaggttgtgtttctgtgtgtatggattgtgtttgtgtgtgtgtgtgtgtatggattgtttgtgtgtgtgggggttgtgtttgtgtgggttgtggttgtgtgtgtggttatgtgtgagttgtgtttgtgtggctgtgtgggggtttatgtctgggttgtgtttgtgtggttgtgtgtaggggtttgtgtgtggaggggtttggtgtggaggggtttgtgtgtggctgtgtgtgtgggggttgtgcatgtgtgggttgtgtgtgtgggttgtgtttgtgtgtgggggaggttgtgtgtggtgctgtcggggtggttgtatgtgtggcgctatgtgttgggtattgtgtgtgtatggttgtgtgtggggagattgtgtatggaggggttgtgtttgtgtgtgggggggattgtgtggttgtggggggttgtgtgtagggagatcgtgtgtggaggggttgtgtttgtgtgtgtggggggattgtgtggttgtggggggttgtgtgtggggagattgtgtgtggaggggttgtgtttgtgtgtgtgtggggattgtgtggttgtgggggattgtgtgtggggagattgtgtgtggaggggttgtgtttgtgtgtgtgtgtgtgtgtgtgtgtgtgtgtgtgtgtgtgtggttgtgtggtgggggcgggtggggagggtttctctgtccgagggtgaatcatcagaggctatatgtgtgtgatttctccgatgctgagtgcaggccgtttctgccttctctgaccctgatagagatgtgtgtttgtgttcaggtgtggcctggcatggtgggcccacaatggactttggccttgccctccaccagcacgctgtttgggccctgacccctcagcttgtgtttctgtatcagcatgacagggacaagggcacctgccttagggggacatgttcgaggctgagaggggatgctgggcagaccccagcagatgggacggcttttttcctggggcagtgttcagcctggggaaggggcaggatgggcctctggagaagggtctgcaggccgggcagactggctggtacagggactgcctgcaagcccagaccagactcttcctgccccaagtggccgaacccaggaactgttcttgtcttgggagcagggactggcactgggctgggtgcagccatggcttcccttgtgtgtccaaacactaccccaggggacaagtcccagtcaaggccacacagcagggccggggattggtgctcctccacgtgtctggtggcaggagccccgtcctgtctcacaggtgaggcacaggcaggcaaagcctcccatgggcgtatgaggcagctcagcaggggcgagggggcaggagattcagccacagtctctcccgcgctcatggtgtcacagaggaggagacggggcttgggtgccaagggggtgctgcagccaggggacaagacctgagggctccccccatgttgtcccctccttgtggactatttgagcgcccttcatgtgtcagtctaactgtgaggagctcatgccaaagcccaggcattagtttaggaagggccaactctgttgacagagggtctggggtcagcctggaatgcaatggcctctgatgtgatgccgccctgcactgagcctggccgggaccagcgcagtccgtccatccgcctgcctgcccctggctgtccgtcctcccagacagggctggagctttgcccagctgggctgcaggggcacagccaaagtcaggctggtgtgacccatgacaggcttgttgggggccagtgcttctgatctgtgagcccctgggacacaagcctacctgattcacagctgcagcaaatggagactcacgtggagtccatgtcctttgtggggggatgctgagagggggtcgccaaggaggggcgccagagttgcgcgtggctgcccaagcccctcttgttgcattttacctcatagggtgtcgcaggccaggtctgtccatttggtggtggggaaagtgagtcatggtccagacaaaccactttccaggggtcacacgattggggtgggggccctgcatctgggcaggtgctgagcactgtcctcagacagcagtgctgttgctgctgaaaacggcccctggccccatgcccacccgcataggtgcctgagtcccctctctacgcagtgtgtgttgctgaggatgggctgcctgtcccgtcactggctgaagagcaggggtgtgttttagggaaaagggccagcacattcctgttgtgagggttgcactgtggggactcatgcaggaagatgcaggctggggacctgtcctgccgaggacctcccagtgacaccccctccccctccacgcagcacatctccatcccccagcctgactgccccgcagaggcgcggacgttctccttctacctctccaacatcggccgcgacaacccccagggcagcttcgactgcatccagcagtatgtctccaggtgaggcgccgccccaccccagagcaccccgccggctcttgaggtcaccctgccacctctggcccagggttgagatgtgccccattgaaaccatattgcctgagatggtgttgacagagtccattttccaggccaggtggtgggctgggggcttgggccctcaacggatcctccctgcattgtcccagctgctgaccccagctcctggccttgtcttgcagtcatggggaagttcacctggactgcctgggcagcatacaggacaagatcacggtgtgtgccaccgacgactcctaccagaaggcgcggcagagcatggcccaggcggaggaggagacgcggagccgaagtgccattgtcatcaaggctggaggccgctacctgggtgagcagtgggtttggcagggctgtagggcagccgggcagctgccagtgtcgggagacatttggggcctgtccaggctgggcactggctgtgccctgcacagaaatgatgggtcaaccgaggagtcggtccctgagcaggacgtgcctggaccagagtctgggttgggaagagaggtatggccacatgggcctgggggctatgtgagggatagggggttgggttatggcagctgctggcttgtgaagcctgaggtggacaaaggggcctgagaactccaggagctgtgagttggtggtccctgctttcaggctgcagccttggggaccttcacctgtcagggagatcaacaggctccctgaagatgggcatgcagcctagggcaaggcccatgtctgtctctggaggctgcccccaccctcacctgaccagccagctcctgcccaacgccaccacagccggcaacaggcaggaaatgagcctcacaggccctgttgccagcgacccagcactgcaggaaagctctggccactcagcatcaacttggaaacggtttcagcagttgagaagccaacaggccttgacagtgggaagcacagtgctgtttgtttacagagctgcagcaccccgcctcttagtccaggcagagctccaggagtcatgggaactcattacggcaggagtagggtgccgggcttcagggaggagggagatggctcagagcagacgacagccttgatggctttttgagttttatctttaagaaaaggcgggggcatttcaattcctctctctcctccttccgaagaaagcacgtgatttccctttgctgagcagaggggttccctctgagtgaaaccccagatgtgggtgcaggggttggtcttcctggtcaacactgagtccgggtggacatgttgtatggccagggagcccgggttgtccatgatgttgaggccctgggctgtaagccccaagcacagggctgctgtggggagaacagttgaagagacagcgtgttttgttttttgttttttctttttttaaagacaggacctttctctgtcactcaggctggagtgcggtggcacaatcatagctcactgcagcctcaaactcctaggctcaagtgatcctacctcagcctccagagtagctgggaccacaggtgtgtgccaccacacatggctaacttttagattttttgtagagacagagcctcgctatgttgcacaggctggtgtctgactcctgggctcaaatgatcctttcgcctgggcctcccacaatgctgggattacaggcatgagtcagcgcacctggccccatatacatgttaataaatctgtgggtccttcagccaaaaacttgatcagaaatgtatcttagcacaccactttgggtacagtgagggttttttttttttgagatggagtcgcggtctgtcgcccaggctggagtgcagtggcgcgatctcggctcactgcaacctccgcctcccgggttcacgccattctcctgcctcagcctcccgagtagctgggactacaggtgcctgccaccacgcccggctaattttctttttttttgtatttttaatagagacggggtttcaccgtgttagccaggacggtctcgatctcctgacctcgtaatccgcccacctcagcatcccaaagtgctgggattacaggtgtgagccaccgcccctggcccagtgagggtttttgaaacagtttatgttctggtaggggacgctgtctgttaagatgtgaatgtggccagatgcagtggctcacacctgtaatctcagcactttgagagtccaaggcagggagatcacaaggtcaggagttcgagaccagcctggccaatatggtgaaaccccatctctactaaaaatacaaaaattagccagttgtggtggcgtgcgcctggagtcccagctactcgggaggctgaggcaggagaatctcttgaacctggaaggcggaggttgcagtgagctgagattgtgccattgcactccagcctgcgcaacagagtgagactctgtctcaaaaaaaaaaaaaaaaaaaaaaaaaaagatgtgaatgtgcgtgttcctctgtctcacagtgcccccctcaggttgctcctcctccctgtcaatcagcctggccctatatgggtgagtccagccctgctgtcaggaccccactgaacagaccccagaggtgtgagcactggccctgggtattctgaaagcaaggctttctgggttaatttgacagatcagattttgagagataagatcagagtgatgttgttacgaagagcttttgggggaaggatttgaggcactgttgagcttgctcggccgaccctgttcccaaggatgccggggcatcattgttcaggacagagcaggggagcagcgtgctggaccctgcccacgtctctgcgttggggatagaggggaacctgctctccccagggctctgggcacagccacgcctgccagaggagagcttgaccaggcctaaggctggggtgccacttgcacctcagggtcttcagagcagctgctgaaagtggctccgacatctttactgactttagaaaaacaaaaatggcagccacatggggccagcataggactctgaagtgcaggcttgggagtgactgcctcttgcagttcagggacccccagtttaacatcagaagggtttacaaacagcccctgcctcaggttgggcaggatggctctggtttataataccagcactttggaaagctgaggtgggagggtcctttgggcccatgagtttgagaccagtctgggcagcatagtgagaccccatctctacaaataatataaattagccaggcatggtggtgcacacctgtggtcccagctactccagaggctgaggtgggaggatcgcttgagcccagaagtttggggctgcaatgagccatgattgtattacactccagcctgggtgacagagcaggatcctgtctcaaaaaacaaaacaatccttccccccccgccccccgcccaaacacacacacacacacacacacacacacagcccactagagtgatcaggtgatttcatacacgcacacacacattgcccaccagagtgatcaggtgatttctcacacacacatactgcccaccagagtgatcaggtgattacatacacacacacacacacacacacacacacacacacacacacactgcccaccagagtgagagtgatcaggtgattttgctgtccaggatttaggttgcctgtgatgaagtaagtaaggctctaacacagttctgccgcctgcacctcccacttctgaggctgggtgccctgcaggtgcctgccttgggcagcaggtggcgctcttggtcgcccagggtccccaaggagcaagctggcttttgctgtggttggtgtggtgcctcccaccagcactgtctatagtctcaaacctctgggcacctggtcagcagcactggcttaggacacggcagcgccctctctgttccctaaagcttggattcttgttgcaggcaagaaggttcagtttcggaaaccagccccaggtgcaacagacgcggtgccctcccggaagcgggcaacccccatcaacttggcgagtgccatcaggaagagtggtgccagtgccgtgagtgggggcagcggggtgtcccagaggcccttccgtgaccgagtgctgcacctcctggcactacggccctaccgcaaggctgagctgctgctgcgactgcagaaggacggcctgacgcaggcggacaaggacgcgctggatggcctcctccagcaggtgggtgccgccccgatgtcttgtctttaccagtggtctccgcagatggtcttgtgcgggtgggatgggccagagcatggagactgggattgggactggcaaggaagagcccttcctggggtctctcacaggttcagaacctgcctgagagccagggcctcctggattagaacaagcttagggggccatggatgcgtttctgggcatggccccgactgtccagggttgagaggtggactcagcatggagcccaggccctccttcactgtctgctgacacacgggccgtggggcctggcacagtggattcaggcttcagttgcagacgatttgtggactcaaggcctggggaaggaatctacacgtgcctggcagagcctggcaggcctcagtgtgaatcagctgcctgccgccctccacctgcgcctccgggtgaggggcttcacgtctcagaccatcaggcttccatctgtgacctgcagtgcccctccctggggttggaggctaggccatctggaatgtggtgctggcgagtggagcctgctcttgagaaacaccccgggcattggagcaggtgcgatggccctgactgccttccacccccctcacccatggaggttcctgaggctccaccttggcttcctggggtccctgggaaggggagtgactcgcactggcttcagaacattagccaggctatgcagatgcagccttgaggtgaactgaggatgggtctcctcggatcgctgctgtggtggaggaagagacatggctgagcctcttgcaccttttaggatgatggaagtgggatgttcggggtcacatccagcacctcaggaacacaggtgatgcctgcagcaaaaagcacatgctgtggcatgccgggatagcagctgtataaaggacgttcttccatgtttacggagctcctcataggcgtccctctcgggtgcgcggctggtgggaccctgttccacattccttgggaggatgtcagcctggccctcgtccacccccatcctgctcccaaggctagggctggcatggtgccagcaggagttgctgaagggagctcgatggagtcatcagatgtgggacctgcattggcctggccaggaggtgtctgtgctggtgcctggcttctccaggtgactttggttcagtgcctcctgggagcaggcctggccagcatctgcaggcagattgtcccttcctgtgccactgtgacttcccctggacagctcgtctgcttcttgcttctatattcattatgcagctgcttccccccaagcagctgtgggggtcagcaggacactgttggcttgtagaagaggagggggatgtgcctcacccagactggtcatttccagcccctcacaggccctcagacatgctgaggaatggcagtgacaaaactgcatgcctcaaaggtgcttggccctccctctgtggaaaaatctagagcagagatggaaggtgtccacctctaggactggctgagccccagggaaacccgcaagcctatccttcaaggggaggggtgttgacggctgagtaatatttagcaaagcctgtcatgagccataaaaatattcagcctttgacctactaatctggcttctgggaatcccgtcgaaggaaactgttgccaacctgaaaaaaactgcacacagtaatgtctgtttatgctacagagaaactggcagcagtttgggggtgggatattactcaactgttaaaaatgctccccatgggccgggcgcggtggctcacgcctgtaatcccagcactttgggaggccgaggcaagtggattacgaggtcaggagatcgagaccatcctggctaacatggtgaaaccccatctctactaaaaatacacacacaaaaaaattagccgggcgtggtggcgggtgcctgtagtcccagctactccagaggctgaggctggagaatggcgtgaacccgggaggcggagcttgcagtgagccaagatagcgccattgcactctagcctgggcaactgagcgagactccatctcaaaaaaaaaaaaaaaatgctccccatgggatacgctgtgacgcagagccatgtcagatgcagcagaaaacagtgactgctatgcctgcagcaagatggagaccagagtgccctgtaggccagcacgcagcacccactcagggcagtgacctggagcttcctcagatccctctaaggcagacgttctgaatccatctttgttagcagtctgggagacgaacttagctttggtcaaccggcaacagcaaggcaggctggttgtagggaaggtgggctcagacgtggccccagaggtacccctcacccagcatccccagccgtggctgactcttccctgggagttgtgatcagaaatggggtggagcccagcgcggtggctcacgcctgtttccagcactttgggaggctgaggtgggaggatccttgaggccaggagctcgagaccagcctatgcaaaatactgagatcctatctatacaaaaaattagctgggtatgatagtgcatgcttatagcccacctacttgggagactgaggcaagaggatcgcttgagcccaggagtttgcagctacagtgaaccttgatcacaccactgcactccagcctggaagaaataggagccaggtgtggtggctggaatcccagcacattgggaggctgagatcagaggatcgcttgagcccaggggttcaagacaagcctggacaacatagcgagatcccatctcttaaaaaaaattagctggagtatagtggtgcacacctgtggccccacctacctgggaggctgacgtgggagggtcgcttgagcacaggaggtctaggctatagtgagctaagatcttgtatcaaaaaaggaaaaaaagcaggctagaggggccagggggcaggtgatggggtctcagtactgcaggtggtagccctcccctttttggagccagcctggccccagcacctctaagacagttgagtctggacctgccttcatgaccctcattatcccttctgcaccctgaggattgtgtgcgggggaactgggggtgggagacatcacggatcggtagtgggccatcctctttcctctcctctgtctctgtctgtctcccactgtctctgcacaccctcccaaacccactatcagatcttttttctctagtcccccgtctctctcaggattcccacaaagtgatggctggctctgtcttgcaggtggccaacatgagtgctaaggacggcacgtgtacactgcaggactgcatgtacaaggatgtgcagaaggactggcctggctactcggagggggaccagcagctgctgaagcgggtgctcgtccggtaatgccgcctcccatcccccagcatgtccccacccgcatgaaggcagccagagcttacccagaggatgctggggtggtcttgtgtggtcctgaaggccacagggcttgggagcaggatggaagggtccaagtaggcctctctggccatcctccctactgcccacgtggtgccccagggtgtcccgtggtgggggaaggccacgctcacagagtgggacggaggtgtgagtcactggccccgaccttggaatcttcagacaaaaggcctcagtctgctgagaccctcctcagctgtccccaacttcccttcatgcttccctccacaacctgggcatccccacagggcctgggaagttcactgactttttgaaaagagcctctcaagaacctgaagtagagagaaataaggccaaacgacactcccggcagggcaggcgtcattaagcagcgttaattaaatgcatcccctcaggctaattgggacccagggtcagaagtggcagcagctcaggggagcagtggttaaggaggcaggcggctaatgacttccttctccactgctgccagctaggggagctcgggctgtgaagcaggtcaatctgctaattagtccgtaagtgatttctcagggactcggaggtatttatgagtttgtagttgttttttggaagttcagctgtttaaagcagtaattgcctctggaaagcagaatgaagttgggggtccactctgctcccctgagagggtagtgcctgcctgtccaccctgggtgtgcaggtcaggggcctgcggggcactgccctggcttggcggcaggctggcggagggcacagtcttggcagaagacccgcccccatcctcataccctgtgtcctctcccttggccccctgggttcctcagacccttagggcactggaaggagaactgcccagagctagtggagtgaggtggagaaggctgggctgcacctctggggcgtcggggagcttccccgggatgcaggctccagagccgcctccagctcccctgattcaaggctcatgttccgtctgctgagtgagcttgctgggctcatgccagccccttggcactctgctttcactctgggccggcatggggatcagcactgccttcacaagcttccactagcgtgcagggggcagggttgatgtccctgggccataaccacatagaaggtgacctgcggtgcccctctgcatagctgtttttttttttttttcctatttagcaccccatccctaagaaagccccatttatagcagtttttgacaccatggcttcgtgtatatcaaagcagggccttggagtatttgttaccagctgggctagcccagtgcaggccgttagcctagtgcaggccgtgagacagatgggatgtgggggcccaagtcactgcaggagcctccccagctgagctggcaccacatgtggctttggggggtggtttctccactcatgttctctttgttcatgatgtccaaacccgatctgtccctggtatccaaatctcctctcatcactgtccatgggtcaggggtcctgcaggtccccccaagagttcctgattcctctgcccaagccacacactgcctggtgcccttacctccaacctgagccactcccctctcctgtgagccccatgccagagtctatatactcctccttcctgctcctccctggtgccaagggagcacagctcctggagcacctctctgaggacagggctccaggaggactgctggccacatcttcatgcccagacgatggtcctgctgagccggcggttgatcacatctagacttgtagagtccaagatgctttccctccacgttgaaggtcagaggcttcccaccccaaccctgtgctggtccacagagccaggggctggccaggtacctactctgggatggtgggcaccacggcccccgcaggctgaaaacttgccttatccgtctatccgtccttctgtcctgtgtgtggtagtggaaaggcctatcctactgcacaccacctcaaactgctcttggcaggctgctagagtctgtcctcctcttcctggttttcatctcttttttttttttttgtgatggagttttgctcttgttgcccaggctggagtgcaatggcgcgatctcggctcacagcaacgtccgtctcctgggttcaagccattctcctgcctcagcatccagagtagctgggattacaggcatgcgcaccatgcccggctaattttgtatttttagtagagatggggtttctccatgttggtcaggctggtctcaaactccggatctcaggtgatccgcccacctcagcctcccaaagtgctgggattacaggcgtgagccaccgcgcccagctggttttcatctcttgctcttttttattctccttttaggagacttctttgacatttctcatcctgtctcttaatttactattatttgtagtttctttttttttcttgagacagagtgttgctctgttgcctaggcaaagagatggggtttcaccatgttctccagactggtcttgaactcctgacctcaagtgatctgcctgcctcagccacccaaagcactgggattacacatgtgagccaccatgcaaggcctattatttctagtttctaagagtcttccccattgcgttttcgtaggagcatgttcttttttttttttttttcctgagacagagtcttgctctgtcacgcaggctggagtgcagtggcatgatctcggctcactgcaacctccgcctcctgggttcaagcaattctgtgcctcagcttcccgagtagctgggattacaggtgcccgccaccacgcctggctaatttttgtatttttagtagagatggggtttcaccatcttggccaggctggtctggaactcctgacctcatgatccacccgcctcggcctcccaaagtgctgggattacaggcgtgatccactgtgcctggcctaactcatcatgttcttatttaatggaaaggatgtctttttctttctttctttctttttttttttttttggagagggactctcaccctatcgcccaacctggagtgcagtggcgcaatcttggctcactgcaacctctgcctccccggttcaagcaattctcctgcctcagcctcctgagtagctgggattacaggcatgcaccaccatgcccggctaattttttgtatttttagtagatctggggtttcaccatgttggccaggcttgtctcaaactcctgacctcaagggcctcagccttccaaagtgctgggtttacaggtgtgagccaccgtgcccagccaggatgccttttttttttttttttttgagactgagtctcactctgttgcccaggctggagtgcagtggcgcaatctctgctcactgcaacatctgcctcccaggttcaagtgattcgcctacctcagcttcccgagtagctgggattacaggcgcctgccaccacgaccggctaattttgtatttttaagtagagacagggtttcaccatgcaggccaggctggtcgggaactcccaacctcaggtaatctgcccatctcagcctcccaaagtactgggattacaggcatgagccattatgcccagcccaggatgtcatttttaacctactctaaggatgtttattttatttatttctttatttattttgagacggagtcttgctcgtcacccaggctggagtgcagtggcgcgatctcggctcactgctagctccgcctcctgggttgacaccattctcctgcctcagcctcgcgagtagctgggactacaggcgcccgccaccatgcccggctaattttttgtatttttagtagagatgaggtttcaccgtgttagccaggatggtctcgatctcctgacctcgtgatccacctgcctcggcctcccaaagtgctgggattacaggcgtgagccatcgggcccggcctctaaggatgttttttaaagaataacagctttattcagatacagttcatgtaacacaagtcatccatttaaagtgagcagctcagtaacattttgtacgttcataatattgtgcagccaccacctctgtctagttccagaaaattttcatttccccaaaaggaaaccctatccccatcaggagtcattctccccattccctcccatgctcccagcccctggtaactactaatctgctttctgtctctattgatttgcctgttgtggacatttcagatcaatggaattatacgctgtgtggctgacatgtaatctgtggaaacttgtagctgtgaggaatgttgaatcaggaccgggcgtggtggctcatgcctataatgtcagcactttgggaggcttaggtgggaggattgcttgagcccaagcctgggctcaagttctagacaagcctgggcaacatagtgagaccctcatctctacaaaaaatgaaaaaattagccaggcatggtgttgtgctcttgtgatcccagctaccctagaggctgaggtgggaggatcacttgagcacaggagatccaggctgcagtgagctgtgactgggattagaggcgtgagccactgcgcccaacctattttctgttttttttattccagtcatccctgggtgtgtgtgaagtggtatctcgttgtttgttttttgtttggtgggtttgtttgttcattattgctccttgcagggcagggctaacccataggcagtgtgcccagagtagccagtgtctcgttgttttgatttgcatttccctgatgacacatggcattgagcatcttgttatgtgcttttagccatttgtatagcttctttgaagaaacgtctattcagagcttttgtttttccaaggacacgaaaactggcattttttatttatttattttatgtttttgagacggagtctcggtcttgttgcccagactggagtgcaatggcatgatctctgctcactgcaacctccgcctcccgggttcaagtgattctcctgcttcagcctcccaagtaattgaggttacaggtgcccaccaccatgcccggctaatttttttgtacgtttaggagagacggggtttcaccatgttggccagactggtcccgaactcctgaccttaggtgatccgcctgccttggcctcccaaagtgctgggattacaggcgtgagccatgggcgcccggcctgttgatttattttttaacgttttcatctccctgtggagtctcttttcaaatgtattttcgtgttcctctgttttgaggtctgacgtttgttgcctggaagctgcagtgcagccgttggggacactgcacagcttggggcctctgaatcccgatgtgccctagtcctgggccctgtttcttcttctcctgaggccacacatctggccatcctgttgtccagctgtggcccaggtaacttcccaactgcctggaggagtggcccgagcctctttgctgcctgacagccctgggctcactgtcctgcagccccaccagcagtgatgaggatctggagtagagctgtgggggatggccctgcagcagtctgttgtcccctgaggtcgtggtgcctcttgctctgggccctggattctctggatcctgcagcagtcaccactcatgcttctgctatgctttccggtgtcttcactcctccttttgtctctgccttgcctgtccagtggatgcaaatgcctgttctcagttttctgtctttaactgggagttctgtttatgtccacatggctctcctctcaggccaccagggaagtgacacctgcagtggtctgtagcctagcccatttgttagggagatgggctctgggtgtcactggctggcagaatggccacggccctggacttaagtctctctgcagggcctggaggggcgctaggctgccctgagatggcacagcccccgggaattgaacagttgggtcagagaggatacccataagctgcagggttgctggcgggggtgggggattccacttgcccagatcacatggagcgggagaaggggcatgcactggggtgtttcttcccttcttccccagctgcatcacctagtcaagctggtggccactctgccgccctccagatcctgctgtgacctgggcttccaggaaggctgtctcatcctaggccagggccctccgttctcttctgcattttggacagtttctgcagtgagcgttctgaacaggatgaacagctgtctttaaaagcagggtccagcaccctagcgtgtgtccctggtctctccggtagcaggcacctacacaaagtgatcctcctctgggctcagggggacagtgagtggggaagtcctcctttgggtgaagtcgggggcaggatggcctcaggcccaggctcctgtgaccccttggccctgctctggatttgggaggaggggggtcccttccttgaggcatctccaccgggcccccatgtggatacaggcctggggcccctaggccccctcagcaccttctgacctagccctgcctctccttcgcaggaagctgtgccagccacagagcactggcagcctccttggagaccctgctgcctccagccccccaggcgagcgtgggcgctcggcctcgcccccacaggtaagtgaggcatgcctggggtgactgtcccaagcacctgcagggcactctgtgctgcatcagtaacccttgtcaccttcctcaccagctctttggagcatgagctgctccaagttgagccgcctccctccgcccagggaccaagggggaagctgtcgggttggggttgggggcagattcctgccagtgtggccgcagcaccccagtgtcacagtgcggaacctgggacggggggcggctccctgatgtgggctcaaccctgggcttcctgctcctgtgtcacagttatcactggggaagcatgctgagcacagcagcgctttagaccagtccccaggggtggcccgctcacacactgggccctgccctccccctgcatcgatcccagcaggctgatgggccccagctgaggccaccctgagcggcacctgggacctgacttggtgctcgggcgcccccatgtggccagcgtgggccttgcaggcggcgttgggttttctagccaggccaggggattgcctgttgctgctcagccactctgtgctcccctctaaaatgatctctgctcctctccagaagcggctgcagcctcctgatttcatcgaccccctagccaacaagaaaccccggatatcgcacttcactcagagagctcagcctgccgtcaacgggaagctgggcgtgcccaatggccgtgaggccttgctgcccaccccgggcccaccagccagcacggacaccctcagctccagcactcacctgcccccgcggctggagcccccgagggcccacgaccccctggccgatgtcagcaatgacctgggccacagcggccgagactgtgagcacggagaggcggctgccccagcccccactgtgcgcctcggcctgcccctgctgacggactgtgcccagcccagcaggccacacggcagcccctcgcgcagcaagcccaagaagaagtccaagaagcacaaagacaaggagagggcggctgaggacaagccccgggcccagcttccagactgtgcacctgccacccatgccacccccggagccccagcagacaccccaggtaggtgcccaggcaggagggcgttgccggggctctaagtactggccccacacccgcctcaccctcatggggtgtcgagggggctcaagctgtagaagccaggggaggggaccctgttgccccaggccccatcagatttgccctgtgtgcctggcacctggcaccctatgttcctgcacctggtcctctccctgcctgtctggagtgcccggtgccacttgcagtcaatgtgccaggccagcactgggggccggaggcccagagccttgtggggaactgaggccgcagaaggggctaacatgcagagaggaatggggcccaggccccagctctgactgcagggaagccccaggagccagggccatgctgaggtctgctggggttcagggaagacagtgggggcccaggcaagccagccctattcagggagaggcagcacaggtgcagatgggcagatcctggtgggagagggatagcacctggacctctgtaggcaccgtgcgactgttgtggactgtaggtttctgctgtggggacagggcctggcaggctgggattggggagccaggagacctgggcggctccgagaccacagcccaggcacctaaactgagcagcagtagcacccgcctagcaccgtggccatgagcctgcgcagctgttcatttataggaaccagcagaagcagtggccagcgtgcagcggctgttccaccaccatgtgcgacaggggctgcagtggtcccatgtggcgatggcggccagttgcagatggccacttcgctctcggcgccagctggcccagggcagcccaggtggtgtcacctgctgtgcttttgggttgtgtctctggggaggaggctgagtcaggggattcctgggatgagggtgggagcccttctttcattatagctttgcgttgctcagagggccatgccccgtcccctgctgtggctggagagcaggtcctcacaactgtggctgggtcttactggataggaaggaagactttcggggttgggtcagccctgcctcgtgctgggcttcccacctcccgtgggactgcatgtgggggccgacggggagaaggtggccttactccctgggcagcctctctgaccagggccatgctcagggcaggactcctgattcccaggacacacccacaccccacagccagacctgggccacgatcaaatggcaggatctgccatttgagacccttggcccggctccagggtccacagaccactctgggctgtgtcccttccttggatgcccagtgcctaggtgccaagacaggcctggggactcaaggtggtttcctgtctggcctggtgcgtgttggcccctaggcagttcatccccggcccaggggctgtcatctctaccacaggtgagaaaatgcaaagcaggggtagatgtcccaagcaccaagaaaaggacagtggaggcaccagaagctgagcctggtgctggtggtccatgttaccagagtcctgaaggtggtacttgtgcagggcatgtcttagctgtcctgtgcccgtgcccaggacaagcaagtagagagacgtgggctgtgaaggggagagatggggagaggagctgctgtgggggtgttctccggggccccgaagcagggaccagcttggccggccccacacagccagagcttgagtaggagtcgggggccgctgaggtttgccaagggctggactttgaaggtcccactggtaccaggttgagctgaccctgagccttgatttccccgtttgtcatcctagctggtgaagatcttggggcatgtcaaatgaggtaatgttgaccagcctgacacatggcagttatctgttgtagaatacccacggagtccactgcgtggcgggagcatgggcttggccttcgcagctgcgccttgcctctcacttccttctggcccggaccagggtcagacccattcaatacatgcccattgagttgcgtccctgggaaggccacagcctcttaaagacaacccaggtgggggtggtggtgatatggaagacagtgtctggcccaaagtggggagtgttagaaactttgtggggagtgagcttcgtccacttttgggaatttggcagcagagaagctgctgtggtcagcccaggtgtgttacactgagagagagggctcagcaaactggagatcgcagactcctgctctctcaggggatagtgcagagggcccctgaaaatgtgcactagggccaggcacagtggttccgcctataatcccagcatgttgagaggccaagtcaagaggatcacttaagtccaggagttcaagaccagcctaggcgatataggcaagcctcctcatctctactaaaaagtaaaaaaaaaaaaaaaaaattcgccaggtgtggtggttcatgcctttaatcccaacgctttgaaaggccagttcaggaggattgcttgaggtcaggagtttcagaccagcctgggcaacacagtgagaccccatctctacaaaaaaattttgtaattagctgggcatggtggcatatgcctgtagtctcacctacttgggaggctgaggcaagaggatcacttgagcccaggagttcaaggttgtagtgagccatgatcgcaccattgcaactccagcctgggtggcagagcaagaccctgtctctaaaaaaaaaaaaaaagtgtattgaggatacatctgaaattgataaaatcatttctgtatcggaaagaaagccactgcaagaaggtctagaaaacgcactaaattgtagttgtggtcttaggcgacgcgcacttcagtcttcctgcccctcccctccctgatttccagaccctcaggggtgttgtcttatgtggccggggcaccccaccacatggctcaggagcaggacagctgcctggggtgccatctagccatcagctgtgctgctttgggcaggcccctgaaggggcgaagggctgagcgtcatcatggacactttgctcatggatggccgattggggtggcccatgggctcctctggctggccctgtcctggagctgccttgtggagcgtgcaattcagtgtctagtggaaaggacgggatgatctgggtggggcacagaccaagggcgtggaactttgtcagcagcaagagatgcaggccctgctggccatcttgtctttgtcctgtctggccagagactgggatgccccagagactcaggtcaagccaggggtcatttgttttcagcttagtgacctttgacatgcagtcagtggaggcagcaagggcctggcctgggggaagctctgaccggttgtgcaggctttggccctgcagttccctgacctgtccgctgtttgccaagaatgtgactgtggtgatgcctgggtgctctgtgtcctgcagggctttgccctggacacgcaggtgcacgctgagctctgctcaccacctggagggcacgcccaggtccagcagcccacagttgccaggtgcgaggggctcagcccttgcacctgccacacagtcatcccctctgctatccctctatgtccctccagcagcaaagtgtacagttttcatgcatgtccccatcctggcgtgcttcctgccgaccggtgccatgggcgcagactcaggaggtatgtgtttgctctcgtaggtttaaacggaacctgcagcgtttccagtgttcccacgtccacgtcggagacgcctgactacttgctgtgagtgtttgtctgggccctgcaggccaggcctcccttttctgggttcagaccccctcccccagcactgcaggttatcagaggtagaagccactgcaagtctgagtatgtgaattccaaacatagcagcctcttctgggccaggccccctcataatccagggaatcacccgagaggccaggccgccggtggagccaggatggccacttcctgggtggggctgggtccttccagcctccactcagtggcccctctctcctgtttcaggaagtacgcagccatctcctcttcggagcagcgccagagctacaagaacgacttcaatgccgagtacagcgagtaccgcgacctgcacgcccgcattgagcgcatcacgcggcggttcacccagctcgacgcccagctccggcagctctcccagggctccgaggagtatgaggtagagcccccccgctgcctactgtgccctggctctggcgggagccagggcccacttgggcgcgcaccatcgccaccacgagcttggtggccccagagtctggcccttccccaggcagcgcttctccccctggtgcactccatgcagcaaccccatggttctggcccggccctggggtcctgttgtgggagtccttgaaggcagcccagcttgtcagcctcctttgcagtggggacagctgtgacccacctccttggatgggggcgagccggggtacatggatccccacatgtttgagcgcctggggtcctctcacagcctaggacacagggctcttggtacctgtgccaaaccctcaggagactccgcagctgagctctgtccagcaccctggggcccatccatgctgccacaactatagcagggggaggtgacaggtccctgtggtcctgggaatcaggactcctgtggtcccctggcttgagctcacagctcattcagctgccctgtgtatacagagagtctccacccttagcctagccttggacgtagccgccccacctgccacctttcggaactggtgacctgactacagggctgggccctgattaatcagatgccggggtctctcctggccaaggcccctttgccttccaaagacgacgactcatgatggggttctaggggctgcgagccacgggttcttggggcatctctccttccccttccctccctctttgctgcacccccccaccccctccccacccccccacgacatggatacttccttgtcctgccacgcccccacaacagcagtgccccacctgctattgcctccaggggacccggcagcctttccctcatgccccacccactccggagctacagccgctgtgggcccctggggtgttacttggccttgtccttgaggctgccccaccctcccatgcccccttctcagagcacctgggaccactcaatttgggtttcctgtaggcggggacacattctgttttctcaaaattttgtttttcttctagactactcgagggcagattttgcaggaatatcgaaaaatcaaaaaggtgagtgtctcttgtgttggggtgggctccaagtgagccatgggagctggagggaggagggtgggcccggggcagcctccctgcccgctacttccaaggtgtgggggaagagcctttgagtctgaggccaaagttgccccaccacccccagctaagtcttcagctgtggcatcctggcccagccacacaagctgtggaggtgcgggggaccaactcccactctgcccttggaccacaaccctccttgctgggcaccaagcccaggtttttggtttgggggggacactggcctgcttacagcggggagcagcacccagggcggctctgtcctgagcatgactgtgctgtcccacagaccaacaccaactacagccaggagaagcaccgctgcgagtacctgcacagcaagctggcccacatcaagaggctcatcgccgagtacgaccagcggcagctgcaggcttggccctagccgccctccccgatggcggggatctgggagggtcgggggagcaaaaggcggtgagagaggatttatttaaaaaaataaacccgaggaagatgctcatctgagccagcaccgccggctttcagggcagcccctgcagacgtctggccctggcgggtggctgcaagcccacctcggccctccctgcgcttcctgagcagtccctgcttatgatgggctccccaggaagcccactgcctcctccctggctgcagcctccggggttcagcctcctgtctcgccagaagactcctaggcccttggggtggcgcgcctgccttttctagttttatacaaagacagccacttttagctactgctaatgagacttgagtctatttttgtacaaaagagaagcaaaatcttttttctaaacctgtgcctccctctcctcggacacccagggtctagccgctgccctgggtcctgcctgcagtattacagaggtcgtcgaaaggtgcagctgcgttctgagggcgtggggaatgggcaggtggcctctgctggtctctggctctacgtttaggcacccctttccccagcctctcctccttgggcagggtctctgctccagcaagcaaacagggtggcccaggtggctattttgagaactccagctggtgcccccagacagctgctcagagccaagggggcagagggctttcagcgcccccaggcctgccctgctatttcaggccctcagctgtcgggggccactgtgtttctgtgctccaagttgagactcggccgcagcggcgtcagacttttctttgcgatgtcctcggtttcccatttgttgctgctgctgctcattccacactgttgagaccttgtggtctcgatgctgctggcctccctccgtccctctgtccacttgtgggtcctggggtcgtcttagcagagccaccgccaaggtttgcactcagggaggggctgatggagggctgggcgccatggggtcagggaggccccagggacccatgggcagagctggggagccaggaggatgggtctgcctgctctgggggtgcaggctctgcagacaccccaattgctgctctgttgctgtgcctagtctagtgtcccccaaagcatcggggggccacgcaagtgtgggtgtgtgagtgtgcgtatgtggggaccccccagggcatggtggggtctgaggcgtgtgttcccatttagggctgaatgaagccatgacttggaaaggtggtggggggtggatggcggctgtgactcagggcccagggatcacatgggggtcactgctgccatcagcagtcaggcagggagaacagaaatgcaaaaatacagatgtctatttttctaaactggggggtggaggggtgcctcctgacagcttccaaagagctgactgtggagggcccacagtgtatcccacccctgcccgagagtctctctcctttgggacccccgggttcccagagctccgaggaaactgatccttcatgtttcaatagctgttgttgtttttctctttgggccgggccgggccggggaagggccgagcaggctccaggaggcctccagagtcagctggaccttgctgtgtcgcccgcaggcagccctgcagacaccggtgaggtgggatgatttcaggaggtcccagcccgggactgcccgcccctctgccctgggaaccagtccaaggggctgtcagttgaatttgcctttttgttgttgttgttgtttttgttgtttatttgttctccttttaaggaattatgaagctaagaaaagttttgtgttttgggggttggtggacaaagttctagctgattaaatatggtctaacttattgatactatttttttttcttttaatgttgtactgtggagaaaaactattttgagccatggggttggtgtttacaagaactttccacttttgccaaaatgttacaattgaaaggcatctatctgcgtcttcagtttcctgatattttcttaaaagatctagtgtcctttttgtacactaaacaggtgaatgctgacttttttcattctccaataaatttcactgaactgaa

SEQ ID NO: 24 - DNA, 95023 bp, Homo sapiens
ggagtgaggacggtgacagccacgcgcgcgcgtacgcgcccgatgcagcgcggccccgtgaccctagtcggccgctgagaggcgcgcggagtctgggccgctgccgtctaggggtcccgtcccgaggcgtccccggcatctccggcccgaatcccggagtgccgggtcgcgcctgcaccgaaggtcccggctcctgtgccctccctgcagccgtcagggcccgtcccccaactcccctttccgctcaggcagggtcctcgcggcccatgctggccgctggggacccgcgcagcccagaccgttcccgggccgggcagccggccaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgaggtaaccggccggcagccccgactgctgcggtgacagtcgaggtggaagctcgagaggttctctttatatcatcttatgggtgtagctagagacgggcagaaccggaagggccaactaggcccaaaacctcatgttaaagatgattgctgctttttttcataggacttttgggttttggcatttcctgaaggttattttcattcattgttattggaagaagctggatgctcctgtgatagaaaattcaggatttcagtgtcaggcttaagttaggcttacgcttaaaagcttgaaagtttattctttcattaggtaatattgttatgtacccaggtattagaagttgcgtcttgtttattggaaagccaatacttgtttcccttttctaaagcttgcatattctgggaaaaaaaaccctttgaagaacgatataacatctcatacttactttccacatagtttccaacatgatgataacagctatcaattgttcagtattttcaaagtgctagacatttgcacatttaatcctcagaacaaacccatttatctagtaaatggcaaggtggggttttgaaccaagctcacagcccgtacagtactgcttctcaagtaatttaagttcttgctgctaaaagtgtggtttgtggaccagcagcattggcagcagtaagcaagggttggcatgctttttctgtacaggaccacatagtaaatattttcaactttgtagactagagaatctctgttggagttattcaactcttcaactctaccattgtaacacaaaagcagccttagataagatcagcttccagcatgacagcttaaggaacccattcctctgtaaaactggtgaaaattcttttttgttttgtttcgttttgagacagaatctcactctgtcaccgaggctggcatgcagtagtgtgatcatggcttactgcaaccctgaccaacctccctggctcaatcagtcctcctgcctcagcctctcgagtagctgggaccacaggcgtgtgccaccacacctggctaattttttttttttttttttttttgagacggagtctcgctctgtcacccagagtgcaccgggctagagtgcaatggcgcgatcttgtctcactgccacctccacttccaggttcaagtgattctcctgcttcagccttccaggtagctgggattacaggcgtgcgccacctcgtctggctaatttttctatttttagtagagacagggtttcaccatattgggcaggctgatctcgaactcctgacctcgtgaccagccgacctgggcctcccaaagtggtgggaaagtggtgcgattacagatgtgagccaccccgcccagcctcacctagctaatttttgtaaagacagggttttgccatgttgcccaggctgatcttgaactcctgagctcaagcaatccactcgccttggcctcccaaagtgatgggattacagatgcagccaccacgcctggcccaaaaattctttttttaaaatcaactatttaaaccctccggcaatggtcctgagggcaaacaacaaatgaaaaaacacctattcaagaaaatctacaaattcggtaagaaagatgagagggtatggtatttgaaccaagatcattccctccttactcactcctagcttagtgaggtggagcttctactccagactattgcaaactgtaataccgggcactgctcccccagctcccaatcaaatgctttcttcccaggaaaagcaggacatcagcatttctcatcctacctagagctacttgttgctgaggttaaaacctgtgtgagtgcaattgaaagttggagctctctttttttttcttttgagacggagttttgctcttgttgctcaaactggagtgcaatggtgtgatctcgcctcaccgcagcctctgcttcccgggttcaagcgattctcccacatcagcctcccaagtagctgggattgcaggcttgcgccaccatgtctggctaattttgtatttttagtagaggcagggtttctccatgttggtcaggctggtcttgaactccctacctcaggtgatccacctgcctcggcctcccaaagtgttgggattataggcgtgagccactgtgccctgcgaaaagttggagctcccttcttccacctagtccctacttgtggaacaggactgtaccttggacatgacatactgaaattactggtgccccaattgctcatcccccagttcttgcaggctgagcctcaggttattgcggtcccctgcctccttccaccaagtgctcagttcctagagtgagggtatttctcagagagaatctttccagggtccttccccacagctccagagccttggctccgggattttgcctcaggagagaagcaggccctaaaacagatagctcctaatctctttccaatggcagtgacttcatttgcaacacagtgtggagaaattcatgcctaagggcaatctggagatgtgaaggttttggtaagaggcaactgggagatctgcggatttaatggagatgcagcctagactgtaggcctcctggtttgctggaaagaattggggaataagacagctggaagaagccattctaggatcagaagaaggatcaaacattgaccgcagcatggtggctcacgcctgtaatcccagcactttgggaggctgaggcaggcagatcatctgaggtcgggagtttgagaccagcttgaccaatatggtgaaccccatctctactaaaaatacaaaaattagctgggcatgggggcatacacttgtaatcccagctacttgggaggctgaagcaggaaaatcacgtgaactgggaggtggaagttgcagtgagccaagatcacgccactgcactccagcctgggtgacagtgaagctctgtcctgtcacaaaacaaaacattgaccacagacctctgaggtggtggatgtccctcctgtcctggttgtatcattatacattgtatattaatgtatcgaaatactacaggtacccccaacatgtgtacaactattatgaatcaataaaaaacaatttgaaaagtaaggtatgtggcagaggtggaaaaaaatgctttcctccaaacagccacaatttgattgtatcagtttgtagagtaagagcaagttatgcctcagtgtgttgttgaaaataatagaacaatatgccacaattagtggagcttcatagctgggtgtggtcaaggagagaatagaagagaaccctaccaaaaccactgtcatcccagggtgactgtgagcatacccaaagctgcacctccctgaagagcaatatcataggccttaacacttttcaggggaaatggatttcactcaaataatccagccagtcgctaaacaaataaataacaattggccctggagagggggtaccaatccccagagttgctacagtatattatctaaaatgtccagtttccaacaagaaattgtgagacgtacaaagaaacaggaaaatatgacacatacactggaaaaaagctggcagcagcaactgcctgtgagacaaggggccaaattaatgaaaaaggcttcaaactggcctatatatatattcacagtactatatatattcacaatactaaaggaaaatatgatgacaaagaagtaaaggatggtatgacactgttgcatcaattaaagaatatccataaagatatagaaattataaaaaaagaatcaaatgaaaattctggagttgaaagtacaataacagctgggcgcggtggctcacacctgtaatcccagcactttgggaggctgaggcgggcggatcacctgaggtcgggagttcgagaccagcctgaccaacatggtaaaaccccgtctctgctaaaaatacaaaaattagccaggcgtggtggccggcacctgtagtcccagctacgcgggaggctgaggcaggagaattccttgaacctgggaggcggaggttgcagtgagccaagatcgagccactgcacaccagcctgggcaacagagcaagactctgtctcaaaaaaaaaaaaaaaaaaaaaaaaagtacaataacaaatttaaaaattaactagagggactcaggactcaataacagatttgaactgggtgaagaaagaattcgttaattttttttttctttttgagacagagtctcgctctgttgcctaggctggagtgcagtggggcaatctcggctcactgcaacctctgcctccctggttcaagcgattctcctgcctcagccaccgcacagtggctttgggagtactctgggaggctgaggtgggtggatcacctgaggtcaggagttcaagaccagcctggccaacatggtgaaaccccatctctacaaaaatacaaaaatttagttgggcatgatggcgggtgcctgtaaccccagctacttgggaggttgaggcgggagaattgcttgaacccgggaggcggaggttgtagtgagcagagatcgtgccactgccctccaacctgggtgacagagcgagactccatccctgccctgaaaaaaaaaaaaaagatgtgaaacacatacaaaaaaaagtaaaatggcagttgaatgccaagtaattagataacttcaataaaatggacaaactcctagaaagatataaaccaccaaaattgacccaagaagagacactatctgaatagacctataacaagtaaagatattaaattagtaattgaggggactcgtggggtaacttgcccttgggaaccagtagtatggcatcgggctgcaagattggcctgtccatcctcaatgctacctggccaatttaggggcccagtgcctctggatgctagactctggggtcgattatctccaccggaatgtaatggatgaacatgcatgtgatggtgtccaagccagaacagtgggtaaagccaatggctataagaggagccaatcagtacatctttcatctcgaggaaactgagaacccaggggctttgattaaagacattcaggagaatgggatgaaggttggccttgccataaaaccaggaacctcagttcagtatttggcaccatgggctaatcaactaggtatgaccttggttatgacagtggaaccagggtttggagggcataaattcatggaagatatgatgttaaaggttcactggttgaggatccagttcccatctttggctatagaggtcgctggtggaatagatcctgacactgtccataggtgtgcagaggcgaagctaacatgattgtgtctggcagtgctatggtgaggagtgaagaccctagatctgtgatcagcctgttaagaaacatttgctcagaagctgctcagaaagattctcttgattgatgaaaccttaaggagcccaatgtttgtttatgaaatctcctttttactggaaaacaggaatattgactaccaaatcatagtgtagttgaagccattctgcgtttttgagcagttattcgtttcagtgattataattgattgtgcagagtattctaagaagttagaaattggtgtgtataactacattttcagtgatgcaatttaatgattagtgagtgagatactgtttttattgagagccttgatttttataaagagtaaaaatatggctgcattaagggtacaaacagaaaagtgtcttaatgtctaaggagggcatattagctacactataaaaacaatttttttctgtatttctgaaaagaattttgttgtttctcagttgttttccaaaagcaaaggaagtcttaatgtttttttctatttcgtgttatgtgtgatttgtttatatgcttggtaatatgagtctaatggaatttaaaaatataagtttgggtaggatagtatacccttaaaaaataaataaataattagagagagagagagagagagagacctgggcacagtggctgttgcctgtaatctcagcactttgggaggtcaaggcaggaggatcctttgaggccaggagcttgagaccaacctgggcaacatagagagaccccaactctaaaatatacatactatatctaaactcagctaggcgtggtggtgtgagcctggagtcccagctactcaggaggttaaggtgtgaggatcacttgatcccaggaggttgaggaggcagtgagctatgattgtgccacagtgcttcagccagggtgacagagtgagaccctgtctcttaaaaaaaagaaaagaggctgggtgcagtggctcatgcctgtaatcccagcactttgggaagccaaggtgggcagatcacgaggtcaggagttcaagaccagcctgtctaatatggtgaaaccccatctctactaaaaatacaaaaattagccgagcatggtggagtgcgcctgtagtcccagctactcgagaggctgaggcaggagaatcgcttgaacccgggaagttggaggttgcagtgagctgagattgcgccactgcactccagcctgggtgacaaagtgagactccatctcaaaaaaaaaaaaaaagaagaaagaaaagcaaagcaaagcccaggcctgtacctactagaggtcctgataacttcaccactgaattctatcaaacatttcaagaaaaattaatacagttcttcacaaagtcttcaaaaatgaaaaagaggagaaaatacttacaaacgaattttatgagactggtattaccctgttgccaaaaaccaggaaaagacattacaagaaaagaaaaccatagacaaatatatcttacaaatgtggaagcaaaaatcctcaacaaaaatactagcaaactgaatccagtaacatataaaaataattatataccataaacaagcaggatttattccaggagtgcaaggttggtttaacatccaaaaatgaattagtgtaaataatgtaatgcattatatcaatagaataaaaaacaaaaatcaccttgtcatctcagtagacacagaaaaagcatttgacaaaattcagcatgtttttcatgataaaaacactaaataaactaagaagagaagagcagttcctcaacctgatacacagcagttatgaaaaacccacagctaacttcataatagtgagactgaggccaggcacagtggctcacgcctgtaatcctaacactttaggaggccaaggttggagggatcacttgaggtcaggagttcaagaacagcctggccaacatggtgaaaccctgtctctactacaaatacaaaaaaaaattagccaggtgtggtggtgcatacctataattgtagctacttgggaggctgaggtgggaggattgcttgaacctgggaggcagaggttgcagtgagctgagatagcactactgcacacaataggctgggcgacagagctcaaaacaaacaaacaaacaaacaaaatagtgaaagactgtatgcttatccttaagattaggaaaaagagagataagtctactttcactactgctattcagcattgtactggaggttctagccagggcaattaggcaagaaaatgcaataaaatacatctatgttggaagggaacaagtaagatcatctctgcagatgacatgatcttgcatatagaccctgaggaatccactaccaaagtattggaactaataaattattagtttagtaaggttataggatacaagatcattacacaaaacttagttgtaaatgtatccacttggaatgaacaatctgaaaaggaaattaagaaaattccatttacaataacctaaaaaataaaaatacttataacaaaagaggtatctttttttccatcctctgacagtttagtaaaagaaagtataaaacttatactctaaaagctgtaaaacatttttggttttgttttttaaattaattttttttgaaacggagtctcactctgtcgtccaggctggaatgcggtggcgcgatctcggctcactgcaacctctgcctcccaggttaaagcgattctcctgcctcagcctccggagtagctggagctacaggtgtgcaccaccatgcctggctaatttttgtatttttagtatagagggggtttcaccatgttggccaggctggtctcgaactcctgacctcaggtgatccacccgcctcagcctctgaaagtcctgggattacaggcgtgagctagtgcgcccagcctggccttttaaaatatttaattaattgatttttttttttctcggacttgcactgaagtgagaacaagtgcagtggtgcaatcatatctcagtgcagcctagaccttccaggcttaagtgatcctcctatatcagcctcccaagcagctcagaccacaggcatgcgcgatcatccctagctttttttttttgtttgtttgttttttaatttcttgtagagacagagtctccctgtgttacccaggctggtcttgaacctgacctcaagcaacctcccatgttggcccctcaaagtgctgggattacaggtgtgagccaccgtgcctggcctgtaaaacatttttaaaagaaagaagatataaataaataaataaatagaaaatagctcttgttcatggatcataagacataacgttgtcaaattggcagtattttggaaattgatctacacgtttgacataatccctgtcagaatcccagtttatttcattgtagaaattgacaagtctccaggcgtagtggctcatgcctgtaatcccagcactttgggaggccgaggcaggcggatcacctgaggtcaggagttcaagaccagcctggccaacatggagaaaccctgtctctactaaaactacaaaattagccgggtgtggtggcacatacctgtaatcccaggtactcgggaggctgaggcagggaatcgcttgaacctgggaggcggagcttgcggtgagctgagatcacgcgccactgcactccagcttgggcaacaagagcgaaactccatctcaaaaaaaaaaaagaaattgacaagtcaattcataaattcctatggaatcgcaagggacccacaatagctaaatcttgaaaaagaacaaagcagaaagactcacgctttgtgatttcaagacatactataaaacaactaatcaagacaacgtcaccaggcaccgtggcttatgcctataatcccaacactttgggaggccaaggcaggcagatcacttgaggacaggagttcgagaccagcctgggcaacatggcgaaatcttgtctctaccaaaaatacaaaaattaaccgggcgtgggggtgcacacttgtagtccaagctgcttgggagggctgaggcacaagaatcccttgaacccaggaggtggaggttgcagtgagtcgagatcgtgctattgcactccagcctgggggacagagcgagattccatttcaaaaaaataaaaataaaaagacagtgtggtactggtataaggataaatgtgtagatcagtggcatagaattgagagtccagaaataaacccagtggaatagagttgagagttcatggtcacctgattcttgacaagggtgcaaagaccattcagtgggggagaactgtcttgtcttgtcttttcttgctacatgccacagactgtgagaaggaatagtcctttcttttcttttttctttttttttttgagatggagtctcgctctgtcatctaggctggagtgcagtggtgcaatcttggctcactgcaacctccgcctcctgggttcaagtgattttcctgcctcagcctcctgagtacctggactacaggcgcctgtcacaacgcccggctaatttttgtatttttagtagagatagggttccactatgttggccaggctagtctcgaactcctgacctcgtgatccacctgcctcagcctcccaaagtgctgggattacaggtgtgagccaccgcacccggccggaatagtcctttcaacaaatggagctgagacaactggatagccacatgcaaaaaaaagaagaaattaaacccttacctcacactacatacaaaaattaactcatggctgggcacggtggctcacacctgtaatcccagcactttgggaggccaaggcaggtggatcatgaggtcaggagttcaagacgaggctggccaacatggtgaaaccccatctctactaaaaatacaaaaagtaggccgggtgcggtggctcaacacctgtaatcccagcacttcgggaggccgaggtgggtggctcacgaggtcaggagatcaagaccatcctggctaacatggtgaaaccctgtctgtactaaaaatacaaaaacaaaattagctgggcgtggtggcgggcgcctgtagtcccagctacttaggaggctgaggcaggagaatggcgtgaatccaggaggtggagcttgcagtaagccgagatcgcactactgcactccggcctgggcgacagagggagactccatctaaaaaaaaaaaaaaaaattagctgggcatggtggcgggcacctgtaatcacagctacttgggaggctgaggcaggagaatcgcttgaacccaggggtgagctgagatcacgccattgcactctagcctgggtgacagggtgagtctccatcccccacccaaaaaaaagcttaaaatggatcaaagggccagttgaggtggctcaccccagtaatctgagcactttaggatgttgaggtggatggatcacttgaggccaggagtttgagaccagtctggccaacatggtgaaaccctgtctatattaaaaatacagaaattaggctgggtgtggtggctcatgcctgtaatcctagcactttgggaggctgaggcaggtggactgcttgaggacaggagttcaagactaccttggccaacatagcaaaaccccatctctactaaaaatacaaaaattagccagccgtggtggcatgctcttgtagtgccatctactctggaggctgagacatgagaatcacttgaactcgggaggtggaggttgcagtgagctcagattgtgctactgcactccaacctgggcaacaaagcaagactctgtctggaaaaaacaaaaacaaaaacaaaaaacaaatgtggagaaatgtgaacccttttacactgctggtaagaccgtaaaatggtgcagccagtttgaaaagcaaactagttagccaggcatggtgggtcatacatgtaattcctgcactttgggagaccaaggtgggaggatcacttgaagccagaattttgagaccagcctgggcaacagagtgagaccttttctctacaaaaaatttaaaaattagccaggcgtggtggcttgcacctgtagtcttagttacttgggaggttgaggtgggaggatcacttgagcctgggagaggctatagtgaggcatgactgcaccactgcacctccagcctggtaatcaaagcgagaccctgtctcaaaaaaaggaagacaattagctgggtgtggtagcgttcctctgtagtcacagctacttgagaggccaaggtggtaggattccttgagcccagaattttgaggttgcagttagctgtgattgtggtgctatactccaggctgggcgacagagtgagacccagtctcaaaaaagataaaaagaaaaacatggtggcagttcctcaaacagttaaacacagagttaccatataaccccacaattcaacttacagatgtcttctcaagagaaatgaaaacatagctttacgagaaaaacttatatgtgaatgtttatagtagtattattcataatagccagaaggtagaaacagttcaaatatacatcagctgatgaatggataaacaaaatgtggtctatccttactatggaattacttggcaataaaatagaatgaagtaccagcacgtgcttcaacatggatggaccttgaaaacactatgctatgtgaaagaaaccagccgcaaaagaacacatatgattccattcatatgcaaatctaggataggcatatctacagagacaaagtagatcagtggttgttcagggctgggaaaaatgggtggggtagagggtgtgatagctgaaatatacaaggttttatttatgaagtgatgaaaatactctaaaactgactggtgatggttgtacacactgaatgtactaaaaactactgaattatacactttaaatgggtgaattttagggtatatgaattatatatcaagatgtttaaaaaaaaccttaggcaaaatgtaaacaatgggcatgactgtgttccaagaaaactttatggacacagaaatttgaatttcacataattttcacaagaaaataaacattaaaaaatgtaacatgctgggcactgtggctcacgcatgtaatcccagcacttcgggaggccgaggtggacggatgacgaggtcaggagtttcataccagcctggccaatatgtaaaaccctgcctctactgaaaatagaaaaattagctgggcgtgatggcacacgcctgtaatcccagctactcgggaggctgaggcaggagaatcacttgaacctggaaggcggaggttgtggtgagctgagatcacgccgttgcactccagcctgggcaacaagagtgaaactccgtctcaagaaaaaaaaaaaaaaaaagtaaaaatcattcttagttctcaggccacacaaaaataggtggtgggttggatttgtcctgtgggccatagtttgctgatctctgatctaagttactatttgatagatgttagatgttgtgagagggtaagagagactagcctataaggaaagggattttagttttttgggggtttttttttttgagacggagtctcgctctgtcgcccaggttggaaagcaatggtgtgatctcagctcactgcaacctctgtcacccaggctcaagcgattcttctgcctcagcctcccaagtagctgggattacaggcatgtgccaccatgcccggctaatttttgtatttttagtagagatgggctttcaccatgttggccaggctgatcttgaactcctgacttcaggtgatccgccctccttggtctcccaaagtgctgggattacaggtgtgaaccactgtgtccatccaggaaagggattttgtatgacatttttcagccgcaattttgccaggaaaagctcttttttcttcattaagtagattccagacccaaagatgttggacagtattatcagctagagcaaggtttttcaaccctggcactattgacattttggctggatgattctttgttgtggggagctgtcttgtatgttctaggatgtttagcaggatctctggcctctacctactagatgccagtagcattcccccaccccatcccagttgttgtgacaaccaaaaatgtcttcagacattgtcaagtgtccctggggtagggaggacaccctccaatctcctctttctccctacccaacctccatgaccacattgagaaccactgatctatagaaaaggataatagtagtgacattcagagaggcaggatggtatagtgcaaagcttgccaaactttaattttacataaatgacctggggaatcttggaaaaatgtaggttctgattcagtagttctgggatggaagtgagaattttgtattaataacaaactctcaggtgatgatacctgtgccaccggcccaaggaccacactttgaatagcagagcagtagtagaaagtgcatcggctttgaaagaagacagacctgggcttgaattctagctaaaatacttctactttggacaagttacatagctctctggaccttattttctcattggtaaaatgagactaataatgctgaccctgcagagttcttataaggattcatggaatgcatagtccctggcagaaaggaagatataggagggactataattggcctaaagtaggaggctctggttaccatgggcactgccctgttgtgatttatcaagccattacacctcactgaacctcagatttccagtggaaaaacctgtttgtaaaccatgttcacatattctgttgaaagtaatcatagtttgatttatgatgatagggctcaggtaagtgattagttttattctcctgcctgctttttatgttgtccattaatgagcaaggtgctgatgcaaggagatggcagatgcattttgaaaaaaaaggagagagagagtacttgtagaattcttgactttattgaggtcaaatgtaggtggcttttcaagaaggactcaatttcagaaccggtggcatttaacatatgagtcatgttaccttatgctaataagttcagactttttttctttttactgcagagatagggggaaaaatctcctgcactacttgctgcattgctcaattggctggatgctttggaagatttttccacttgaaagatttgttgtttgtcattttgagaaagtgggtgctgagtgtaatttgccaggaggctaaacggctatgttatttcttatctaggctggaattttactctaataattcaatctatcagtaagaaaagccaaataggaagttgtaagagatcctaatactatcttatattgaaaacaaagcctccttctcctgttgtttggcattctaaatgttttcacatacctaagtgagattatgattgtattaaataccaacattgcagatcattccagcatacaagtggacgtaagttgtccataacagaaggaactttctaaaggggaagacagatagaacaattctggcattttcagtaaaatcttaaatcctaggctccctaggaccaggcaaaccatccccttcaaggatgtaaactctggagggcagtgtagttgtacagggtaatagttctatactctatattagtgcaacaagaaacttctattcctgtttcagaagtaagactgttatctacctttttttttttgagatggagtttcactcttgttgcccagactggagtgcatgatctcagctcaccaaaacctctgcctcctgggttcaagtgattctccagcctcagcctcccgaatagctgggaatacaggcatgtgccaacacgccctgctaatttttagatttttagtaaagacagggtttctccatgttggtcatgctggtctcgaactcctgacctcaggtgatccacctgccttggcctcccaaagtgctgggattacaggcacgagccactacgcctggcctgttatctacctttttaccgctgtgctctcccatgggttttttttgtttgtttgtttgtttgtttgttttgagatggagtctcgctctgttgcccaggctggagtgcagtggcgtgatctcagctcacttcaacctctgtctcctgggttcaagcaattctcctgcctcaacctcctgagtagctggaattacaggtgcctgccatcatgccaggctaatttttgtatttttagtagagatggggtcttaccatgttggtcaggctggtcttgaactcctgacctcatgatctgcctggctcggcctcccaaagtgctgggattacaggcatgagccaccgtgcccgacctctcccatgggttttaagtagtgcctatggatggcatgggtgccactactcaggtctaggacaggcaggggtgagtgatgagtgcgtgcgtgctgatgaaggggtgcgaagaaacagatgctggctagtgctgccctccactggaccccattctgcctttgtgtgggacaaagggctagggactagcagttactttgtgctaggtaccatgctaaatgctttaaatgcacactacctcatttgatataacagggactcatttattcattcaagagatattataaaataggctaggcacagtggctgacacctgtaatcccagtgggaggccggggtggccagatcacttgaggccaggagttcgagaccagtttgggcacatggtgaaatcctgtctctactgaaaacacaaaaattagccaggcgtggtagtgggcgcctgtagtcccagctactccggaggttgaggcaggagaattgcttgaacctgggaggtgagggttgcagtgagctgagatcgcgtcactgcactccagcctgggcgacaagagcgagactctgtctcaaaaaaaagacaataattaggcgtggttgtgcgcacctgtagtcctaactacttggtaggctgagacaagaggatcacttgagcccaggagttcgaggctgcagtgagctatgttcgtaccactgcatgaagcctgggtgacagagtgagactctgtctcttttatttatttgttttttaaataatagagacagggttggccgggcatggtggctcattcctgtaatcccagcactttgggaggctgaggcaggtggatccctgaggtcaggagttcaagaccagcctggccaacatgggaaaaactcgtctctactaaaaatagaaaaattagccgggggcaatggcatgtgcctgtaattccagctacttgggaggctgaggcaggataattgcctgaggtggaggttgcctgagattgagccactgcactccagcctggatgacagggagagactccgactccaaaaaaaaaaatagagatgggggtctccctacgttggttgctcaggctggtctcaaactcctgtgctcaagggatcctcctgcctcagcctcccaaagtgctaggattataggtgtgaaccaccacacgcagctctgatttactgggtgcccacgttgaccaggcagggaacacctcctagcagtgatcaaggactactttggacctaggttctgtaactgacttcatctttaagtggggaaacagaggctcagacaggatacatagcatgcttaaaggcttagtgcagccactatctattctgaaagaggcagaataggacagggacaggtaggtagtgagagaatagggagaatagatgggcacaccctttaacttaatatcgaccagtaaagcctgcagttgcttatttgaacctcacattgaggctgacatgtaagttgagcaaatcttaactcaagcttcagtttccttgttggggccgctgaggcagcatagcctagagattacaagcatagacttcagagtttgattcctggctctgcctctaaccagctttgcaaccttaaagctccttaaccccctcacatgcctctgttccctaactgtaaaatggtgaatgtaattaattcttcctgcatagtgttacaagaattaaatttgagtaattactggtaaagtacgtagaatagtacctaacacaagataagtgctatatataatggttgttacctaaagaaataacagcctgggcaacatggcgaaaccctatctctacaaaaaatacaaaaattagccggttgtggtggtgtgcacctgtggtcctagcatctcgggaggctgaggtgggaggatcacatgagcctgggaggtcgaggttgccataagcttcctgattgcaccactgcactccagcctgggtgacagagtgagaccttgtctcaaaaaataaataaataaaataaattaaaaaaataaaaaggaaataagttcagtgcctgtcgttagcttgctccctttctcagcctctcctccacttcctcacgcaccctcttgctctgagcctattatcctggtccctccttcacactgccacatctttgcataggctgttctctttgcctggaatgccattctcatttgttgcttggcagaactgaactcattctccttctaggctctgctcaagggtttcctcttctttgtgtccaaagtcaccacatagcttctaagtgatgggactgagatttgaagccaggtcatctgtctttcaggccagccctctttccactaccctatgctacccaaataggaagcgtaaaagagaagtaggagagaaaaagttagaaacctggagagaacttaggtatttggtaaacaggaaaaagaaagtggaaagaagagatcatttgaaggacttcctcaacttaacaactatttgcctatggcattattttattgcatttggtgtatgatactatctcaaaagcattttgtaaacttgccagtggcttacatttttgccggatgaatgacatgactaacgatccgtgctacattacctcagtgtctagtttgtcattttgaatcaagtggacattttctgtaagtgaatcattttcacttgctcatgatataatgagaattccttacctttggcttaaaatgaggcttatgttataacagttaagcattgtctagttgcatatttaacatagtcagaatgctcctgcctgtattcagcctggtgtcttataatatttggtatgcccacctagatagcaattggtaacatctttattctgagactctttcatgtatggattttgaaaagttagttaactgttcagacgacattgtttctttgacttttacaatccgcttccctctcactgacagttcagttttggaagaccctgtatttttttttttttttttttttttttttgagacagagactcgctctgtcgcccaggctggagtgcagtggcgtgatctctgctcactgcaacctccacctcccgggttcaagcaattctcttgcctcagcctcctgagtagctgggattatgggtgtgcaccaccacacatggctaatttttgtatttttagtagagacgaagtttcaccatgttggccaggacggtctcgatctcctgaccttgtgatcagcctgcctcggcctcccaaagtgctgggattacaggcgtgaaccaccgtgcccggccttttttttttttttttttttttcgagatggggtctcactcagactggagtgcagtggtgctatcacagctcactacagacttgacctgctgggctcaagtgattctcctgcctaagcctcccaagtagctgggactacaggcacatgccaccaatacctggctaatttttttgaagaaatgggatcccgctatgttgcctaggctggtctggaacttctgggctcaagcgatccttccgcctcagcctctcaaagtgctgggattacaggcatgagccaacatgcccagctagagatgtgtgtgaattggtagcttcaagctagatattggaggctcatgaagcccaggttaaagaggcttgtattcatcagatgcgatgaagagctttgaagtttttactagaagtgtgatttaaagtggttggcatgcaaaatgatttggaacgtttggggtttggggtagggagagagaggttggaagtaggaaacaattagaaggcaaacgctttgggcaaggtatcacattgaaacctgaacagcagtgggacttgctgggggttgggacaaaactaggcagatgtaagcatctagtgaatctagagattagggtgttctgtgaccaagaatgagcagaagacctgctaggctcaagattcaggagattctcaggtccaaagccagtcctcagtctccgaagtcagtcaggcagaagggaagttggatcaagctggccagagttgagctcaggaagtcagtgcactttctcttgtctggttcctgcatcgttttacttgtgtaaaatcatcaagatccctaaaccgatgtctgaacaccaggcttctaggcagagctccaccgtgtgaccttgggcgcatcacttatttcccccaggcctcagttcttctgaaagatgaggggaagaactcacattcaaaggccctcagctttagcgtcttattttaggtgatctgggcagaagagtctcactgtgctcctctccctttcatatttcctgctttggtaggaagtcatctcaagacttgagtgtataggcatgaggaagtctgctagaggacaggaagaatattgcttaaagaataagagctacagccctgatggaaggggtaaattggcctgggaaaagccctgcctctgctacctgcttcccaagtgaccttgaacttaactctttaaacctcagttgctgcatctataaaatgagaataatagtatcttttttatagggttttttttgttttgtttgtttgtttttagacggaatctccctctgttgcccaggctggagtgcagtggcacgatctcggctcactgcaacctttgcctcccgggttcaagcgattctcgtgcctcagcctcctgagtagctgggattataggagtgcaccaccacgcctagctaatttttgtatttttagtagagatggggttttgccatgttggctaggctggcctggaactcctaacctcaagtgattctcctgccttgacctccctaagtgctaggattacaggtgtgagccaacgtgcctggccagggttgttttgagacatgaatgaggtggacctttacaggcacttggttcagggcctgacccgtagtgagcatttgataaatgttacctatctatgttgtcatgggctgggagtgtgggaacaggaagtgtctcatgccagaagcactgtgaattttctcctttaatcattgccttcattttctttgaaccttattcagattgtccatgcctttgtaattgtagaccctctaaactataattagtccaaataaaatggactcaccttatgccatgttcttgttgaagggtcctctttctttctttctttctttctttctttctttctttctttctttctttctttctttctttctttctttctctttctctcctctttctgtctctctcttctttctctctctctctctctctctttctttctttctttctttctttttctttctttctcttttcttgctctattgccaggctggagtgcagtggtgagatctcggctcactgcaacctccgcctctgcctcccaggtttaagcgattctcctttctcagccttccgagaagctgggactacaggcgtgcgccactaatttttgtatttttaggagagacggggtttcaccatgttggccaggatggtctcgatctcttgacctcgtgatccacgctcctcggcctcccaaagtgttgggattacaggcacgagccattgcacccggccagatcttcttttttgtaacatgctaagtaatacaatctctatttagcttgatgtccacggtgatagcaggattcttttcggatttctgccatagttaattattctgcattcttttgtccctagtgtgtcatattgaaatttttcttttttctttgtttttgatgacttctccagttattcatgctagttttgcattcctgtccaagaacatttttgctgcttgtttatttttaatttcataaactaaagcgtttgaggttttaaaaacccagaattgagttttctcagagctgctaatctttctagccagctggtgacgaggcttctcaattcttgttacaggatgatgtgttctgtcctcctgtctgtgctttgtctaatttagattctaaatccacatgtttaggacatttttagcgtgtcaaaatttattaccaaagtagtgctgacttcagggaaaaatttttaatggaatctttagtcactcatgttgacacaaggtgcttgtcctagtgcaggaatctgtgtggcaccactaggtggtgccagactgcatcatttttaaagacagccttttctcttccaactcttttgccactgttctcttttttgcttctttgccaaatttggaccgagctttgaaaacttcatataaactttctcttagtgagttatgttgcttatagcttttccctccaccttgcctgttttagtcttcttgtttcaatagttttgatagtttgacattcagataaaacttaaaactgaagcccaaagtaattactaaatgtatctcgactgatctgtggttttaaattcaccaacagtgcatctccctacttgcttaatcatattgattttgagattaaatcagtctcataaatatgttagtcttcagcccacggtagttctcatccatctgcagactttttttttttttttttttgagatggagtctaactctgtcaccaggctggagtacagtggcgccatctcagctcatggcaatctctgcctcctgggttcaagcgattctcttgcctcagcctcccgagtagctgggactacaggtgcttgctaccacgcccagctaatttttgtatttttagtagagacagggtttcaccatgttggccaggatggtctcgatctcttgatctcgtgatccacccgcttcggtctcccaaagtgctgggattacatgtgcgagccaccacgcccagccccatctgcagatatttttaccagtcctatccactcatgcctgtaccttctaatgttattaaagtcagttttattatcattgatgaccatgagacttaatcaaaaggtcaagctagaaacagagaatattcaaaatttctttccaggcaaacatctgggttcaatagaagctagttcacatgaatggatcatgctctagctctgttgtgctggagcttttttgaaggaatgcattgttacatactaaccacaatttttacattgtccagggcaggagtaaccagttggttgatacttagtcaggggttgtgtttcgtaatctgctagttgtacttgatgtttaggcatttgaaatttaaccttgtgccttatttgtgctgaatttactattgtttcctatttgtagtgctctgcaaaattattctcagtatatcacacatttgtaatcattgccaatcactgaatatcaataacatgctaggtgataagaacttctatttttcagcagcattatcattcccaattttactacatcagagagttcatcattatacagtcaactcatgattattaggagtaaggaacgtaatagcagaccctgaatgagggaaaagaatgtgaaaccacacataaactaaaggtgaagtcatttacatccctgaaaatgattttaagatacagaatgagatgttaaaggatcaaaagaaaattatcgtagcaatgaaaaatgctacatggtttatacaaagtcatgtcaagctcatagactcagagagtggtgttaatcctgaagaccacttgatgattatggaagccgagacccaaagaggttaagtgacttacccagcacagcgggtttgggtgttttatagctgtttgactatatgagctatgattgctctcatgttgtgagctaaattccaaagatattgtcgtgtttgcttttgtggggactgtattgctttcatagcatgatggttgtattgtttctttttgctttgtcatctgtcagtcaactttgaagtgaatcttctttgtttacagcatagtaaaatatggtgattgcatggctcataagagatttacaaatgaagaaactgaggcccggttgagctgcatggcacacccaagtcatagacttgtgtgtggttgaggcagagaatctaggatacagacctccctgctgggttcctcccgctcccataactgctctgcacttcagcgggaaagatgccagaaactgcaagcataaggcctttttttcccctaaaaaactgtaattcatttggttttgaaagacttaccagagtttaaaagctccattttgtggcttcccaaggtgctgtgatttgtttcttactagtctcctttgttctgtggaaaattttcttctttggttgtttgagatttagatttccttgccaaggtatttttagagagaggaaatcagtatgtttcaccaaaggggtaaaatatataccttaaggcctaattatgcaattacatttttaataacgagtgtcataaattcttgcttcattgcaatcattaattggaagactgttctgctcagaagcctcatctagttatcatgattatcatcaacatcgtcaaccaaccacaagcatcaagcatttatggagtatccacagattatgcagcacttgccagggttctgggagacttaatctgtgtgtgtgtgtgtgtgtgtgtgtgtgtgtgtgtgtgtgtgtgtacacccttgccttcaaggagtttgtgatctgcagaactggaggaaagacagaaaacttggggaaagacaagtacctcatttttcaatatgtgtaaagcccatactgattcatgtatgtggcattgggggacatggacagcagggagacaaagggatagatcttagaaaggtctagttacaaataaatggaagcacataagtttgctgacatgggaggacataggctgggttgtaataaggtagggtaattggttgaaggagggaggaagaaattggtgaagagttgaaggcagtaattaaatagatttggcataataacagagatgattggagaactgggagaagaaaattacttgctgtagttgattatggcagaaactgacagggcaagagattacagttgggattttttgcaaagaggagctttcaagtttgtgacatctttttttttttttttttttttttgagatagtcttgctctgtcaccctagctggagtgcagtggcgtgatcttggtttactgcaacctctgcctcccaagttcaagcgattctcctgcctcagcttcccaagtagctgggactacaggtatgcgccaccacgcccaactagtttttgtatttttagtagagacggggtttcaccatgttggccaggctggtctcgaactcctgacctcaggtgatccacctgtctcggcctcccaaagtgctggagttacaggcatgagccactgcgcctggcctccaagtttgtgagatcttgcccagatttaaatgaaggatgtggggttcaggattggtacagcagaggaaaaaagtctctctctctccccactcccctctttttgctgtgatctattttttttcccacacttttcacaggtgttgtcctgtgatctatttctatttggtggatctcttttcccctcatgttgagaataatggctgaggtgtggtgtatcctttaattttgaaaggaaacggcatgatggttttgcggtttaatcatgagacacaagaacagcttttgttgtgtggtgataccataccctgaattgagattatcagtgtcagacatatattactgcacttttttatcttcttcgcttaatcaaaatagattttaatggaatttattattcacttactgtacagtaaaattacttttataactttccattgtgtttttcttgtaaattgaggtatttggcctctatttttcaaaacagacaaaagttgtattcaggttaggtttggatctggtatattagcatcttaaattctcaagtctcctataaacctgttctcttaggccagctatggctgcagaagtcagttatagataaacattgagaggggagatcacatcatcctttgttttccatttctgaaataacggcagacacgtggcacatgtcctgagcctggggtggtgccgttccttttgttgctctatctgtatgggagctaaccttttgacaatttttatggcaaatgctagggcagcttgtgagctaattagaagaaactgataagtgaatgctgagtttgtcgattctctttcattttctgcagaggagacagccgttgaaacggcattcttcgtgtggctgataatttagcccaccagacccctatgaaagggaatattgcttctctcttagctttttccacattttagtattctctttaaagccaacatttctccataggttctaatacctaggcatttcatatatagtagccaaattcagttcactttcttcaagaaagttgtccttttcaaactgtggccttttcctgtcatgggtctggtttcttactcaccccgcactgttgtatcagcaggtactaggatttgattgctgatgactgtatgtcccaaagaaaacagtgggagaaatgcagctgtcaaagcaaaaaacaaatagcagttttaaggttgagtctcaacctggccagttgcaagatggctgttcagtagatgttattcctaatgcttccctggttaatagaactcaatcagtcctgcaggttattggtgctggttgcttcctataacagaaaagtactgcattccagctacgttcctgctgtggaacataagtgcttagtgctatttacttaaaacattctaggttgataaattacaagcccttcactctgggtaaagctcataaatccagctcctacaaaaaaaatagcaagctgatagcacttagtcctgtttataaagttcatacacatctatccatgatataggcacaagtatatatctatgaaatagcactgcagcctgttaaagtaatgggtgagcacagccacaaaggcgagaagcatccgacttccagactcctcctattagtctctatgcctgaagggcaccttgaggaggaggtctgtggaagggagcttccaggcattggagtccacatttgtgctcctttctctctttcttcttcccgcaagtcacctttctcacgccctccacctctctctttccttctgcaaaatgagcatctgcctcttagcctccctcttcgtcactaggctgagatgaggcagggaaccgtggtggatccagagcagtttgaacactttggctgcgtggaaagcgatggggttaaatgagcatttaatcagaaccaggagctgttcttttggcaacctgttgaggaaaaatgataaaccctaacaaaaaggccctcaagtggcacgagtgcagggcctgaaagcgttacgtgccatcagttatccaaaaagaacattttttaaccagaaaataaacatgagactcatcccactagtcctaggttcttggagccccacaggtattgttgcaggatgcatcattgcttcgaatcagtgactgaacaacccagttcctaatcagcgtggagagtcagaattgtcacacgcactgggctgaagctgcatattcagtactgcattgaacattcagtactgcagataggataattatgctgtttgtcagatactagaaaagtgcaaagaacattccttcactttgcaacagcttggacccaagtggcagacctgctgttccctcaggctggcgtgacctccctattgtcagccccttcaccacagctcaactacccccctggctttcaagatacagctcaaacagcatctctcctcaggaaagaccttactcccggagacccaggcccgagttgtgttgccactgtaccctgttctgttagcacttaccaggttgcatttttgtgatccatttacctgtcttccctgtcagacatgaacagggacagtgtcttgtcctcaattcatcatttttctcctgttttgagcacaatgaccaggacgtagtggatgctcaataaaggtttgtcaaatgactgatagtatggttagctcagtgagaattgatggtgccctttgtgatctgtcatccatcatccttggtgtgaagcagggctgggaggctttaaacagtgccacttgagaatctaaggagaggtggcagagttacaattaacaataactaccccttactgagtatttatttgctatgggccaagcactctcttagggtttttaaatgaatcaatgcacttaatccttagatcaatctgctaagacgagttctgtttattatcccctttgcaaagcacaaggaagttcagtcacttgcccaaggtcacacagtgacagtgcagagattcataccaatggagacaaccatcacttatctatattccttttagactagttcctggaaagattaagccctcatgtcctgaggcatccatcttaggtaacaatttaacttctctcttgtttctagaatggtattagtgtgttccctacttgggagaatggagaaaatggtcaccagataactttctgtgttttttggttcagatgagataggtagagttagttgacaaagaattgattttatgtatttatttttattttgttttttttgttcttgattttagatggtagtttcggtccttttggaaacatagcattatcctccagccagactgaactatcctactcccatttcctgtaaggacgactgacctcttttttgcctctagacttgtgcatatgctattccctctgcctggaacatacttacctgcttgctcctctttccccaagcccagtcttcacttggttcctcttttctaccatgagccagtttagatgtcatttccctacctgcccaggataggaggttcccacagccgctgggtgtcctgttgtggcactcacaagtgttatagtgctgaaagcccactcctggggtttttatgtgtgcgatgaaggaggtgattatcttttcccagctagttcatatcctagtcctctgagtgtagagacttgtttctttttccccatttgtcccctgcaccttgggcggtgcttggacacaatgtgtgtgttcactaactatttgtggaagaggtgggtgagcgggagttaactggctttaagtctttgagttttgggtttttgaagtagtcaagtccgtccacagtccgtcctgtggacagccattgtttgccatgtcttgtatgtacacacttgcctgggcactgtggggagcagaaagaggactaatactgcccttgtgctgaggcacctacagtctcgggagatgttcagaggacagtgagtcacttcacagcatcagcatggtatagtggatgagtgatgacactgaagatgagcttggtcatattctggcaagttggctgacacctggaagtcccgtccacaccccaagacctcttttcccagggtgtcctgagaaccacccagagcaactgtgaccaatggcgcttgtttttaaagaagtagaaacccaaattaggaagactgagcaaacctcatgcatttggggaagggcttgttggaaagtggaacctgatgtaggtagcaacatgttgaggttagatttaaccaaacagaaagacttcttaattgcttaaagacaaaattttattttataagtggaattagggctttaaatcaaatatgtttgaacgtctttacttggtttcctcaggcaccttcactcatcttgtctaaaacttaattgctggtctatccctgccagatttgctgcttctccttgattccatctctcctttagtggaaccacctggtactcaagccagacacacaggtgtccctcttaattctgtctcctctggtcctgttcaggcacctgttctgtgactctgcctcttttccgtttctcaggctgccttctctcccttctactgccttccttatgtcaggggttggcctactttctggccttcttgatccagggcttcttttgttcaactcatactccaccctgttgtcagagcccatccagattgcagattggagcctatgactcgtctgctcaagggtcttcaaagactttgcagcttttggctgaagttgagccacctggtcccaaatggagccccattcccgccatgccacctcctgtctgtttaagctttacaagatgacttgcagtttcctgtagaaagcatgacttttaaaaaaagacttatttccttctctcctgcatctaactctcacttgctctttaaagccttctctgacctaggtcttgcctgtttctcctgcagaacactgcttccaccattttgtagcatcagtgtctaacattggttggcatgtagggtgtgctctataatccttgttgaaagaataagtgggaggtaacagaggcttaattcacattgagctgtaaacgagcaatatctgactcttctgagaatggattttgtttcaaacactggttacttactggaaaaggtgtctggggagtgctggacagcaagaacaaagggaccccacagaacaggaaaagaggcactctagggtctgcggtttgcctatgttagatcaccgtgaaaaaggccagtgtatgctttggcagctggcaaagaatcctgtgactcagtttccttatttgcacaaaaagggtatgagtctacattaggtaattactcatgctcatttccaactcttgacagtctacgatcctttgtgtcaaagttaaaaatctaagtagggcattctgaattggtgtcagagttgatgcacttctcactgtattgcaagtgccaaggggacaaatacattgtctttttgcattcaacaaagacagttttgcattttaaaaacaaagtagaagggaatacaggaaaactgcattaatacaattttatgctggagaatttaaactcccatgtcaggaaattcactcatcattcccttggcagcttttgtttctctgcactgcacaccccacttacagacagccccttcttgccaaagcccagcccagccatgaccatgagttatggcagattgggaatcgttaccttgatcttctcaacccttgggtgtttaccttttccaagttaatgcctgttctttaatgttacattatcttgtagcaaggtagtcatttataatttatatactagagctgccttaaaatagagacaagaggataatcagcatcctgaaacttctagttttccaaaataacatttcttcagtgaagtctgcctgtaggaattaaaacttttggtgaattaaaaagctttttgtcctattgtcagactgggaaatggatgtgcccattactcagccttaaaaacgaggaaggagatcatctgttaaaaataaaactcatcattttcttttattcttctcaaaataatccctaaagacctcaatctttatagtgttccagtggccccactatagtcagagaggagacagggcagaagttgaaggacagataggagaaacggccctgctaaaagataaaagccagtatgcatctcagctacttgtctgctgtggtcctgatattcttccatctaggttgctgctttgcttgactttgactgcaaacacagagaagggatgggctttcctgttgagtaccttgtagagaacccactgttcattcatatgtgttaaaaatgaaaagcctacttgaaaactcccctgtagaatcaggttttagcaaaaaccaatcaggtatcagaggtctaacttatttttcccttcttggttttatagcaagtctctaaaccctaagattttttgtttgtttgtttgagatggagtcttgctttgtcgccaggctggagtgcagtggcatgatctcggctcactgcaacctccgcctcccggtttcgagtgattcccctgcctcagcctcccgagtagctgggactacaggcatgcgctaccacacctggctaattttttagtattttactagagacagggtttcaccatgttggccaggatggtctcgatctcctgacctcatgattcgcctgcctcagcctcccaaagtgctgggattacaggtgtgaaccaccacgcccggctgcctaagaatttttttcattccttttcattatatacatcttcagtgtgccaagactttgagtggagatttctaatgagggcaggaagggacggatgcttctgcaattgagtggtctcatttttcccatgtctgtcgaaagattactctttcatgaccaccatttctatgatgcatctcatatgatcctaatgcactcgagtttgtatttgaatgtccatctgatatttaggggtggttggggcaaggagggggcaagcagcaactaaggggttgtatgggaacatcctggtggtttaacttgaaagccactaggtggcaacatttactaagttgccagccattctcttcccttaagacattgaacttgcttttccacatagcagatggaatagctgagaaaagagattgccattgcttcaggttcttttgaaagtgaggctataggataaacacactacagtatattgatatctattcgtcacctgggtttagataccaggagtttgaatttgctctgggtgactgggtgagtagcttcccctttggcctcagttaggcatccttgacaggacagacctgtgattggactgtctggtctctcatggttctttttctccatgatttatgactttgattatgatttctttatattaaaaaaaaacttgtagtaaaaccagtcttatttaaaggaatactagccttttatcaaagggcaaagtaatgatttaaaaaaaaaatcaacaacaaaatttcaagggaatgaatgtccctagaagctagccatctccccgagttaacttaagaggctagactctcctaaatgaggatgcttatttaccagctttcctaaattagcagctttggagatgttaaaatccgtaaggaactgtccaagggatgtattgtgtatgctttgcagtgattaagccattaagctctaattggtattttcccactcatgggtttgtaaaggaagctttaaaattatttaggaattcagtcctcatcagctgtcttagtgtcatccccacgttttggaacctgagagtggagagtgcagagaaaaggttttattaatgatttttgctcacagtgtccttccccattggtttgttattgcagatgaagtggaaagggaaggacctctttgatttggtgtgccggactctggggctccgagaaacctggttctttggactgcagtacacaatcaaggacacagtggcctggctcaaaatggacaagaaggttgggctagaactcgatgaaactggtggggctgacgtgagctttccagtttttccctgagcaggcgcctagctcatcactggggcgctgtagctgtatagtagagaagggggcacattcctgaattaagtcatgcagaaagcaggacgtagagatgctaccagtttccttctcctcacaggctctcctgggcaagcagaagttaccaggattagactgctgctggccctggcttctttacccattgttaccagcctgattgcttctggctttatgcctttcagtttatgaataaaaacttcatgaataaaaattactgttatcttcatatacttaaaaataaccaatttgtgtcttttagagagtattggggcttgtgttctttagggaattttttaaagtctttttgaggaacaccatagtctgacatgaagtaatcattaatatgatctaaggaatagagagtgcctggtccccagggtgaaagaatgtccattttgtcctcaggattctctggggcttctgacacatggccaagaaagctgggctcctggcaattttaatgtggcttggaaatgaatattgcctaaaggaactgccctctgcatgggttcatatgttcacacaaggatacacttgcttactgacctgcctacctagccatgaaaggcaggcggggagcaggaccatatgcttttgtcagtaactcctaaaagacacctgaacttcaaagtaagtcaatgtctaattcttaccccaaatgatgccccctccagttgcctacctgagcataataaataatgaaagcttcctattttttttttttttaccagtttgactcaaagcttaagtgttcgaattgtgttcacatatgtacacagtaatctaaataatcacatgggaatccctgctggttgtaagttcaatggtaattcccaatgatcatgagcatctaagtgccactgggggccactgtcagtgagggtgtcgtagaccagattttgaatctccttggcattgccatctagaatttgggcaggagcatggagagttatgtgtcaaagacagcaaaactttttgtatgtttttcatgattcttagcaaagtgaattttaatgatagctgagtgtaggccaaatggatattagactgggggcatcaggagccgtggaacttgctgctcaagggaaatacatcatgacacatgttaatggagccttgtagcctgtcacatggcgtgtttatgtcttgaaattcactctggagagcagatggttcaagctttacaggggtgaatggaattgttagaagatttaaaggcagtggtttacagactgtgcttcaagtattttgtggggcatctctggaggttccttgaaacaaagggttgccatgatggacacattttattctgttgctcagttaatgtttagatgacttcataatgatctagttcatcatctctaagctgtattttttttttttttttttaagacagagttttgctcttgttgcccaggctgcagtacaatgacgcagtctcggctcactgcaacctctacctcctgggttcaagagattctcctgcctcagcctcccgagtagctggaattacaggtgtccaccaccacacctggctaattttttgtatttttagtagagatggggtttcaccatgttggccaggctggtcttgaactcctgacctcaggtgatccacccgctgtggcctcccagcgtgctgggattataggtgtgagccaccacgcccagcgctctaagccgtattctatcacggacctaaatattggcagtaggcaccaagaaaaaagaaataaaggaagattccactacttcagataattaaaaaaccttccacctaccataaaggacagtgtccaagactgctgagtgatacatttctagtttttaactattctgtggccctgagaacatttatgccttaatcctagctctgctcacttcttggggctattgattaatttgtttcagaaacaccataggaagtgaatattacctcttgctataggtgactttgtgaatacttcaaactgtaaaatcacaactttcaggaaatgtgataaatttagtgggaaaaaaatttaatgcacgccttgcaaaggcttctttgagggtagcacaggaggaagtgccaatatagtgtgtttgtcttttgctctgcaattctgcaggtactggatcatgatgtttcaaaggaagaaccagtcacctttcacttcttggccaaattttatcctgagaatgctgaagaggagctggttcaggagatcacacaacatttattcttcttacaggtacatcagtcaaggctaccccccagttctgagagaacttgcccaggagtggttgcagagttggcctcagagttgaccacaaacacctttgtattgcaaaaatattctacctctggaaggtcagcccctttggttctgtaatggaaaaaaggcttcagaacagaactatacttgagtgatgaaaattggtgtcagatgaaattgtgaaggtgtgatggtgaagaatggatacaagtagctacctaacttaaaacctccttgaaaatgggtcctattttcttctagctaacttaaaagtactcaatagtttcaaaggaaggctaaagagagagtcttataaagcagtagttcttccaaaagtttaaaatctgctctcattaagagaggactggccgggcatggtggctcaggcctgtaatcccagcactttaggaggccgaggcgggcagatcacaaggtcaggagatcgagaccatctggctaacatggtgaaaccccgtctctactaaatatacaaaaattagccgggtgtggtggcaggtgcctgtagtcccagctactcgggaggctgaggcaggagaatcacttgaacctggaagatggaggttgcagtgagccaagatcgcgccactgcactccagcttgggcaacagagtgaggttccgtctcaaaaaaaaaaaaaaaaaaaaaaaaaaggacttcagccgggcgggttggctcacccctgtaatcccagcactttgggaggctgaggcgggcagatcacgaggtcaggagttcaagaccagcctgaccaacatggtgaaactccatgtctactaaaaatacaaaaattagccaggcatggtgatgcatgcctgtaatcccagctactcaggaggctgaggcaggagaatcacttgaacccaggaggcggaggttgcagtgagccaaaattgagtcacttcactctagcctgggtgacagagtgagactctgtcttaaaaaaaaaaaaaaaaaaaaaaaaagaggacttcagagctctagtgacacttggtttgtcccccatatgtggtacttcagacatcgtgcttcatgctatgctgtgtctctaattgtcctatttcttccttaattcctcattagattgtaagccccttaaaggcaagcctcattaagtacacagtaggcattccataagtaattgtcccaccgaattgaagaaattaagaaattcacaattacaggttgaccatccagaggcacagggaggggaactggtctgaggatgaaaaccttatcagtttcacttatgttcttactgcaggtcagagtggctccccagtttcatggccagttgcagtgattggcactggggctatttgtgtgctcaaaggtttcagtaatgtaaaagatggcagtaggggcattaattacatgatttcccagagatagttgggtagtctgtcacatagccctcctgtaattaatttcagcctcagtatattgtggtcagcaaatattaagttaaatataataaaaccccctaaattctttttaaaaaaggtctggggggcgtgtgtgtgtgtgtgtgtgtgtgcacgcgcaaaagaggtgacaaatttatttctgatgtttgcagatcaaagggacactcttaggctgggcgtggtggctcatgcctgtaatcccagcaatttgggaggccgaggcgggtggatcacctgaggtcaggagtttgagaccaccctgaccaacatggagaaaccccgtccctactaaaaatacaaaattagccgggcatggtggcacatgcctgtaatcccagctacttgggagactgaggcaggggaatcacttgaacccgggaggtggaggttgcagtgagccgagattgcgccattgcactccagcctgggcaaccagagtgaaactccttctcaaaagaaaagggatgttcttgcagtttttctatagcgttgctttttcccccctctctttggaaatgaaaccaagggattagaaagttgcactgcttgagaaacatctcaggtttcattttctctctaagaatgtaaaatcacttttaaaacctaagaagaatttttgtgtttgaacgtaaacacctaacaatctcctaggtcccagaatgtcctaatgttatagaaatggctttcttgtaagtacttggaagcactgcctgtctcttgtgtgactgacttgattttccccatactgaaatgttaaggcatttttatgactgagcaaggcaaaatttactgcttttatgaatccggtgactgttgacatctgtgagaggagagctggctttcctgctgtgtttatttcagtgtccccctgccacgtcatgcagttgtcttgcttctgtgtctggaacatcccaagttgcaccattctaagaaaattaagtgcaatgaaatatgttaattcaacattatggcttaagaattatatttcctggacctcacgtgtacttaaaagttgaatcgatcaaattttattgcttccttttcccttagagcagcacgttgagagtgatggttttttctgcaatcataactcagtggccttggtgacttttgtcttgtgttaatacttaaaagtagatccatttcctctggggccatgcatattcaaaggggctgaggctgtagtcatccccagagctgctcttgacacttcttgagttcatagcgctctgtcacacagcctctgttgtaactacagagaccgtttttactcttcagcattgatcatgaagagaagagataaggggtttttatgcatagccgtcataccagtaacttctgtgactgaactctccacctgtctgcatcagtaaaaaaaaaattgtaccctttgtcagaaaattattaacaggctgctctggcagccctcattagaacgccgtgaggccatctgttgtgatcagcctacacacctcacttccactcacagagtatcatgtctcccttgttgctcctttcaggtaaagaagcagattttagatgaaaagatctactgccctcctgaggcttctgtgctcctggcttcttacgccgtccaggccaaggtaggctcaaagaagaaaaatgtatttttcctgggcgttaatttgggtcatgggatcactcctatcttctctttctttgggttttctgtacttcagagagacttgccccagaaagtgagatgttatgggacttgtggacttgaagaaccactgtcactgttccagtgtttgtataatcttgtgtgtgtatgtgtgtgtgtgtgtatgtgtgtgtgtggtgtgcagaaattataagtatcgttctaatgaattagaattcattctaagtgaattcattcagaaagatgaatttcctgtgtaatctcattatgtacatgtggtttatgacatttactggaaaaaccttttttcttttttttttttaaaccataaactcaaccatgtggtacaacctttctattagccaggaaaaatgaatttatggtctccaattttagccaaacatggcctttaggtcagaaaggcccaggtcctcactccaaactcatttgcaaacaagctgccttgtgtgtggacactacactacaccttcagagaatgccctgcttcatctgcccctgattgacatgctagctgttcatgtggctaagcactgcaggtgctgtggcccaccaagcccacttgagctgtctggttagctgaaaatcgttcacttccgttaaatcactatagaccttttttttttttttacaagaccgatgagagggttagccacggagtttcatgtccctcagatttttcacttcagtcatatatcaccttctcttggttcccctgatccctgcctttcaccagagcacaagatgttgtccccagaattggggctccttgattacttgtgtgattttattttatttatgttttatttgtatttttatagagatggggtctcactatgttgtccaggctggtcttgaactcctgagctcaagtgatccttccaccttggcctcccaaagtgctgggattacaggtctgagtcaccatgcctggtcttacttgtgtgatttttttttttttttttattgatcattcttgggtgtttctcacagagggggctttggcagggtcataggacaatagtggagggaaggtcagcagataaacaagtgaacaaaggtctctggttttcctaggcagaggaccctgcggacttccgcagcgtttgtgtccctgggtacttgagattagggagtggtgatgactcttaatgagcatgctgccttcaagcatctgtttaacaaagcacatcttgcaccgcccttaatccatttaaccctgagtggacatagcacatgtttcagagagcacagggttgggggtaaggtcacagatcaacaggatcccaaggcagaagaatttttcttagtacagaacaaaatgaaaagtctcccgtgtctacttctttctacacagacacggcaaccatccgatttctcaatcttttccccacctttcccccctttctattccacaaagccgccattgtcatcctggcccgttctcaatgagctgttgggcacacctcccagacggggtggtggccgggcagaggggctccttacttcccagtaggggcggccgggcagaggcgcccctcacctcccggatggggcggctggccgggcggggggctgaccccccaacctccctcccggacggggcggctggcctggcggggggctgacccccccacctccctcccggacggggcggctggcctggccggggggctgacccccccacctccctcccggacggggtggctgccgggcggagacgctcctcacttcccagacggggtggctgccgggcggaggggctcctcacttctcatatggggcggctgcctggcggaggagctcctcacttcacagacggggcggttgccaggcagagggtctcctcacttctcagacggggcggccgggcagagatgctcctcacctcccagacggggtggcggccgggcagaggcgctcctcacatcccagacggggcggcggggcagaggcgctccccacatcccagacgatgggcggccgggcagagacgctcctcacttcctagatgtgatggcggccgggaagaggcgctcctcacttcccagatgggatggcggctgggcagagacgctcctcactttccagactgggcagccaggcagaggggctcctcacatcccagacgatgggcggccaggcagagacgctcctcacttcccagacggggtggcggccgggcagaggctgcaatctcggcactttgggaggccaaggcaggcggctgggaggtggaggttgtagcgagccgagatcacgccactgcactccagcctgggcaccattgagcactgagtgaacgagactccgtctgcaatcccggcacctcgggaggccgaggctggcggatcactcgcggttaggagctggagaccggcccggccaacacagcgaaaccccgtctccaccaaaaaaatacgaaaacccgtcaggcgtggtggcgcgcgcctgcaattgcaggcactcggcaggctgaggcaggagaatcaggcagggaggttgcagtgagccgagatggcagcagtatagtccagctttggctcggcatgagagggagaccgtggaaagagagggagagggagaccatggggagagggagaccatggggagagggagagggagagggcacttgtgtgattttaaaacataatcttttcacttatttttctttttaattaaaggtgttcatgaagccatttcccttaaggttagaaaaaataataaaatactcttaactcactttttggggtagattaatgcaatttcagatcaaagccaggaagtaactgtcatttgtggggaaaaaaggctatacatgctagtcagaccaatagaagcaccaaagtcaatttaatcatttgatggctcatgtaatatttgctgagtattcatcaggcccagggtggggagagagcatgagagttgttgaccatctcatagttgcaggcactaaagcaagtatctgccctcagtgatttgcccaagatcattcagacaatcttgggcaaagctaagagcagaagggtagaattcatggctttgagattgcattttgtgcctccaatattctactttcctgaaaaattagtaattgagaaaacagaaaatgggccctcattcaactaaaacatatgcttccttttatgctttgatcaagaatattagtaagaggaaaaatgtgtcctttcaatcagtatcaccccgacagtgatgaagcagtcattggcactttgattaaatccgagcacttcctggcctggagttgagttccttttcgcacgctttctccccagcgagagcagacccagcctctcaaggacaccacctctctttgaagggcttccatctcaaaggctacattttctttccatggatttttgggccacaaattcaaaggccacctgtagaaaaaaattacttttcagtgaaccagcagatgtttgcttaaacaggtttcactgtaggaaagccctgctaatttggatcgtactaatttggagatgaaagtgattcacagacgacatatgtggctcacatggaggaggatgttctagctattttttctggtgtaaattttaaggatcttacaaataaaggtaatctatggcttaaagtcttcatttgggaaactaaggcttactatgacatacttccagtttctaggactgctggttaatagttaaaggatatctgattataatattaataagatcttacatgcccatagtgttttctagttttaccaaagcaatacaaatgaatattttgtgcgacactcagtgtagtctttccagaagccaaggcttgagagtattatgcctgttttgcagatgaggaatttaaggctcagaaagggatttgtgacttgtgcaaactcacaatacttttatgttaagcctatttttatgaaatttttagcccacttctcgatggagaggatttcaggccaaatagaatgagtggagctgggatgggaaccctagtgtccaggctgcctaagttagcacattgcacttgcctgtcactgtctagcttgagggaggtctttgggtagcaaccactgcctttcactaaaggctagtttcatttatatgatcacatttgtctaagttcttcagtaagtcatactggttccttccattatattcagcttgttttcttccacaacctttctgaaacagaaaggaactttagaagtgtggaagggaaagcgaattgagctcattaacacatggaatgtaattatgcacaaatgtattcattacagtatttcagctgttggaatgatatagacacagttaattccaaagcataaagaaacaattaccctcaaagtataaatacaatactaatcacatggttcagttaacaagaaccatatatgagttatacttgaatcaaaagtgtaggcagggactgggcacagtggctcacacctgtaatcctagcactttgggaggccaaggaggatggatcacctgaggtcaggagttctagaccagcctgaccaatgtggtgaaacctaatctctactaaaaatacaaaaattagccaggcgtggtggtgtagtcccagctacttgggaggctgagacaggaggattgcttgaacctgggaggtggaggttacagtgagctgagattgagccattgcactccagcctgggtgacaaagtgagactccatctcaaaaaaaaaaaaaaaaatgtagtcagggtttttttggtgcagtcacatgacacactaaaccatcttgcaatgtttaagtcacctgttggattgtatattgaccatttggtgttggaaatgtgttcttattgaaaatgactttgggagagaatggcatataatttatgaatctcatgttgctgtgtgcagactcctagtgatcagaagagagaaaagaattgtgggaagggaagcttagtttcttagtactctttaatgcaaatcagggacagagtgccaaagtacaattgagttagaaaattgagtgtgtaaagtgtaggtagagagtggcaagagttgaggctggagaggtatgcaaaaaatcagatcttaaaaggtcttaactttatcctgtaggcgatgcagtgaagggtttatattttagatagagcctgtagtggctgtgtgatggacagattggagtgagacaactttggaaacagggagacctattagaaggctgtgatagttgccctggtgagagaatattaggttcacacttcaggtggttggttggatgggggctgactgatttaaaaatatccaggagataaaaagttgattagatggtgctatactctgcatatccctttttttcatatccttttacagaatggtatttttcttcccactcagcatctactttgagatgtatccatgttgtgtgtatagatgtagctcactgattttaattgatttaatatggtaaccactgataaataaacctagtttatttatctgttcctcttctgagggagaggtagtttgtttccactttttccttattatctaaacagtgctcaaatgaagatccttttatgtgattccttatgtacatgtgcaaatgctttttccccttaaggtaggtgcctacgaaaataaataaataaatacatacatacaaaaaatagctgggtgcagtggtgggcgcctgtagtcccagctacttgggagactgaggcagaagaatcgcttgaatccgggaggcagaagttgcagagagccaagatcacaccactgcactccagcctggacgacagagtgagactccatctcaaaataaataaataaataaataaataaataaataaagtaaaaaaattaaaaaaggtaggtgtctagaagaagaattgcatagaattgacagaagaggtgaaccccaatataaaaaaaatcttaagttgataaaaagacaaatgctataaacagggcatgaaacatgcactttatagaagagaaaacaagaatggtcataaatacaaaaagatgtttcatctcacaggtaatcaagaaaaagaaaaaacaacaataaggcaacatttcaaacccataagattggcagggattactagattgggtaactgcattgttggtgctcatttacctgccaaagggattgtgaaattggcataacctctgtagagcaccaagtgtggaagggacgggtggaagtgaggagacacaccgctggctgttccaggtggctactccagaggaatctctgcacacacatccttttcacttaaaactgtcacaacagatagacccacttcattttctttttctttttgagacagcagtctctctctgtcacccaggtggcacaatctccacccactacaacttctgcctcccaggctcaagggatcctcccacctcagcctcagcgtatgccctgctaatttttgtgttttttgtagagacagggtttccccttgttgcccaggcaggtcccaaactccagggcacaaactctatacccgcctcagcctcccaaagtgcagggattacaggcatgaatcactgcacctgaccccagctcattttcatttaactgccgaactatgtttcatagaaaggagggactggattatttaaatatatctttattggtagatatttaggtttgtttttctttctgttgtttttctattggtgaaacagatgcaatggacatccttgaatatgcatctttgggcatatatggataatatctctctataatagatatcaagacatggtataactgggttaaagaataagaacatttaaaatgtaagtaatgtgaagcaaaaaaaaaagccagacacaaaaggccacatattttatgcttccacttacctgtagatgaaatgtccagaacaggcaaatccatagagacagaaagtagatttagtggttgccagggaaagggagaaggaggaaattaggagtgactgatactggccaggcacggtggctcacacctgtaatcccaacactttgggaggctgaagtgggtggatcactggaggccaggagcttgagaccagcttggccacatggcaaaaccctgtctctacttggccgggtgcggtggctcacgcctgtaatcccaactctcagggaggcaagaggtgggaggatagcttgagcccaggagttcgagacctgcctgggcaatatagcgagacccctttctccagaaaaaggcaaaaacaaaacaaaacaaaacaaaacaaaagacaaaaaatatataaaagccagctgtggtggcatatgcctgtaatcccagctactcaggaggctgaggcacgagaatcacttgaacccaggaggcagaggttgcagtgagctgagattgcacccctgcactctagcctggggtgacagagtgagactctgtctgaaaaataaaataaaaataaaaaaggagccactggtacaaaaaaaaaaaagaaaaaatgagtaagacctactatttgatagcacaacagggtgactatagtcaataataattatacacttaaaaataactacaagaacataattggattgtttgtaaaacaaaggataaatgcttgaggggatggacaccccattctccatgatgtgattatttcacattgcacaccgtatcaaaacatctcaggtaccacacaaatatatatatacctactatgtacccacaaacattaaaaattaaaaataaatataacttacaaagattaaaaatgaaattagaagtgatggctagtgggtacaggacttctttttggggtgatggaaatgttctggaattagatagtggtgatggttgcacaagattctgaatatactaaaaaacactgaattgtacacttaatgtaaattttatgtatataaattttatctcaataaaaaatttaaatagatatagccaaatcaccctccaaaactgatgtcataatttaactttcaataacagtgtgtgagaatacctgtttttccacattcttgcgaacagtagatactatcagtctttaaaatttttgctaattgatagaaaaagattttttaaaatttgcatttccttgattgctattgggactgaacgtcttttcataaacttactgtccatttgtatttctttgttctgtgaatcaaccgtttatgacttgcctactactgtattgtttgtttgtttctttctttttctttctttctctttctctttctttctctctctctctccttcctccctccccttccttttctttcctttttcttttctttctcccttcccttcccttctctcccctttgctcccctcccctccccttctgtttctttttcttttctttcttcctttcttcctttcccaggttcaagtgatccatccgcctcagcctccagaggagccgggactataggcatgcgccaccatgccaagctaatttttgtatttttagtacagatgaggtttcaccatgttggccagactggtctggaactcctgacctcaggtgatccatccgcctcggcctctcaaagtgctgggattacaggcatgagccactgcacccaacctgttcatctttttccgattgatttgtagatgctccatgtattatgagttatcaaccttttgtctattttacgtataggactggtcaatctttttctttgtatgttttgagtgacttttagaatgcgtttaccaaccattattatatccatactctgttatgttttgttctggtatttttatggattttcatttataggtttaagaatttattgactggtgtgtgggtatagtagggagggggtctgtcttttttctatatatgtagtaatctaacctttatgtttttgtgaaatcctactcagagcattttatctcatttctcatagttatagacaggaaattatttcatatccagatagagcctccgtttaacctaagtattggctccacaagtcttttaaatggtaaactccttgaatttaaattcaattagtttatgtcacgagtaggtccaggttttctgggtctgaattttaataatttaggggattgtctttaatgcaagagtaccaaattaggtacaggcatatgaaggtgcagagacctgaaatccaagcttccttagcttcccagtaaattcaccctggttacattatcagaatgcatctgttacataaaacgatgaggagcagccatctccatccctggagtggtatgactttcttttgtattcaccagctaccacaacttcaggatttttttcttcccttgttgtttaaagagacatttaagagcagacacatacatcaaggtggctttaatgttggaagcagagttagtccagtggagaagttctttcagcagggtctttgccacctctgcattgctcaaatgtgatgtatttgatcagtggactagctgagaacttggtataataatgggggttgttaatcttgcatgcctttggaacctgaatttacagctttaactttgcatatctgcttgcttttgcattagagcttggtcagcactgttgagagatttgcaaatgcaactaacagggctttcttttagcatcctaccctttcaaaaatccaggaggcaaacaatgatcaatgttgtcataagtaatgcagaggatggcaataataataatacctgactttcaccataagccatgtgctgtgcgaaatgcttacctgtattgttttacttcatcctcatcatcccctataaggcagatgctattatgaccctcactctacagatgaggaagttgaggcttagagagaggatgccttactcaaggcctcagaaggggtacttcagcacccccccacttcccttcaggatcctctaaggccagtgctctcatttgacaaatgaaagacagatttggagagacctgagatcttttggacatcaggtttatgtgtcaagcatagttttatttattttattttattttgttattttttgagatggagttttgctcttgttgcccaggctgtagtgcaatggcatgatcttggctcactgcaacctccgcctcccgggttcaagcgattctcctgcctcagcctcccgaatagctgggattacaggcatgtaccaccacgcctggctgattttgtatttttagtagagacgggtttctccatttggtcaggctgctctcaaactctcaacttcaggtgatctgcccgcctaggcctcccaaaagtgctgggattacaggtgtgagccaccacgcccagccaagcatagttttaaaaactttgctggtcttatttaattaaatccctgtaagagtcctgcaagataaatactattattattcctgttttacagatgagaaagctgagacacaaaaatttccaaggccacatagctactatgtgaaagatgtaggataaaaccttaggcagcctgcctccagagccaggctcctaccctcactctacagctgccttgcagggagtactgttaaagcttagtacagttacgacttactgcatcacatctctgagcctcccagaaatagagagataccaaggcctttcatttataatttctaagttattttttatttttatagacagggtcttccactgtcactcaggctggagtgtagtggcacaatcacagctcactgtagccttaacccgtgggctcaagtgaccctcccattttggcctcccaaagtcctaggattacaggcatgagccatggtgcccaccctatttttttaaatgaagaaatgcctaaactgtgttacaaaaactgtggcatgtttaaaatgtttaaatttgacaaattaggccaggcgcggtggctgacgcctgtaatctcagcactttgggaggctgaggcgggcagatcacaacatcagaagtccgagaccagcctggccaacatggtgaaaccctgtctctactaaaaatacagaaattagcccggggtggtggcgtgcacctgtaatcccagttgctcaggatactgaggcaggagaattgcttgaacctgggaggtggaggttgcggtgagctgagatcacgccattgcactccagcctgggtgacagagcgagactctgtctcaaaaaaaaaaaaaaaaaaaattgacaaattaattctcttaagattcaaaaaaaacaatgcaatacaattctgctatttgaaagataattatgagattcaaaagaaatatgaattcatggggcttttacagttaaggtgatatgggaatgagacatgatttaaagttaatgatgaatatcttctttcactcctgtgtctgtagttttaggccgcttcatttggagaacacaccagaagtcttaacttgaggctctttgagaatgagagaacataacgaaataatgagatttggtggtatatagaaacagcagccttgtgcctgacctttgttttttcactgttggtggctaaaagaataaatgtttatagattatactgaagtactgagctttgttgtttttggtaaaatgaagagccactgtacgctgattgataagagataggctttgattttatattctactgtatgtttcagttagtttctttttaaacattctttaacttttgattatttccttatcagacttgagttttctaggaaaggagtttttttttttaatcagagaataaatttccaagtcattgtccccggagggataaattaaaatgcagggcctatttccaaccgcattagtgacttctctgtagctttaggaagatcaattaaccttttactcacttctttgtctgtacaataggaatggcagtgttgacatcagatttttccaaagtatttttcagaaacttgggtgaaaggtattaaaactactgcctgcattattcctggatccccctagtaatgggctccaattaccagtcacttataagaatttataggtaagactcttatcatatgttgttaatcacaactttcacagttgtgatttggtgttttaattcaaaagctactgttttggaagtgactgctttctttgagggttagaaaacatgcccacatttccatacaagtgtcacattcttgttagcacatcacccatccatctcttacaggattatgcaactcagttcatagatataatcagctttgtattttcattcaaggataacaaactagcaaggttgaaatcttgacttgtcatcggaattgaattgctccctggagctgggagggaatgagattggtccagctctgttcagaaatggcagttatctttagaatctcaatcgcctgctctccctttcttctttccagtatggtgactacgaccccagtgttcacaagcggggatttttggcccaagaggaattgcttccaaaaagggtaagagattaaattcccttttcaggaagacatagcagatatgtggtctaaaagaaagctaaccaaaggacttgaaggaatattggaagtacatagcaatttaattttaataaatattttgtaatctccagtaaacagtgtgggatctctgttaagaatattaaaaagcaaaggtttttggagttagtttggggtcaccaggactagcatggcctgtaaatgttttttctagcgtggttgttttttcagatgcagttgagcatcattgattcccaaagaggaggctggagcagagtgtattcagcttggggaattgagctgtttgcagtggcgaggggcggatagaggagatgaggtaggggtgggcattgtggtttttaatcctcagtgttgttcatcttattcattagccacagaagcaggcccgccctcccttttgctcctgccgattttacagccctcactcatctgtcactgggtaataaaggcccgtttctcacctctcactctctttacctgtccctcgatggcttctgagcatgtgaaggcctgagatgagtgagcattgcttctgactgagctccgctgtcagaggtggtctctgtgatgtatcgcccaggcagggacaggggcactgccagatgagggttgcacctaggtctgagttatcatgcagctttctgagttgctcctccaatagaatggtgccttatttacacgccctctctctgtgtgactatctccctgggtgtagctttttaaaaatagctttactgttttgtaaaaatgatgcataattataaaagtggcaaacaataccaaatttacttcatgtgtaggttttttattttgctctattttttggtaggtaataaatctgtatcagatgactccggaaatgtgggaggagagaattactgcttggtacgcagagcaccgaggccgagccaggtgaggcccattcattgttggtttacattcctttatgggcttttttttttttttttgccttaaagaactgcaaaactaggacatgcttgttaaacaaaatgcagtactgaagtctataaaagaaaaggggagagctggggagctgggagtaacgttggtcttcagttttgtgtgtgtccttttctagtacgtatgacataaagtaggtatgtgtactgcctgtcaagatatatagacctgtactcactggtaattaagtttaagatttttttttttttttgagacagagtcttgctctgttgtccaggctgaaatgcagtggcgccatctcagctcactgcagccttgacctcctgggttcaagcaaacctcctgcctcagcacccccagtagctggcactacaggcacacgccaccatgcccagctagtttttctatttttagtagagatggggtttcaacatgttacccaggctggtcttcaactcctgggctcaaagcaatctgcccacctcggcctcccaaagtgttgggattagaggcgtgagctgagccactgtgcctagcctgaattttaagaattctattgtatggctatcccattgcttttgcatccatccctttattgatggcatttgagtatctgtaggtttttcacttttacaaaaatttctgcagtgcacaatcttttatttttatacaattgtatgagtagttctggggatatattctttttttttttttttttttttttgagacggagtctcactcagtcacccaggctggagtgcagtggcgcgatctcggctcactgcatctccgcctcccaggttcacgccattctcctgcctcagcctcccgagtagctgggactacaggcacccgccaccacgcctaggctaattttttgtgtttttagtagagatggggtttcactgtgttagccgggatggtctcgatctcctgacctcgtgatctgcctgcctcggcctcccaaagtgctgggattacaggcatgagccaccgcgcccagccaatatattctttaaaacaagagttgttgggacaaaggatgtgagcattttgcattttgccaggtaccaccaaattgttctccaaaaaggctgtacctgtttatacatgcctgtcgacaagtgttatgagagtgtcccaccccccacccccagtctatcctcaacaattgtttttatcagtctaatttttgtaatctaaaaagtgaaaagttgtattatgttagaattccattcccttgattaggaattggtcatgttttcattagcctttaacatttttttctcttcttcaaatcagtttcctaacacttttttttttaaacttaagtgcaacatgcatatggaaaagtagacaaattataagtatacaacttgatcaattattgtaaggtgaaaacaccagaggaagaaataacctgtgtctccctacccccaattcccctttcttcctccccaaaggcaaccagtctcctgatttttaattccagattggcgttgcccatcttaaactttgcattctgttttttgtgtctccttttactcagcatcatgttgtcagattggggtttgtggcatgtggcaatagttttctcattttcattgctgtatagacttccactgtattagtatattaaaaattatttattcattctactaatgatggacagttaggttgttgggttgtcccctgagttttgctattacaataatgtcaaacaatttcccaaagtaattgtaccaatttacgtcaatgtgcatgatttctgatttctccaccttttcaccaacacttggcgttctctcaggctgggtttttaaaaattcattgagagcatttggagattggagagagaaggaagaggacaaggtcatagggagacttgagttaaaatatttcagtatgatacctgtttgggagttttctgcaagttattgctacttcaagagcttactttaaattataacttagatgaaggtgatctgacttgggttttacaacccagataactcttgccctaacctccaacaatactcaggaagcttgcagagagagctgtttcatttccagaaccttccaggtaaagaaagtacacaaaggaaaagcaagaacttaaataaaattccaacacccaaatctgtttgagggtagaagataacataccacacactcttgttgaattacttgagatgagtttactgtttaccaagggcaaggtgggaaactaaggccaagaaactccgtgatgagtctgttctctgactatcttttgatggggatgggaaattctgcttgacctcagtgtgtttaatagactcagggccgggcagagctttgctggtgtctgctgtggcttttgtcttctggcagcgacgtggctctagaggaatggcagggtcagaatgcttgatttggtgcccacccgctctccacccatctcacttagctccaatgacagtgtcttccgttctccccacagggatgaagctgaaatggaatatctgaagatagctcaggacctggagatgtacggtgtgaactactttgcaatccgggtgtgttgaaacctctctgagctccttgtgtagtagacagagactgagtgagggccagactgctaaaatggttacttcttcattccaaggcgatagactcttttatggttctgtggtaaagaaggaaagaggaaggaaagagaggtcttagtgcctaactttctatttttggacttcaattagatcataggtaattaagtgtcacttgagccttgggggacttggacctggttctgctctcagcagaaacctgtttgaatgctctgagtgtaagatttgattatttctggctctgtgagatctccgtccacagggagcacttgtaagtacttctccccccaacacacaccccacccccatccccacccccacccccaccccaggcactagtagagtagatctgcctttatagattactgatttgtttgggattctcactatgaggctaattggttttctattcagactattaatagtctgctgtctgctgggaacccactgcttctgcagggagaggcatttgtgtgcagcccagatctgggcctttagaatgtctttctcctgtgggtcagtatctggatgcagtgtataggcagcttcttacaaagggatgcatgcgatttgccaaagcatttcactacggactccaaactgcagatgagtagatgttaaaacaatgaggcgggtccacctttattttcatagtcatgctttgctttcccttattgggttcctacagttgttgtattaaattcaggtaaattgaaacatattttaaatattctaggatagctttctacttcatttgtattttgtaaatacagatttgtatggattacactgcataagaaaataaggcacacttaaagtgcctaaaagatgctccataatagtacaggaagttcttttctaaagttctgtcagtttgtatttgctaattgcttggtttctttaaggtcaaactaatgtaacacatttctgtggttttgtcaactcaactcctcttgccccatgttctggccacctagattctagaaaactaaagttttataatcctcagaaaacagtttttttggtttttaaaaatcttttttgttttttagaggtggagttttgctatatcgcccaggcctgctaggctcaagtgatccttccaccccagccttccaagtagctggggagtatcactgtgcctggctgaaaaggtttcttattagggaatatttctacatcagtcagactaatggatactgttttttgtgtgtgtttcctatattgagcaatagacaaagctactggctatcttagtgtcttttatgttaaatttcctgaaatctcaccattaactaaggaagatgtatgcttaaaacagtttaaaaggggctgcttgagtcctcacctctctctctgtttaatctctaggagtgttggagtcataatggtaggaggcagaaggctgaatctttttttaaaaatttaaactaaatagtcagaaactattttctgactattgaaacacaatgaaacatctcattttccaaaatgtactgcagatgtaaaagtacaaagcctcacttctattaatgcagtagctttcatggctttgctgacgagcagaagagtctctcatggtttggtgatagcacctgacttcaggatgttaggagtaaaaagatttatgctggagtactcactcctcagtctgatatctgctgttagatgggtacttctcttcacagtcccagtaccttctcagtttgcagacctgtttttctgcccttgagtcttggttcagtttccattatcgtcaaggggtcaggagctgtagtatccttgtgcagcgagtttccttccactccaaatgagggctagaccacagcactggcgggtggacctgcacgtgaagatacagccactcagtccgtcgcaggttcagtgctgtgggagcccagggcacccgccgcgggctgctctgactgctggccaggaccgctgtcaggggcagagcataagtacggcttttagacaactttgttgatgaatagaattctttttgatatgtatttcccatcatgcaattattaaaaatttcaaacttacaggaaaactgaaagaatttttcagtgaatacccatatatatgcacaatctagattctacagttaacattttaccagacttgctttatcacatgaagactacattttatcataaaatgagaccatccagccccaggcactgaaaattttcttcctagtagtccaacaatggtttctttaaatataagaaatcattaaacctatgggttttttttgttttgttttttaacgaagtctctctttgtcgaccaggctggagtgccggggcaccatctcagctcactgcagccttctgggttcaaccagttctcctgctcagcctcctgagtagctgggattacaggcgcgtgccaccatgcccggctaatttttttgtgtgtatttttagtagagatggggtttcaccatgctggccaggctggtcttgaactcctgacctcgtgaaccgcccgcctcggcctcccaaagtgctgggattacaggcatgagccactgctccccgcctaaacctatgggctttaattctatacctatgatagcctgcttatttaaccagagggaacaacacttatgttactcttcctttagccatcgagccagtgacagaagccctcagtgattgttctgggggacccagaagtcacaagaatggaacagttttgcttctacctgccccaattcagaaagctgaaatcttcttggtttataagacagctgtgacttctgttgggacctgctgaaacttgtcacatgtgacagtgtgtgccagattctttggaaggttgaataaaattttgagcctcagctggcgcttacagtagctgttcttattggatccacagaataaaaagggcacagagctgctgcttggagtggatgccctggggcttcacatttatgaccctgagaacagactgacccccaagatctccttcccgtggaatgaaatccgaaacatctcgtacagtgacaaggaggtaggacatgtgtgtactgcagatgggtccagcagatctttccctgtctgcccccctcactggagcctccccagccagggcatctccttgttattcatagagtcctttaattcccaggctttgagggtgtggttgttgattttcgaagtctttacagaacagtattggcatcaataaccccactatgactaataggaaactgggaagctcaactggccagggagaaaccccaaagaatagtgaacaaaaacagtaacattttcttattacttggctttctatttttgtcgatacattctctttgtatgttttcttttcttttttagagacaggatttcattatgcatgcccagactggatttgaatcctgggctcaagcaatccttccacctcagcctcctgagtagctactacaggtgtgcgccacagcacctggcttaaattctcttcgtattttaagtgtggtctttattgagctttctttctgtgtccggtgcttgatacatgtggcagagaaatacatatacacacatatacacatatggacatatatgtgttttgtgtgtgtatctctcagtaattatataaataagtatattaggttaatatgcttacaagaattccaaaataattaaggtggaataacttagataaatgctcttagaatttaaatatttccatatagggtggtgacttttaccaaaaaggtcccataatgtataatcttatgtttactcatccatccattcattcattcactcatccattcattcattcttcattcattttattttattattatcattttttgagacaggctctcattctgtcaccgaggctggaatgcagtggcacatgatcacggctcactgcagccttgacctccctgggctcaggtgatcctctcacctcagcctcccaggtaacagactacaggcgtgtgccaccacatctggctaattttttgtagagatggggttttgccacattgcccaccaggctggtcttgaacttctgggcttgagcaatcctcccacctcagcctcccaaagtgctggaattacaggtgtgagccactgtgctcagcagttcttcattaattttaaaggaattattgagcatctgctttgtgttagatttcatgggggaaacaaagatgtagaaaatccagtcttagcattcaaggaagtcaagtaactactcacctgctataataaataagtgccgtggaagagacatgatgacaacaaatgtagtcttccacatacaagcacattcaccctgaccgtctgaatttaatctctataagaacactgctgtaaaggcaggggctgtgttgtcaatatctctgtgtcacatcaggaagcagagacacagaaggatcaagtgacctgtgtctgagtgaagtagcagagattaggagccagagttgctgatgccacagcccccgcctttcagggaggcccagaggctgagtcctgagagcacaggggcactggggagagggaggctccactcagtgacctcctggtacctgcacagccaggacacagactagagagtgaagaacaggaacagcttatgttgctgcctgcagagccccaaacctgagcatatttcctgttttctctttttcatggcaactcaaggaagggaacaccaggcccctggtttccagtatatggttgggatctactcagccatgcttgataagacagactgagccccttaattcaaaacattctgactttgaagtttttgttagtagttagcccaggagataagcagttaggtatttcttttttaaagtacttaaattgaaagttccacatgacataaagctgtatgtgtgccaccgtatggtagtttttcatctcccaatttcataaagtctgtttattgcacgtccacacatttgtgtgctaaaggctccctaaacacccgttcttcaaagaagccaaggattgaaatctcccatactatggcctgacacagtaaactctaatatgccctctccgggggacaggcgccatcatgttccatcatgtcaataactcatgcagtaagcagaccccaagctgacttgacataaaagaagtagtcttggtagttatgcatgacagccatgctgtcaaaacagaaatgttagtttattttaaatgatccattgattctttgtgtacgccctggcatggtgcagagcctgcggtttccccactacttgtggtttcccaatgacagctccagggtttgacagcaaagccaaaaataagctcacaaaattcatgaatagcagcctacacaagagcaacactgcttctaagttaacttggctgaaagctaaacaaaggatcattttctgtcctcagtgtactaaccccttcttgggcaatataacgtgtgaaagaaatatatcttcccaaacatatttatctgcttagcaagtctttcttgggaatggatatccattttgtaagtgcatcttggaaatctaggatctgtttggtcttatcgggagtggttgagagcagcagccatttgttccttgcaggctttcctgctagtggtctaaccctaggttctcctaccaagccaccaccctgtctttatcattcatctttctctccattttgatttcagcatcaagaactgttttcccttctactatagtccattttttccccatttgattctattaacagcttttaccaaattattcccatgttcagaaacctgtggtgagctcaggtatcctgtcacatcaaacctaaacccttcttttttttgagataggggtctgctctgttgcccagcctggagtgcagttgtgcaattacagctcactgcagcctcaaactcttggcctcaagcgatcctcctgctttggccttccaaagtgttgggattacgggtgtgagccaccatatctggccgcctctgacttttattctcactgccagcccctacacccaccccttcctccctctcaggctaaacctattatatcatcttagtcaccaaaaagctaataccacacacacacacacacacacacacacacacacacagctcatttccctgtctctaccttatttctggttttgccctgtgcagaatgccccttcacctgccttttagctaccctgttggattgttcttctaagatcagcttcactctctcttgcttatggtggatctactctgaacctccacatatttgtgatttgtaccacccagtgaagcactaatatttgatgtgatttcttgagtaattggctgttgttagcctagttccaactagatggtgagcttcatgaaggtgggcccatgccctcgactacagtagccctccagtgttggcctcagggttgggcccattaaggatgcttattttaggttgtcaagaatcccttcccacactcatgcctaagatggtctagagagcgtacctttagggtcctgagcttccacagcccgagacttggtgctcctaattccctgaggtttagtgcctggatactgggaagccaggacaaggcataacttcatgctggtctgtggccagtgtggttgcgcatttgtggaatttccaattgctggtaacattccaggctgtcggactgaaactgtgttctgcttcattcttccagtttactattaaaccactggataagaaaattgatgtcttcaagtttaactcctcaaagcttcgtgttaataagctggtaagttgagatcctggttttcattactgataatggtagcttttctgagaattgaatacttctttttaaaggatatcagagtgacatcttgtgaagtatagaatggtatctcacttggcgcatactttctgtttagcttaaagagttaaaactaaattatatcatgaagaagtttttttttttgttttttttttgagacagagtctcgctctgtcgcccaggctggagtgcagtggcagtgccatctcggctcactgcaacgtccgcctcccagattcaagagattctcctggctcagcctcccaagtagctgggattacaggcatgagacaccatgcccagctaatttttgtattttcagtagagacggggtttcaccatattggtaaggctggtctcgaactcctgacctcaggtgacccatccgcctgggcttcccaaagtgctgggattacagtcatgacccactgcgcccagccgatgaggaatttttaaaaaggatttttaatgcagtatttcatacatataaaaggataagtgtaacatatgaattataaagaataacaaaagtgaatagctgtgtacccacaaccccactttaagaaatagcacagtcctggccgggtgcggtggcttacgcctgtaatcccagcactttgggtggccgagacgggtggatcacaaggtcaggaaaaaaaaaaaaaaagaaaaagaaaaaggaaaaaagaaatagcacagtcccaatactgttgagacccttcatgttaacaccctgctggtctctcctttccctctccccaagggtgatcactgttttgagttgagtattcatcatcctcttgcttttcaacagaattttatttcatatatggcaaaagaaaaataccattcaatgtcatatgtttatgaaatttatctaaatgctgtcaagtatatatattcttttgtcattttccttttcctttttcattatttttttgagatatatctttgttgatgcttaaagatagtctgttcattctcacctctgtagcactctgttatatatttttctgattcttctgttaatggataattaagtgctttttacttctatacttttttttttgaaatggggtctcactctgttgcccaggcacaatctcggctcactgcaacctccgcctcccggatttaagcaattctcctgcctcagcctcctgagtagctgggattacaggcggccactaccacgcccggctaatttttgtatttttagtagagatggtgtttcaccatgttggtcaggctggtctcgaactcctgaccttgtgatctgcccaccttggcctcccaaagtgctgggattacaggcgtgagccactgcacccagccacttctatactgttttaacaggctgttatgaaaacttttgtatctgcctcctggtgcacataggcaatagtttctttggagtcttgagtatactgggctaggtggggtggctcacgcctgtaatctcagcacttggagaggtcaaggcaggataactgtttgaggccaggagttcgagaccaacctgggcaacatagcaagaccctgtctccaaaaaaatgaaaataaataaaatttttaaataataaaaaagagggccaggcacagtggctcaactcctgtaatcccagcactttgggaggctgaggcaggcggatcacctgaggtcaggagttcaagaccagcctgaccaacatggagaaatcctgtctctactaaaaatacaaaattagctgggcgtggtggcgcatgcctataaatcccagctacttaggaggctgaggcaggagatcgcttgaacccaggaggtggaggttgcagtgagccgagatcatgccattgcactccagcctgggcaacaagagtaaaacttcgtctccaaaaaaaaaataaatacataaaaataaatcaaaaatagagcttagagtatatacacaggagtagaagtacagggcttggtatatgtttaaatttcaaaattatgacacattgttttctaaagaaggtgaatcgatttttacagacccaacagtagtgggtgaagtttgttttttgctatccttaatacttgtattatcagccttttaaaatttttgccaatcttgtgcatctaaaatggtatctcattatcaaatgaactttttttttttgagattttgagatagggtctcactctgttgcccaggctgaaatgtaatgacacgatcatgtctcactgcagcatggacctgcccaggctcagtgatcctcccacctcaccctccccagtagctgggactacagacacacaccaccatgcccagctaattttttgtattttttttatagagacaaagttttgccatgttgtccaggcttgtcttaaactcctgggctcaagcaatctgcctgcctccccttcccaaagtgctaggattacacttcccaaagtgctgagccaccaggtctggccaaatgttttgagttttttgtggagatggcgtctcactatgtcacccaggctggtcttgaactcctgggctcaaggatcctctcaccttggcctccgaaagtgctgggattacaggtgtgagctactgcacctagcctgttttctttattggctatatcttccagtttgttgctctttttctttttttatgtcttgacaataagaatttttaattttaatgtagacaaatatatacattttttccttaatcactttttgtgtcttacttggcatcttctcttatcctatgatcataaagatattcttctatattgtcttctaaaagtttcaagggcttaatctttgcatttaagtatttaatccttctggagttgatttttgtgtaaggtgtaagggagggatacaacttatttttttccacatgcataacctgttgcctcagcccagcttactgaacgagctttcctatcctccctggtctgcagaaccacatcttgatgtaggagagtaaggtgcacccagaagacatggtgaagtgtcctccagtcctctcttgatttatgatttttacctcctggcatatctgaggcgccttcattttgcatgtttccagagctgacggcactagaggccactagtagggctttggtgtttcactctatgcattcatcttcacgtttactgctacctgcaagagctcaaactgctatggcactagtgggccagtaggcagtgaagtaaatttgtggatattaacctttttgtctgcttctgtggccacagattctccagctatgtatcgggaaccatgatctatttatgaggagaaggaaagccgattctttggaagttcagcagatgaaagcccaggccagggaggagaaggctagaaagcaggtgagcacaaccttgttttaactgatgatgtcactgtgtggtcagtcctggcctgggaggcgaggagtggtcatgggctggcaggagtcttttggccgtggacatacctgctcttgttttataccttttggatcttcatttgccgatgcctacctggtgggatgtcatctctggaaatgaggaataaaccctaatagcatatctaaaagaaacatctctagtaatttctacgcttggagaaattaagtgtgattaacaccagtttgggatgaaatagccaagagtgcatgcatctatccgtccggctagctagcttgctttctttttttgcctgtctgcctccttgtgcagccttctccttttctaattagatggtgatagaatgccaggtggcatttcagtgcttgcggctggaatgctaatttgactctggctgcaattccccactgcaggtcaggccttatggcatgtcacctgccccaggaggtgccaggagcatctatcagcagactggatgatctgcatcattgttttctactcataaaccttctctgctcatggaaatccacacaactaatttgggccttactgctgagaatatcaattgtgtttttggataaactactagatagagtagcagcagctgcagttggctgcccgcaggacttgcaagctcagaagtgtaataattagtctgtgtgcacctttctgatttggatacattggagaggctggtcccagccctaggatttagaatgaaatgcccagtgtgctttcagctctctatctctttgctttctgaggtagtgggccacaaatgtgttctttgggatgctttcagggtgatgggatggatttgttggacaaagaaatcctactgagccagcatggggtcatagtggcagtttcatgaagagctcgtggcagtggctcatccctataactccagcactttgggaggccaaggcaggaggatcacttgcctaggaatttgaggctgcagtgagctatgattgcaccactacattccagcctgggtgaccaagcaagaccctgttttaaaacagaagcagaaacaaaataccaaaataaataaataaataagtaaataaataagaaggaggaggagagctttctttgacctttttcttagcagagcaaagcttagaagtaagaaatctgaaagtgtcagggaatatgcagtctgtgggccctggcagagaatagcaggaacactgcagatcggcactgcttacagcacagcagagccacaaacctggcatctgggcaaccacagatcaggtggacagacactgaccttggagccagatctgaaatttagaatgtgagtaagtcaatgacttaccttccagaccttagttttctcatccatcaggtgaaactaatgatataccttctccatctcagatgaagggacgtatattacaccttacagtctttgtatgcagtaaacttcttttgtgaataggaggtcttttatattggggtagaggtctcagggaaagtacagggccaggaactgaaggagattacctggcttttttttttaataaaagggtcttgttctgtcactgaggctggagtgcagtggtgccatcatagctcactgtaacctcaagctcctgggcttgagcaatccttctgcctcagcccctcaagtagctgggactacaagtgcatgctaccacacctagttaattttaattgtttcgtagagatcaggtcttgctatgttacccaggctgatctcaaactcctgggctcaaacattcctcctacttcagccccccaaagtgctagggttacaggcatgagctgctatgcctgcctggcctgactgggctttttctttctttctttcttagtttctttttttttaaaagaattgtagatatgtagtaagccaccttatggaaattgtaatatgatggaaattagagaacaaattggccaagcttttcattgacttacaaggagaaaattggagaagaactttcactgttttattgcttgtctttgcattatctttttgagcttgtgtgtgtgtgtgtgtgtgtgtgtgtgtgtgtgtatttggcttaggatttagaaaaagcagcagtcttagaaaccttgtatgaccagagtgtgggataagattgaagcaagaagtaattaaatgtgctttaattatttaaggcagaaaatagtgcagtggtcacttctgggttctgctttttgaactcagttagtaccctgggatcacagaggaatggcactgtcttgtgcttgttccccttattaagctcagcatgtggcccaattaatgcagtgatccagaaggcaagggaggtagtggtggctttgtgctgttgccttaaggacacggggctgtgtttcccgcctggctccctcctgtcctaggcctggctcaggagttgtctccacatgaggctgtgcaagtctgtgctgtggctgttgcagctcccccctgtgaaatacaatgtgtgaactattgatgcatcacgtagaatgattccatcttctctgtgggtcagaggcaagagtggagctattgttgatgaaatcagagatgtgagaggggtccatgtggattagaaatggtgagatggcttgcctgcccagatgagaaagctgcttatttctggggctctatctgagggaggaggtcctgcattgcatcccatcggccatggggcagagccacctggggtttcccaacaaaaagcaacattggcaaggtagccatttcagtgcaccgtgtataagaatgcctccttctgccaggcgcggcggctcatgcctgtaatcccagcactttgggaggccaaggtgggtggatcataaggtcaggagttcaagaccagcctggccaatatggtgaaacctgatctctactaaaaatacaaaaattagccaggcatggtggcgggtgcctatagtcccagctactcgggaggctgaggcaggagaattgattgaacctgggaggcggaggttgcagtgagccgagatcgcgccactgcactccagcctgggtgacagagcaaaactctgtcccctccaccaaaaaaaaagaatgcctttttctatccgggtcaagactcaacaggtttttattgtttgttcatttgttcattcaccactagactgtttttcaagtggcacagctttcaactctgcaactggtttagaaggacggggtggggggcaataagaatgaccctggctacctaaaggaaagggaaggaaaaaggtcccaaaaggggagactggagatggggcatctttgggcccttgtggcaccctaggtctcgagccctgtgattcaatgactgtttttcttcacccctcgcagatggagcggcagcgcctcgctcgagagaagcagatgagggaggaggctgaacgcacgagggatgagttggagaggaggctgctgcagatgaaagaagaagcaacaatggccaacgaagcactggtgatttctgaggggctggggttccaggaggctacttggggacttccttggcttttctggagcttggtctcctgaaaaccatgagttagcagcgtttgctttgaaatacttaatttcagctttgaaaaaatcagtgccttttcttttcacctgtgttggcagaagcagatttaggttgagcttatgtgcagccaaactccactttcaccacgaggttgcctttatagcagggcttctcagcctgggcactactgacatttggggctgaccatcctttgctgtaggaactagatcccagtagcagcacctcaccctccatttgtaacaatccaaaacatcttcagacattgccacatgtctcttttttttttttttttttttgagacggagtctcgctctgttgcctaggctggagtgtacagtggcacgatctcagcttactgcaatcttcacctcccaggttcaagcaattctcctgcctcagcctcctgagcagctgggattacaggcatgcatcaccatgcccagctaatttttgtatttttagtagagatggggtttccccatgttggtcaggctggtttcgaactcctgacctcgtgatctgcccgcctcagcctcccaaagtgctgggattataggtgttagccaccgtgcccagctgtacttttattttttttttttgagatggagtttcactcttgttgcccaagctggagtgcaatggcatgatcttggctcactgcaacctccgcctcctgggttcaagcgattctcctgcctcagcctcccaagtagctgggattacaggtgcgcgccaacacatccagcttttttttttttgtatttttagtagaaatgggttttcaccatgttagccaggctggtcttgaactcctgacctcaggtgatctgcccgcctcagcctcccaaaaggctgggattataggcgtgagccaccgtgccccacctgccacatgtctcttgcaggggacaaaaaactcctctggttctaaccactgatttaaagggaaagaacagagtttaagttgtttttctccacgtgaagcataagcctgagctgaggtgggtactcagagaaggtgctcttgttactccccatgggtgcagcccgaagggcccttctgaaaagttggggaatgtggcttgtcatttcttgtcagagggtcatggagggcactcagcagcagggccccaggagtccgagactctggtttgtcccatctcagtgttcaaggcagatctgggcgggagaacagcacatgatcccacttcagctaagagcactgtgccctccagatgcggtctgaggagacagctgacctgttggctgaaaaggcccagatcaccgaggaggaggcaaaacttctggcccagaaggccgcagaggctgagcaggaaatgcagcgcatcaaggccacagcgattcgcacggaggaggagaagcgcctgatggagcagaaggtgctggaagccgaggtgctggcactgaagatggctgaggagtcagagaggaggtgagggggcaccgggcaccagactggcgaggaggctggcgaagggccgcagaccagcctgccctgaggctgagctctacagcagttgtcctcaagctgcttgcccatcttctgggccgtggggaggctcctccttggctgatggtgactggtgctttatccattttggggctggcgctactggttgggcacaggaactcagttccccctccaggggggcctctctggtcatacttgtgtctctttgataagcccctgtccctctgatggccgtgtgtgcaggaaaacccctgagcatatccacagaccgctttcagctgaagagatgtgaggaggctctttgtgcatttaaaaaaagtgtggttcttttctgctttcattcagtggggctgcaggagaacagcagctgcctacctttaaagggaagctagtgcctgcatcccccagcctttcttggcacatgggggaggagggctaggatgatctctgtgactgggatgtcccactcatggccaggttgaaggatggaactgttgtctgtacttttgaaagactattctaggcctgcaaccttcagataaacactgacacattccccacagcttttggctctgttgatttagagcacttgaatttggcttttagctaccaaggtgcattcactacagttttcctcaccacgctttgcatgtcgttctgggaatatggttcctttttgcctgccctgcttcaggccccttactgtattcgggggtcactccctgtgcatgatgcaggttgggccaggtccctgcaccaggcctcacatgccgtgaccacctgagccccataggatgaggatctgcaccagggtgcgggtgccctcagtgactgggctcatctttctgctggagaaagtgggcacaaggcccactggtgttttatccgggggctgtgaagacgcagttcttgcacattctgccctttgcgatccaatataagaactttgatcctccaggttcttcctttgcccagctcactctcacccaaaaataaagcagagaaagctgctggtgccctctccagctcctctgtctcctggctgcagaaggtctggtttctctcattccccaccagttttcctgctcttccagtttagatttaccaactcaaacaaaagtcctcaggaatgttgtccttgcttggaagttctgatttcatgtaaatatccctgtctcactgtcctttttcacctctttgggtgccatcctcagggttagcccaggtccctcctctgcaggggtggggtggtgtcttttcctgctacctgccctcttctgtgaagctgacatctcatcctttccttgcagggccaaagaggcagatcagctgaagcaggacctgcaggaagcacgcgaggcggagcgaagagccaagcagaagctcctggagattgccaccaagcccacgtacccggtgagcctgggggccaccagctggggctgccttagtcctggtgatgttctctttcctcccggcccttcagttcatctggcggtgccttcagggtgaccattcaggcaaacacatggctggatgagaggtgcagagagcctgcagttagggactgggtagaacatcctggtctgccatttggctttggactagttagttgtctctttggttgcctggataacaggcaacagggccttttccagctctggaatgtttttctttttctaagtaatatagtcccaaattatcctcaagagaatttgctctcttgcctcttaatgctgagctgaatgtaatcttcaactatcagtatataccatatatcataattatagttctgggaagggattggctgtacacctcagagtgaattactgccgtgcaagaacgagcagccactctcagtttggggacagagagtcagacttccattaaatggggtcacaaaatgaatagaagcctctttccttcctttcttctgtgcattcagtttggcatttttttttttttcatatttgttcagtgtccacatagtgccatgcagttggaagtctctatcctgacaggtgttctcagggtgcacaggtgcctagaggaggaggacacagcccaccctggaggagcaggagaggctcagtgtggtgtctacactgatgcttgaagggggagcaggaagtagccaggtggagaagagaacatagggtattcagggtgagggcacagatgcacacatggcccagactcacacacagcacagtcatctacatggcacagacacacacacgtacccatacatacattgatgcacatagcacatccacacacacagcacggacacacacgcacccatacttacattcatgcacatggcacaggcacatacatgacccagatgcacaaagggcaccagaggcacaagctgcccagggtttgaggtggggaaaatgtaagcagtttgctgttgccgtatatcccggttctccgttactgtgtaacaacccacccaagccagctgtgtggctttgttagtacctctggtggcttgttgggttgactgggccagacagagatccttgctggggatctctctggtggtcacagtcagatggtagctgggactggagtcgtctgagcagtcaactgggctgaacacctgagatgtgttatgtttttattttttattttatttattatttttttttttagagagagagagttttatttactctgtcacccaggctggaatgcggtggcagaatctcggctcactgcaaccttagcctcataggctcaagcgatcttcccgccccagtctcctgagtagctgggaccacagacatgcaccaccacgcccagctaatttttttttttatttggtagggacagggttttgccatgttgccacagctggtctcaaactcccgagctcaagtgatctgcctgcctcagcttcccaaagtgctgggattataggcatgagccactgtgcccagcctatatgtgttgtttttaaaatatacactggagcaaagcttatacactgctgtaactgctctttcctcttagcagtcaatcctgaaggagatcatccatatcagctttttaatcatgttttgttgtgtggatggattgtaatttatttaaccagtccctcatggatgagtatttagtctgttttcttttgcaattttgaacaaaatgacactgaacatccctgaacacaaatcttgacacacacacgtggatatattggtagaataaattcttataatagaactgtggggtcaaattttcgattttgatactctccaaagaagtcataccagttcatgctctcactagtggtgcagcaactagtacgcgtttttgctgaaaatttttatgatgtgtaacatacacatagagaagtgcccaaattacaactgtacagtttgaagaattttcacaaactgaacatacccatgtacccagcacccagatcagaaaacaggacatccctggcacccaaggagccttctctcagcacccttgcagacggtctgcctcaggccttgagaatgtctcaaatgaatgttccaagcctctgctctttcccagacactgtcctagactcaatacgggatccaaggatgaaaaagaggcagattgtttgcaggaaacttgcaaatagtagaaagaagatacagccaaaaagaaatcttttacagggtggaatcgcagaagaaccattagagaaccgtaaacacagcgttaagggacagcaaagaaaagggttgccggctggctgggaggggctagaaaggctttggtgagagatcgtggtgtttgagaagggccttgaaagagggatggagcatagggaggagaaatgggataggcaggggtacagagatgggaaggcagtagtccaggggataataaacaatactgtctgtgacttagtagggcaaatagtaggagaagccgggaagctagattggggtcctctttagatgaccctttgtgctgggatgaaagtccaaaaaaaaaaaaaactacaccacccctgcttcaggccctactccggttccattgtccaagcccaagcccctcggtgggccggtggggagccctttgtggtggtgcccatctcccaccccacctctccacactgcatggcagactcctggcaccctcactgggcactgccccacccattgccatacttcccgtccggcagaccttctcctggcactgccttggatcccagcaaaagcagcatctcttctagcctctgttcgctccctggctacagtgtttaccttttttaacagtgatgatctgtgaacacatctatttcctgaacaagactttcagctgctcaaagccaaggatgctgtcttgttttctgcatctccagccccttgcacagggcctgggagtttcctaaatgaaaaagcgagtgggagtttgtgtttgattcagctgagcatgaagaacggttagagatttgagggatgattttcctggatttgtagtctttgatattgtttacctggcagtggcaaatgtggagggagtgaagtggagggatggggactcgtggtggcattgggaggtgggacccgagttgtgcccattgcctctgtggctgctggaggatcggttgtcaacacagtagtgtccttctgtgcttgtatgacccaagctcctaatccgaaatttctcattaacagcccatgaacccaattccagcaccgttgcctcctgacataccaagcttcaacctcattggtgacagcctgtctttcgacttcaaagatactgacatgaagcggctttccatggagatagagaaagaaaagtatgtagccccctgtgccctgctgtgggcagctgtgaactagactgagtgattggggccttgggaagctggggcagaggtgagaggtcgctgcagcagcctgtcattactcctgcaaaggtttgctctgctcttacaccctggaggaagaatttccttaatcagaaattaaggacaacagatcagcattcattctgaacgaataaaaataacaatttttatccaggataaaaataacacttgactggtgagctggagtttttggtggctctaagcctcacctaaagtgtaggactgggttgttagcatctctgagtcagttcaactgctgttatactactggactgtagtcacctcctagttgtgttctccagcaactgggatctgtggtggttcccatgtctagaacaaacaaaggtgagagaagagactcaggctcgaggctaaggaaagctgacagctggtggggccactttgctgcagtgggtggcactgggcagggccccagcatggcctgatcatggcagcaattgctgagctgccctccgtcttccctttattgtgggtagaagtggatcagagatggaaaggaaaggatccccactgcagaggaaatctaagcgagggcccctagttcccagagctagcggtaagttggttaactgctgctgcttgctagaggacaaccacagtagctaccatgcattgagtgcctgtgtgtcaggggttttggcttttgtctcatttaattcctgctaacttacaaacatcaaaatgacatcaaaggtaggttttcatgttcccattttataagtgagaactcagatttagagagtttagtgaactccaccagcatcccacagctgatgcagaggggttgaaacccctcacccatctgactctgcagcccatgtgcttttaccatgggtggtatcctcaggaaaaccctttggggaaagtgtctccatggagtccagtatgggcaaccagaacccaggctgtttttctttgggctctcacactgagggtatagctaagtagccaatgaaccagagcctctagctgtcatatctgctgtccatgttcctttcaccattatccagacatatacatttatgtggttgggatccgggatcagggtgaagctgttctgtgtctgctattttatagtttgtattttgttactatcttagtttgttttggctactgtaacaaaataccagaggctgggtagcttataaacaacagaaatttatttcttggccaggcacagtggctcatgcctgtaattccagcactttgggagtccaaggggggcagatctcttgagccaggagttcaagaccagcctgggcaacatggcaaaaccccatttctactaagaatacaaaaattagctgggtgtggtggcacatgcctgtggtcccagctactcgggaggctgaggtgggaggattgcttgagcctgggaggcagaggttgcagtgagcccagattgcaccactgcactccagcctgggcaacagagagacaccctgtctcaaaaaaaaaaaaaagaaaagaaagaaattgatttctcacagtttgggaggctgagaaggccaagatcaaggcacgggcagaggtggagtctagtgagggcattcttgctggttcataatcagcccctttttgctgcatgctcacccagtggaagggatgaggggtctctctggagtctcttttataagggcactaatcccattcatgaggctctaccctcatgactgcccaaaggccccacctcctgacactttttttttttttgagatggagtctcactccatcgcccaggctggagtgcagtggtgcgatctcggctcactgtaacctccacctcctgggtgcaagcgattctcctgcctcagcctcctgagtagctgggattacaggcgcatgctatcacgcccagctaacttttgtatttttagtagagatggggtttcaccatgttggtcaggctggtctcgaactcctgacctcatgatccgcccaccttggcctcccaaagtgttgggattacaggcgtgagccaccacacccagccggtgattaggtttccacatatgaattttgaagacacgaacattcagaccatagcacttcttacccttgcacatattggcagagtctctatactaaccatggcaatccctatggagtgtttttggtatttgtattgcatggtttttctggccatgccttgtagttggacactttgtgggtggtttccagattttcaccatcatagatgctgtcactcagtgttatctgttctcaggtgagggtggggatcttttcttccttgcgttgggtgagcttctgagtgagcttctgtcatctttagatgaagtctcagaacaagtgggaatgtggatgtggcctatcaaaagagatcacgtgaagctgggcgctgtggcttatgcctataatcccagccctttgagaccaggggttcaaagccagcctgggcagcatagcaagatcctataaaaaaaaaaaagagtttacttgaattactgctccaagaagggttgagacaaggagattgttctgggttcccaggaagcttgtttcacgtatgttttttttttgtacagaacgaaaagctgtccatgagagctggtatttgtagagccccctatgagaatttaccaagggcttttctactctttctttttctttccttttctttttttttttttaaaaatagagacagggtcttgctatgtttcccaagctggtctccaactcctgggctcaagcaatcctcctgcctcagccacccaaagtactgggattacaggtggagccaccgtgcctggcctcctacactgttttatttaatcctaaccacggccctgtgatcattatcccaattttaatgatgaggaaacattcatagcatttaagtgaccagcccaagctcccatggcctgtgagtggccaagtagagacgtgaaccccaggcctcaaaccctagatcgcacaccaagcagcttgtgggccgcagagcacctgagccgtgtctcactgtctgcccaagccctgatgcatgataccctcttgccggcagagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaaggtacccagggtctctttcttgtattttgctgatcaggaccatcattaatgaaatgtgcggttggcatctggtttcctcagtagccaagtcactagactattggcatcttttgtatgtacttagttgaggaaattttttaacttatgccagaaagggaatttaatctgccaatgactatgaacccattggctggatggaagttgagcttgtgttaaaagctctgatgtaatgaacccctgttacagggtggattttgagccctcatttagcagtaaagcataatgcccttttaagccaaggggtgttatacccagggagctgccttactttatgagaaagcagaatgaaatggaggctattgagaatggactttccctctagtcttgtggtgtctttaagtggcaaggactataaaaccaaactgaatttttaacttttttcatacttaaaaggaagtgtctaggaaagaacctctttgttttaaaagagaagactttattactttgcaaatggtttcatatctttctctactggtattttgagctttcagcattgtcgagattcagaagctaaattccatactaattatcagcccaagagcatacctctctcatttgggccaagcagaagggtcctctcataccaaataatgctctgctcttaactgatagcccaggaccaggttaacacctataaaataggtgttattaagataagactgtccattgagtttaggtgatactgatacagttaattttttattctttacctcagtctttaaaataggcttccagttttatggactgtctctgtttttagtggttaagctgtatctgaaaactccaggggatctgtttctgcctgccttcgttgttgggtacagtaggcagccctgacttctacctctcgactccagtcacaactggcaccgggtagagaattccttttaatagtgcaacctagaaggaaaggcatttccacattccacattcttctttcctctggcttctgtaatttactgggcttcccttccaaaacaaaattattaaacagtaaaggggagttcaagggaggcctcggtcattaaggaaagaggtaaaacgatggctgagccagtgagccagtcagcccttaaatgaactgcctcagacaccccatctcaccccttacccccagccttgtcatctgggtcccaggaacagtctcaccatttccactgctgctgcaatgagcagtgccctcagccacagaaacctgcagtgtgagagctggagagaccccgttccaagccattaaaacaaacaaaatcactcatcacgatttcaggcctatccaagcattttgcagatggcacttatggcattgttgatatcacagggtatgtttttgtttttcttcattttattttgctggtttagcctcaagcccaaggcagaagacctatctgcatttgagccctcaaagtaggttgttcccaggtactctctatgtggtgatggtgctgccctctgtgatactaacccgtgcatgagcttgcctgtctctgtcctcgggccacactgagcccttacgagggcaggtggtgcctgggtactggccgcagcatgctttgagtctaaaagtaggcacccaccctgtgaagccagaccagcctccagggccccagaagactgcctcgttccgaagagcatgtcatggggctgtaggaccagccattcttcccatctcgggtcattgttgggctggggaaggttatggcttcttgtccagtcaggtgtgtctaaaagtcctttgtcttggtggcatactcctagcatggaaatggggtcaatctgggcactttggagactggtgtgtttaactcaagatcaagaccttttatgcgttgacagcctctcaagacccatggtcacacctggcagcttctggtagtggggcaaaagggttgcttgtgctggctcattttcctttagagctttccctttctgcacacatcccttttcttttcaaataaagcaaacccagagcacagggtctgatatgtgagtccacggggagtggactgtctgttcatctgtgctcagccacctctgcttcagcttcctctccataggctgagcagagatgtggtcagagtgaactcacattggaacagtacactcacggcaccctggagaggagcggtcactggttgctgagtgaattaaccgaatgtttgctgcttttctcctgcaacagttcattattcctccagcatgcctaggcagtggagagaatgtattttgcccaataataaaatgacatcctgcctctacttctcacctaatccccagtagtacccatgccaacaagccccacaccacctgacagcagcataggatgtgtcctttggagtcttccctgcagtttctgctcatagagtggaataagctcattggaacctttctaacaaaaagagatctggcataagatagatcctacttgtggtcgttatcccatcaagagaggtcagctgttaaagtccctgatagatcttattaaaaggtacacttgagctgtcagtggttccaagaatccatgacatgaaccctgttttgtatgcgacactttcatttagcgggctcctgtttcttcagctttcatatccttgttggcattgataccctgatacagaacagtccgcgctctgagcagggcagttatggccagcattgtcacgggcaggccagctcatggcacccagagcagccaggtggacccaccttggtttactgaactttttgtaaccatgggggcaagcagaaaaccccgctgcatttcagccagtgctgccaggtgttccctccatgggaaggtgctgctcaacctgaatgtgacttcctctttcttctttctataatgatgcagaatgctgaaattcttcagggtcctgattttgactgtcatttctcactgagcttttactgcagacaaaagaagtttcatttttagttaaatttgcactgctcctgggacatacatggatgcatttatttattcatccattttaatgtctcgatgtgaacttgtttttaaagcaggctaccaggcagttaatcaaacactcgggttaatcaagggttaataaaagcagggacttgatgtttaatgggacaggcattctctcagcatcactagattcaataatgctgcactattaaattttgctgcacatgaagttcagtgcatgttccattttctagactttggcagtgcctgtggtcagtgaccgggactgatgagcagccacatgcctgcactagggtggctctggggtggtgcatgctgcagtctggctggcacaagcctagctgaagagaagtactgctttaggcttggatgtggggatacctagatgtcaagggcagaactccatctagaatgcctggggatgagatgcaaaagctgatagtgaatggaacagtttccaatgtccaaaagcttgctaatctgggatcaaaccagcctgtgttgatgttagttttgctttgttttgagacacggtctccctctgtcacccaggctggtacattctcggctcactgcaacctccacctcacaggctcaagtgatcctcctgcctcagcctcccaagtagctgagactagaggtactagccaccacactcaactaatttttgtattttttatagagatggggtttcgccatgttgcccaggctggtctcgaactcctgagctcaaccaatctgcccgcctctgcctcccagagtgctgggattataaaagtgagccactgtgcctggcctgttttgtttttaataaggttttttgtttgttttgttttgtttgagacaggatctcactctgtcacccaccttggtgacagcctcgacctcctgggctcaagcgatcctcccacgtcagcctcccaagtagctgggactacaggcatttgccaccatgcctgactgatttttttatttttatttttgtaaagatgggtttcgccatgtttccaggctggtctcgaactcctgagctcaagtgatcttcctgccacagcctcccaaaatgctgggattacagacatgagccatcttgcctggccattgtatttgtcctcgttttcagtactcttctgcctcactgagaggtctcagagtctgctgtgtggtttcagcagtacccatgggggctgtgtaacattgaagctgattcaaggagtttgcccttaggttaccaggggttaccgcattccctgaggaatgctgagcggccatccagtctgattaaccgaggttcctacttctctgccacttcctttctctataattcttactcgctcgctctctctttttttttttttattatactttaagttctagggtacatgtgcacaacgtgcaggtttgttacatatgtatacatgcagctataaaaaaggatgaattcttactctctcttgaggcacagtgtcctcacctgcaaaaggtggataaaaatagtctttgcccccaggagtgttgtgaggaataaatgagagaatgtgtgtgcaacactcagtgcacagtcagagctcagtaaggggttaaaactctgaaaagggaaaatctgcttgtgatcctgcagcaaagggcgaaggacggcatgtgggccacaccgccacatctaggtacactgcttgtgctgggcatattcattcattgtattaattgctacgtggctgaaagtaaaaacttttaaaaagccataattggccgggcacagtggctcatgcctataatcccagcacgttgggaggccgaggcaggtgaatcacctgaggtcaggagttcgagaccagcctgaccaacatggagaaaccccgtctctaccaaaaatacaaaatttgccaggtgtggtggcgcatgcctgtaaacccagctacttgggaggctgaggcaggagaattgcttgaacctgggaggtgggggttgcagtgagccaagatcgtgccattgcactccagcctgggcaacaagagcaagattccatctcataaataaataaataaatagccataattaacttcactgtttccttgtaatatttcacttgggtttgcaaggatgtatttttctcctcttgctaatcttaacttcctgtatttccatttttcccaattgatgatcagtacaactagtttgccatttgcatctgagtcagagcagtgctagcgatcaaaagccgccctggggaacctggaattgtttcattctcagtgggagcgacacgtgtcctggcatctgagccttccgagtgaggggagtgagtctggccatcaggctggggttgagggacacagggtgccttgagcctggctttcgtgccttcagagccacagtgccaatgatgggagtggtggcttggtgtggcgtaactgtaccaccataccttgatggtagaatgcagtcctggaatatatacattcagggtctttctttcatcgcttctcaagagaggggtttcagtctcccgatcctgagctggtctgagtgccagcaaacaaagtcatcacttttgtgcctgtggtctcccaaggagcacaggatttccaaggaaattgacggatgagaaatcatgggggtggtggagcttagaaagcttatttcattagtaaatggtttgaaccgtcaaggtccagctgtggtttccactgatggaggaacaggaagaagaggagccttgacatttatctcaagcgccagcagcttctcttggatcaggaagacataaaagtccaatgtcatcttcaatttgtgcaggctccccttggagttgcagagccagtgaagtgaagtagaacagttaaaaaaacacccggggaagtgataaatcacagagagagattgcatatgcgggaaaggtgtctcccacaattaaaacaagtggccagagcctccctggcgacctctggtctgcattgccagccctgaagatggctcctaaattacttaagtttaataggtagttaatatagccaaccctccttatgaccccagtgggctgaatggctctgcttgctttaggaactgggcgttgtatggtagagcatcttggccttgacataaaaggtagcatactggctccccagccctgaaccttccctgctagagcaaggcaggggtgagagggggaaggaaagaaaaaggagtggggagtggggtggggagcaaggattaacagggagcagtagcagcaccagatgtgggcatagcacactgggaagaaattgcagtggcgatctgaactcttcctctccgcctcctggctctgtggaagcccagggaaggcattaggaactgcaggctgctcttagtgctcctcccggatgggacaccttgggctcatccctgaaggccactcctaccactctcacacactgagttcctggtgtctcgtaactgttgagagcttagttttcttgcttgtttctggtagctctagatagaagactgtatcggcctcttctaaaagtcaacaagccaatcctgtttttggttaagagactttacctggtcaagcagttgttctttgggaggtgttgaagagcctacaaacctgccttgcctgcctaggtactttaccaccatttggagatgcctgaggatattaccaggccttatttgaggcagtaaaacaccctgttcggcccctcggcactgaagatgtgtttcagtgcagctctcctcggcaccggattcgttgctgcaacagtgggagggaagagccagatgcaaactcgttctgcgagcccgaggttctgttctcatgatccttgctgtgatttctcttttgatgttggcaattttaaaatgacatcagtctatctggacctttttcctaaggctcttgctcagaccactcagtagatagccgccacctgcccagtgaggtgaatcaggcccattaggccatttgtcaggggaaggaacagaggagcagcggagggccccgccggccagtgccacagggcagcctgcaaagcaggtagacaggttttcaggcagcttttgctgctttgggtccctcagggattaatacacaaaaagggccccttgggtattcagtggcagatttctcttgagagcagataaagtcgctaataacaaattggatttgttcattggggtggacttggcctttcgttccacctctgtgtaggataagtgtgtggatagtgctcccactgtgcacatcaccatatggcatttgggtgcagctgtccctagccagactgcagaaaagcttgatctgggccggacgcggtggcttatgcctgtaatcccagcactttgggaggccgaggcaggcggatcacgaagtcaagagattgagaccatcctggccaacatggtgaaaccctgtctctactaaaaatacaaaaattagctgggcgtggtggcatgcgcctgtagttccagctactcaggaggctgaggcaggagaatcacttaaacccaggaggcagaggctgcagtgagcggagatcgcgccactgcagttcagcctggcaacggagtgagactccgtctcaaaaaaaaaaaaaaaaaaaaaaagagaaagtaaagaaaagcttgatctggccacttagtacagccatccccctttactggcccttcctctttgcttatttggaagggggaaggtttcccacaccccaaaccaaagattcttttggaatttgctgctgctggattcagctgtcacctttctgctctgagtctgctttctccctgtggatccggtgccagaggatctgcacgtccttttgtgtctacaccctcccccgctccttcgttttcaatatgtagtagtggagaggaagtgtaacatgattttagggctcacatttcaattccactgcatttttatgggacaagcagagacccagcgcctggagttattaggttagtatctaaaatgggttcagtactgtgagtcttattgtttaaaatgaatgagatggtcccctcctaccttcttttctcctcccctgggatgagtggattgaggcaaggcccccagagactagttgaaggaatcctggtgctctgattagttttgttccccagcttaattgtacagcttcctttctctcaccactgatagccaaagtagctctgtgtctcccccaaccttcccttgctttaggaacaagatgatcacaatgcagccttgtgaatcaattttctgtctgtgctgatgaaagtgtaattcattcttaatcaagcagccttgctgctgcaggctccgtgccggaatacatttagttaccctcccatcactttgggaaacgatcccccaaaagggcttttagaggagagctggaaggagagttggccgtgcgcctcatgctgtggttttccagcagggggcactcaggaacgatgctggcggaggctttgtagctggaagccgtctgctgctggcagggcagcaggagaatgtttgtcacaggtgccttccaggcttgctttctccagaccctggggccatttctcagaagtaccctaatgggccacccaaaatcctcaggtagcagtgaggaggaacagttgaagatgcagattgcatgcctgggttagagagtgccggctgggtaccaggttcttttagccagcctcttctgtctttttaagtagacagatgtgtctcctgaatctgaacttgtttagattgggtggatgtgtctgtttttgtcacaccacacacaatttggggagcgtaaggaggcccagctctgccagaatggaactctcctaagttctcccctgccgtctcacagcctgctggctgtcacaaacagctggcagttttatggacaagtgggcaggggaaaagggaccctgccggggctgagtctcgatgttgggcaggaagtaaaagccaggacccaacaagtggatcagaggggggatgtgaagatgaacagtcagatagcaataaagcctcatagatctgccccagagaaagaaaaggaagttcgtctcctcagaatggaattggattagtgacagacttgagcagccggttcagtcgagagagaacttaattcctcctgtgttattcacacggctgattctaatcagatgtgaagagacagctggaggagagcagcgggtcagcccatgcctggtgcggaggcttcatgttcttgtaggcatcttcagggaactggcaggagcgctttgggttggagactctgagcagggcccttgggtttatagcctgcccaaggaactgggcctggctgcgggactcccatggttggaccttgtctagattcagtgaaagttttgaaggacagtgcatgacagacgtcactggtcaggttcaccagagcttggctcacttgtcttcagaaggattcaaaggcagttgaccagacttggcaagtcccagactggtgcagccactgtcctcgagaccctggttgtacaccctgaggtgcttctgcttcattacctgctgaaatttggagacctcttcttcctggataaccttcaagatactcattgtgcatgcgaggaattccccgccctcctggggggactccactccccaggcaggcaaggttgggcaaggggagggctgttgctggattgccaaagggagcatggacatttttgtttggaattcagggtgggaatgggactcaccagagtggcttcagtgctcaactcacagtgcaacataggacaaggtgaaggccttcttgggaggcctcttctggctctagcaagcaggtgttgctgggcagtgtagagggacccaggccggttgctgagcaggaagatgtacctaacactgatgggcctgcacaccttagggtatgagagcatcgcaggggaaccaggaaacttgttagctggttttcatgtgtttaaaaagaagactcggaggcagagtttattttatgaagggctagctttttgccatttcttctgagcttttgccttttcctttatgaatacttcctgcctatgggtgtactgtaaatgtaacagccagtgagctttctagaagcagcagatggtgaaagatccacaggtgaggagcctgcccactggaggggcgagacagtgcccaggcagggcgtgcaggtggcagagctgtttgcatgctccgcggggtggcttcccaagctctctgtagaaaaactgcctgagggcaaatggctccactgagctgctacctgcaggaaagaagctcaagggctctcctcgtctcactgcctgccttcttcacctgctgggaggagggcattgtggtgtctgagataaaggatacccccaaggtggaagcagagccatgggggtggcctccagcagcagggaggagcattgtgcagtaaattctgactccggggctcctgtggggattggaacccataggaattgcacaatgagggtaaaggatggggcggcagcagccaggtctgtctaaggggcgagcagcagtggccgaaggctcccagggccctcgggcagcagcccttgctgaccagtgcagccaggtcgtggctgcctccagctggtgggtctgccttcccctctgaccgcctcagtgccttctggaggactgtggctctctctcctgcccagtggctgtggtgccttcctacttctgtgtgggcagactgatttccctctctacctttacttgtggctgaggcgaagctcctgctcttgcaagataagaggtggggctgaggcgctgcagtgcagctcaggtggggctcaggaagcaccccacccaccccagagcactctgcatcctaataagcacatgctcgagtcactggaatctggtgctgctggcagtgccagaaccctcccctagcacctcgaggggacagccagcatgctcctcgggtggaggatccaggaattcttggagccaacattgcacaaatgggcaggagcctctcaaggcccccacagcctgggctccctgcctggggaagtggccaggcttcataggggcatcacttggcccgcctggtaggcatggaggccagtgccatacgtgaccttgttgttgcctgcaccccttcctaacgagcaccctgctccccactggaaggagaggggccagggctcctccctccccagggaggggagaaacgtgatgttgctattagcaataacagctgccgagttcccaccatgcgccaggtgcagtgttgagtgcatcacacgcggttcccaattcctctgcctgtcaccccacgaggaaggggctgccatcacgcccgcttcacagtgaggaactgaggctagaggggagcaagtgacctgcccagggccacacagctggtcagtggcccagctgggccttgcaccaggcagctgactgtgcctgtatctgactcaaagtggctgttcttttcagaaacctgagcggagatactgggctcacatgctttcatttaaaccctctctcatttttgccccagtagttatctggcagctaaatctcttcctcctttcttccccagtgaccattctggttcccatcatcacagggcacataactcctggcccttctcctctgattacatttagggagaagcccatcctgatgcagctcccttctagagggagttccatttaggcaaaaaagcgctctccattcccatcagaaccgggctttccaaagggctctgaaattggttccactgaagaaggcagctgagctgcctccccacattccgcttgttagtcgggaacttcaaggccaaaagatttggcaggatttaaagagttgctctcaagctgtctcattctgagcacactaatgctgtctgtcttctgatggtgaagtggtgggtttggagtctccctcccctgccctttatggagccgccgatagtaccgaggactcttcacatgcagactcgaggggtccagagaatgggccagaccatcttgcctgccccatggcaacctccagaggaaagaggctcagagaggtcaggggtgtctgcagtgagctgctgatggcagagagtgagctctcggaccttctcagccgggtgtggagctcttgcctctcccgcgaacctcagtttagttatcttcatagcccacgtcctggtcgcttaacaaacattgagctcctgatcggcacataacactaagccagatatttgggggatatgaagatgaatggtacagactccctcccctccacccccgcactcctgtgggaagtcccggagctggaaatggaacacagtcacacccaaggcattgatttcaggagtcagcagagagcagggagtagggagagtgctggctccagatgcttctatccagggagatgctgggaagtggcccagagtcaagggcttaggaggttgcaaacctcactatgccaagagctcggtccctgatccaccccatccccttccacatctccctgactgtccttctttacatttgctgggcagagtgccacctgtgtgcaccagccctccctgcctgcacaagccacactgagaaagccgttgcctccagctcatggagagaaacaccttctcagctgccacgtcatgagcaagtttgcttcgggaccacctgggaaaccaggagtagaaggggtaaactcttcctcatctgccacaggcctgccttgcctcaggccacgtcaccttaccccagccatgttgccagggcatgaggactaagatgcttgccctgccaagcccggaggggatgagcagcctcagctggtgccgccacagacagcacaccacagaggtggctcagggaccttggtagatgggaatgtgagaatctattaaaataggcagggatctccggtcctctgtcaagaggcaatgctgacggctttttcctgctggcgtgcctctgcccaccagccttccccttgcacatcctcatttgtcacctcctaatttgaattattgggcaaatctggccgcttatttgggactgacagccaacttcttgagcatctatttgaacagccttccctttcgctcccagccacctttgaggtgagtccaagtggcaggacaggaccctgtgtgacagagcggaggtcttgtgccctctcagcttcttctctgctttcttacagctcaccttgcagagcgccaagtcccgagtggccttctttgaagagctctagcaggtgacccagccaccccaggacctgccacttctcctgctaccgggaccgcgggatggaccagatatcaagagagccatccatagggagctggctgggggtttccgtgggagctccagaactttccccagctgagtgaagagcccagcccctcttatgtgcaattgccttgaactacgaccctgtagagatttctctcatggcgttctagttctctgacctgagtctttgttttaagaagtatttgtcttcctttgtctaatgtgggattcctgactcccttcgtccaaggcaccggtgtgtgtgtgtcttgcactccagagctgacctccaccgcccagcctgggaagtcattgtagggagtgagacactgaagccctgagaagccagtgccatcatccccaccccgcccagggttccggaacattcattcccccaccggtgaggacctggcatgcagcgaagcagcccagcccggcggatcccaggccagcacgcctgccggcttctcatcgtcagggagcccgcccagagctcgtgacgagcaagtgctgggtccccgccaggcaccccgaggcggcgctctggctggcagctggtggggaataggcagggcagctgtggctggggagagactttaggcagaagctgtgatgcaggctgactgccagccgaggggctgggtagtgccgtgcgggagctgatggtacagggcactcgctgtccccctccggccaccctagaccagggtccgagaggcaggcaggagccactcatgtcttccccattgcccgacgcccatagacgctccttcctgtgtggggctggggtactccctggtcgtactgcagtcagcacccgtaacccggctatgaccagggatctgtaagccctgtggctccacaggtgctgcttctcactggcccagactctgagctccaccggcccagtctgcacggcccatctgcttcaccttccctcccagccacgtgccagtggccacagcccacttcccaacccactgttgtacccaggcctcactttgctgttgcccttgtccctcttcgggccctgaattttctgttccctgggggccagccagggccctttgtgcccctcccagcacaggcctgatgcaggtgtccactcacaggtggcgctcacctaggctgtcacaggacccacctccatgccaggcaacagagggccacagaaccacccccacggctcactccttggtctggggccaccttcttgccctttctttttttttttttttttttttttccgagatggagtctctctctgtcacccaggtgggagtgtggtggcacaatctcggctcactgcaacctccacctcctgagttcaagcaattctcctgcctcagcctcccaagtagctgggactacaggcatgcaccaccacacttggccaatgttctgtatttttaatagggacggggttttgccatgttagctaggctggtctcaaactcacacctgggattacaggcatgagccactgcacccagccccttcttgccctttcttttctccatggctgatgctgctgtggccagccagggcccttgagatccttccagtttggctgttatgcaaagcaggtgatttgtcttaatcagataaaagatagaggctatgggggcctcaagatttttggagagcagaggtggtctctggcaattccatctggttttgagaaacttagcagctcacagagcacagagatcctgccttcttcctactatcaggctgacctaatggggttgggctgctcggcaactgcttgggtcaccttgccccaaggaaaccagccctgggtgccacccagccacttagggtctacagggtgggactccagacctagagcgtaagtatggatgttgtggccctgtgtcttcctagtgtgacccagccaggagcggaagcttcaggcgtttgtaaagtgaggtctggctctgcctcctccgttttttttttttttctgtttctgtttctgttttttttttgagatggagtctcgctctgtcgcccaggctggagtgcagtgtcacgatctcagctcactgcaacctccgcctcccaggtacaagagattctcctgcctcagcctcccgagtagctgggactacaggcgtgtgccaccatgcctggctaatttttgtatttttagtagagatggggtttcgccatgttagccagactggtctcgaactcctgacctcaggtgatcctcccaccccggcttcccaaagttctgggattataggcgtgagccaccatgcccggtctcttctcagtcttgaagcccatccctggatttccaccaggagttactttcctcctgacctgtaaatttgttctttaacaatggctgcaggtgggagcatatggtggtttataaaaacgctgtcgggctttgtttccttctttagctgccgtgtctacttctgaagtctgggaagtgccaagccacgcggcctcaagggagctggctggtgtttgagctgtggcagaagcacctggggctccagggagcaggctgggaactgcaggaccttgctcagccaggagcacttccccctccttgaggcaggaatactgaggtgcctccccacagatggagaaggtggagaggaggatgggcctcaggagcatctcaagccccagtagcaggagaaagaaagaaagagatgcctggttttcacagactggttcctgtggctgggatgactgcatccttttttttttttttttgagacggagtttttgcctttgtcgcccaggctggagtgcaatggcgtgatctcggctcaccgcaacctccgcctcccggattcaagcaattctcctgcctcagcctcccgagtagctgggattacaggcacgcacctccacgtccggctaattttgtatttttagtggagacggggtttctccatgtcggtcaggctggtctcgaactcccgacctcaggtgatctgcccacctcggcctcccaaagtgctgggattacaggcatgagccaccgcgcttggccagactgcgtcctttttaagcgaacattttagggcctgggagtttgtcaagtaaggaagtctcaagcccaaagagcagcgtcctgaccatggtggtttcattacgagcccttctgctggctctcaggcagaagccccacagcaccgggaccattcatgaggtcactgcccagctcatgatgtccgtgaggctgtccttttggccagtagccgtgtgcagctgtgtggcacagatggcttcgttcatcctgatcaaggccccacctcagccacagcagtccccccaacctgtgttgtccaccctattattcatgtacctgccaggccctgctagatagcaccccgtggcattacataacacttcatgagtggctgtgtcttgtaattttggggacaggtttctctctttccctctcttttttttgtcaaaagcccagagactgacaaccagctgcagtgtctaagtgttcctcactgacagggtggggcctcaccacccctggagggagcagcgttggcagggagacagcctggcccagtgaccctgggcccaagccagcccctccagggctttcagggaagcgccatccattttcaaagatgtcaaacgtcacttcttcctgtagggcccgagtcctgcctcctatcagggccagatcatagaaggctattttctattctggggaacgattataacttaaatgattgttttaataaaaattctaagctggaaaa

SEQ ID NO: 25 - DNA, 73984 bp, Homo sapiens
acccaggagggctgtgctgatagcacgttcctcgagtttactttgctttccttgagtttattgtaaaggggtaaagttttcggatccgtcacgtgaccctgacaggtcctgcctatggcgcggcagaccacccacgccgagggccatggaactgcttaatagaaacaggcttgtaattgtgagtccgcgctgcactccgccgaaagcctccggcggcccagcgcgccggggtttttacactttccgttccttttgtaaagacggaggaggaggagaagaagaagaagaaaacggaggagaagaaaaagacgacaggggagacaaagagacccgcagcgacaaggcaagggggagacgagggaagactgggagaagacggaggagcggaggacgaggaaaggggggccagggaaaaaaaaggaattgatgtgaaatccaagcccagcgtccgcgccatcggcacccgcgctccgagcaggggttgacggccggctatggtgagtgcagccagcgcggcggccgccgacgccacctcgcctcgcgcgccgtgctcctcgggcggcgcggggacacggggacgcgggacgccccgcgcggcggacggaggagcgagccccgagcgccgggcaggaggggcgggccgcgcgccggggccgtggagccgggtgggctgcgccgcctgggcgcgggagcgcgggtcccgcgcctccacgctcgctcgcacgcccgggcccccgcccccgaggccagccccgcgtggcggggagggggctggccgcggcgggccccggctgaggaacggctccggggggaattctcacggagggggtcgccggagctcccattttcacgcctgaaagggtcgccaccttggcttccgctcatcagcctggtggtggctactgactcgccagcggaggcagagctggtgatggaagggctggtgcggagagtgacagcgccgaggggagggggctcagagcgcgcgcgcggaagccgctgccgccagctcgcgggagcagccgcagccgcagggaagggcacgctcgcgccccgcagacccgctctcgagcccgcacgcacgcctaggggtgcgggacacccgggctagaagagacgcaccttacccacctcccctcccatgctgcgggaaaagggccagagaggcttttggagttctggaaggggcggtgggtaagagaggtggtgtgtgtgactcttatgcccaccgattcaggcgcttgggtggctgccacccttacagagatgggcgaccagcccagtgcttagagtgcagagtgcggcctcaggggagcccgggggcgggccggaccgattctcactttacaggcccgggcccagcgctgaaccccaagacccccagaaactgtgcctctgggtgacatgcgctgtgtctccacgtatttagtacgttcatgtttaaaatgatgctagcgtgtggatgagcacactctcagggaaactgatctgtttccatcacctaagaagaaccatatgggtgggcggctgtggaagacacccacagacctgttttcctgcacctgggagagaagaccgtcttcctccctttttatcctttcttcctccctggggaggagaaatacaaaagaactagacataaataataaagagccacaatgggtggctctaaatatttgataattggatcactgaggtcttgaactaccacaatagtcctttttcagcattctgtgtgtgtgcatttcttttaggtttttatttatttctgtgtttattggcgacagtagttcagcatgcaattaatcgcctccacaaagaaagacaatgctttatggtgtcatcctttgttattgcaacttaaaatttctgggtggtactccggataaattgttgcctcaggtgcatggagtgcccaagttgtaaaacaaggggctttcgattgtgagtttatgtgtgttccagttgtcacccagcttccttccacaaggctataaaatgcctttgagtccatgatctgtttcaattaaaatgttgaatcaaggtagacatcaataggccccgccattctcaatttggggtattagcttcatttcaaactcactgtgagtggtgtatctaatttctggttataaagtagtcataatctttgaagctatttgaacaaaacttagaaccatttggaattattttctgaaaagaaaaaggctgttttacaaaattatcttcaactttctacagatagataaactgatgaggttaatcaatgtggattaaaatatgtctcccgtttttatcctcattcctctctctctctcacacacacacacacacacacacacaccttttattttctccagcctctgccacagtgtataatgccctattgagacgtgtaggcgtgatgtgtaaaccggattagcagtatgaaagaaagacacacaataagctggaattgttttacttccctttcatttctcatgcctatatttctgataaatttgttgctccagcagtgggtcaaagggatcatgttgctcagcttctttttcatgcaggacccaatagcagagatcactgaaatgaatggtgtgcctcctagcaaacgcaaagcttgatagagatatattagacagggagaggcgaggagagggaaggatgcaaaacatgttcaaagtctgggtgttgtaggaatacatctctatccatgagaggaaagcaatgtgggtaagaatatatttggagagagagggatcaatgcaggggtcaatgctctgttttctttcaagttcatagtaggctctgaacattcagcagttggtgacatgcttagcaagagaataccaatagcttttggcaatacataaagtctaattcccctttcaagctagtatttagacctggagtaatcaatgtggagatttctgggaccttctcaggacactcccctctgccgctttccccacccccagctcactgtaagctcaaaaaatgccagtgctcccgggtttgtgctgtagacccctcatttactcctttgtggagttaggagcagcttcccattaaaggagatcaggggtaattagcagcattattttgacaagttggctagagctgttccctttcctccagcctggggagggggtaaataaggggaggaaacagaaggtggaagggagtaggggaggggagtcaagcccagtagttttaaattttgtagctgctgaatctccccccaccccgtccccgacttccctgaaaccttttagactcattttctaccatcaccttttaagaatatacaaaagctgccaatgagaaaatagtaaggcattcttagggagccaagaaaatgtggtggatggtggcacattggcttgagttgagtcgactcaactcatattcaaggtacctgcttggaactgctgaagccctgccttgaccatcactcacatcctgtatcctgggctccccatgcagtaaaagaatattgcatcaaatccccaattcctctctccatccgaccctctcaacaaaaatactgtaggacttaaaatcatgtttgcaattccttgtatttctggaagagtattaaactcagtagacaaaattataaatggccccagggtcaaattactggaatacattaacccctttattcatttatactctgcaaaacttgccaaattacattggattttaaagactcatttggtttgatctgagaaaccagtgaaaagttaaatctcactgtggtttttcataactccaccaagtctggcttccacaattgcttaccattggaacatcccaacacaaagggcagatgttttatttcattgtcatcatttggataatctgatgtcatttttgaaatgtgtgtggtgtggccatggatatttgtagtattggaacagagaagggaggagatgtgagggaatccggagagcttaaggcatctgctttgaaaactacacactccaatgagaagtcttggatcatgactgggagaccaaaatgacaatttatgcattgagatgaactttacttggaaaggggaaatggaacactcagctgttgcttcataaaggctggcaactcctgctggctgataaggccccaagttctcacttatttttatttggtaactgtcacaaggggtgccagaggcagaagggccatttaaagggactgtcttcccggaggacaccttagcaggtctggctgccccagtctgcatctcagatctgtggaatccttgtggttagttgaagttaacaaacccggtgtggcacagcagtcccctgcacagggcatgcatattaaagccgacaatgcttacaaatgtaaataagggcagattgattaggaacaacattatcgctgggaatgtcgcactcgcatgcatcagcaatgaggcaaattgggggcagcctcagccctgaccacccaagtcgagcaggcttttacactggctcctcttccctttcttaaaacgttacagaaacaaggccaattagatcctcaaagtaattcatctctaagtatgaaaaaagcagaccacaggggaagcggcgggtggggggtggggagattaagatagcgctcgttagagccgaggctccggagtgcgtcctggaacccacgggtagaatttacaggccgggaccattgtctgagatgctgaaaagttaacccatcaaacagcgggcgagggggctcagggcactgaaagctccggggatcaatgttcaaaacgtttaggaattaagtcaaactaagggatatgggcctgagtggaagaggctttgccactgaaatgacgtgcatgtggcagccgccggaaccagaggacatgcagccgcgtgcggagagtgaggcggatccattacgggcacacagcttaccatttccttccagaattccttcttccaaacaagctatactgaaatccctctagtaaaagattgagacgaaacactaatagttttgggccaaaacgtggtggagaagtttgaaaagacaaacatagcaacgtgtctttggctatatggttccttgccctccagcaagcttgaaatataaaaaggctaacatgcaaaactaggggtactacccccctcccccagtttttaaaaagcaatttccagaagcaaacacacaatggttcgacttgaagtgtcggcataaccattcagtaagaaaagctagaatagtaaacctcttttcctgttttgtgctatttatcaaacctaataaacatcaggatcgtactcaaagatgaaactggcaatgtgtggagccgtctgagctctttatcaactcagtgtcattttcctcgcatgctgcccgcctgctttccgagtttccgcagcccttccctgaggcactcacaaaatcacgtgctccttaagcggtctgagttttgaatttccgcgctggcccggtgctcaggtccccctccggatcccgcgaacgcccccaaacacctccaccccgtctccctctcttcctcgggacatcccgccctgaccccggcaccgcatacggtttgcgggttagggggtcgggggaagggcctccccctgaagccggggaggaggagaggctggagggaaggtggccaggctggtgggggaggggagattgagggagggagcggggcgagggaggaaggagaaggcgcaggccgaaggaaggaagcggggaggggaaaccgccggggaggaaggaagggggcggggagagccggcggacgggccccctgcgggagccgcgtggaccgccccggtggccggcgcgccccgccgcagcccccagcgcgcccgggcagccagcgcggggccgctgaatgggcagggactcgtgagcgcgaccattggccggtcgcggggaggcggcgcgggcattgggcagcgtaagggggccggtccgccttcaggaatgtactacggcgcgtccggcacgtccgtccgcgccggctgggcgcgcgcctcgcctgggctctcgggagaccgcgctggaggcccggagccggcccggcgcatccgcctccctacctactctgccccggccgcgcgggcgcggggagtccgggagccgggcgcgcgcgcgcaccgggcctcctggcgcggggtcacgtggccaccggagctccgccttctccctgctcctccccctttccctccatctgggtttctttctttcctttcctttctttcttctttttttttcaatgaacatacaccgtgcgcatcttaaagccacaccgccccatttcacgacttcactagacttctcgctactgccagtccctctgcagttcaaccccgtttaaaaaaaaaaataaagtgaagcaaatcaagggtttgcgggtcgggttcctaccgcagggaggaacgtaataacttggaaacgtaagaaaaacacattccactttccgaaaacaaaaatttttttaaataaaaagcctagttgtgtagacgtgtctggctccagaatccacctcaaagggtcgcgtgttttccccctccgcgggaagcgaatccccgggatgccttggtgacactggacgcggtgtcgggacgaatcctcgcgatccgcgcacagtttgttttcaatgaatccagcatcggggcatttataatctcctacgtcatactattattaaatataacatgcataccgagttttgtaaaaaaaaatactgactatataaacatctggttaataaaaaggggtgtacaaatgaacccaaaataatcaggaaaactttactctctcaaggaaacaattccgtttctctaagttgtaaaaaaagattctgttgtttctcttttacttatgtcacattcgagattcaaataaaaacgcctctgcctctacaagactgcttcggtgtctggattccacgtttatagaacactgactccttcaaaccaagactgtgttttttttttttttaagttggggggagaaagcggctggggggcagacggattttaagaaagatggcttttcccaacgtccttgctttcctctttaactttccattctgtttatcttaatgcgaggcgttgttccctgcaagagcctaagtcttccctttagttataaaagaaaagagaagaggaaaaaaaaatctggcacacactggcgcactatccagcacgctgtcattattggtgcaggcctgggaatgcgagccggacctcccagtatttgctgcagcttgaggccaaggtgcctctgaaaggcttttctttgaggaatttcagaaattgtttaagcgcttaaaaaaatattacatttccccccgtgtctaccgcgaggcaaatgttcgtgtgtgtgcgtgcgcgcgcgtgtgtgcgcgcaaaggcatcccacaaaaagaagacactgttgaaaagaaaaggaataagagagaaaggagggggagcattccttaatggaagtattgcatgcgagaaggttggcgctctcagaggctgccccgaagccgaggatgcacacactgggttgcctacctgggtggtctctctactttggtgagctgttgctaagcagctaataatagtcatgtttgctgagtaatttctgccctccgcgagccaatcgcgtcgcagaaacccaagccatctgacagccccgggggcgggagctccagcctttttctctttcgctcgctctctccccctccaccccctcccctcccctcctcctcttctttctccaaatggagagagttcttttttttcttcttccatctcatctattgaatcaaggagctgctgcggccgctgcccgctgcacacacacagagcggagtccccaggtcccgggagcgagagaggcgcgctgcacggggacagaatggtccagcgggttgccgaggagcacaagaaagcagagtccgggaccgagcagccaccgcgaacccagcagccagagcccgagcagcccgagcagcagctcctggagccgccaccgccagcagcagccaccgcgggagcagcggcagctgcggctgcccgggcccggcagcgctgagacccgccgggcaccctcggaccccgcggcggcggcggctctgcgcttgccctccgcggccgctcgggcgacccgggaggcgccgagagagccagcgcggccggcgggagcagcggggattcgctggctctttctgcagtgaaggggtcgcggcgcggggcggggggcgggtagggggagttggggaccgcaaggagtgccgcggaagcgcccgaaggacaggctcgctcggcgcgccggctctcgctcttccgcgaactggatgtgggcagcggcggccgcagagacctcgggacccccgcgcaatgtggcaatggaaggcgcagggtctgactccccggcagcggccgcggccgcagcggcagcagcgcccgccgtgtgagcagcagcagcggctggtctgtcaaccggagcccgagcccgagcagcctgcggccagcagcgtcctcgcaagccgagcgcccaggcgcgccaggagcccgcagcagcggcagcagcgcgccgggccgcccgggaagcctccgtccccgcggcggcggcggcggcggcggcaacatggcctcggctggtaacgccgccgagccccaggaccgcggcggcggcggcagcggctgtatcggtgccccgggacggccggctggaggcgggaggcgcagacggacgggggggctgcgccgtgctgccgcgccggaccgggactatctgcaccggcccagctactgcgacgccgccttcgctctggagcagatttccaaggtgcatttcagactctctcctcccactttctcttccctcctctaactctttgggatcgcccccgccacacacaaacacacacactctcttcctctctctctcacacacacacacacactcactcacacctctccaggaaaagcagcagacaaatggggattgaaaaattcaaaccctccctctggtcctgggaggaaagggctgtctgaggtccgcagggggtggaggtgtgtgtgtgtgcgtgtgtgtgtgtgtatacacacgccctccctggtgtgccttttccggagcactggaaagccgtccacggcggaccacctcaagggcggccgcggcactgtcctgccccgtgccccctgccctgaacttcttcctcctgcgcccctgcccctatttgcagcctaaactcctgtacggctgccacatttcttaacatcttggagggggaggcggagtggagagaggcggagagaggaaggggggagggagccgaaataaaggtggtttccttttttggcagccagttttggttttgttgagcatgaaatctctgctcccttaaaaaattattctcggaaaaagatatcccccccgttttccaggttttgagccgcctctccttagggcctggtcgggggaggaaaagttgtaaacaaattgccaccttaaattcgcggtgcgagtctgcggagctgccgggttcattgtgtttacgaggctcgctgaaatgtgtggaatccagggaaggcgagcacccagacgggggcccgccggggccgcggccagcgccggggaaatgccgcgccggggagcagcctgcgccggcctgagcccttccctttgcactcggctgttttttacgtttaaccagaaaggaagggagaggagggaaagatccatgtggctgccctcttccgatcacaaatattgtcgtaagttgcagctggctgccccacttcctaattcagctcacacagcctctccccacgctatggaaatgcgtcgggagtgaactccggcggccgcgctcaccacgtggatccccacttactaccattctcggcgggggtccagttgggggaacccgcaatatgttgttccaaagagcgctcgcccctagcgcccgtccccgagggtgatggacagagcaggactggtttgctggctcctgaaccttgggctccatcgctgggattacgcagcccctcccttctcagctctggggtgaatattgtctgtgtcgagtggtttctctcctctctacctcggcttcctcttctgtattgcagccccagtgccccaagtcgctcagggatcccgcgggtgggggcgccctgatgtccccgaggtgcagctcccacgctgcggcccggctttatgaccgagccccccatgacgctcagatccgccggggctgcagtctcgagggcgagtccgtgtgccgcggccacccgcgcccccacggctgttgggggctcaccgggcgggtgcgcgcaagcgggcgtgggcgcgcgggccgcgactccccggcgctcactcctcccttctgcttcgtccccaggggaaggctactggccggaaagcgccgctgtggctgagagcgaagtttcagagactcttatttaaactgggttgttacattcaaaaaaactgcggcaagttcttggttgtgggcctcctcatatttggggccttcgcggtgggattaaaagcagcgaacctcgagaccaacgtggaggagctgtgggtggaaggtaagagcgcccgccgcggcgcccgcgcccccggcccggtccctcctcgcggttgatagagatattcgccagcgcacacctagagcctggctgcggccggcgaaaccccctgcccgcacccgggggattgtttattgtttgggcgcctggccgggagccaggcccgcccgacaaaggccgcgctgtaatctactcggggcgctgcgccggccgaggtgtggtgggagagagcggcgggggcgggacgggggcgcggggcccctccgggacggaccactctgcgcgccgggggccccgggcccgccgccgctgccgctgtccgcctgggccgcgccccgagaggcgccccggggctggcctctcccggccccgctccgcggcccggctttcttctctcccccacccccacccaccgcgtccaaagaaaaaggagtcggggagagccagaggccacccctccggctggctggagtgtgcgcgcccccggcggccgcggccgccgcgctggggagggccgggggcgggcgcagcgcggggctgcggaggcggcggcgtgtgtggtcctgtttttggacagctttcaactctgagggaaaaaaacatttgtctcaaggtacaaaaaacgcggggtgggggtggaaggagtggaaaaaaaaatagtaaggcacagactggaacgcatgtttgcaaagtagattaatgtttcctcgcgggtgggggctttttacatggaattattctgggggaaggctgcattttgcaggcaaagaaaagaaatgttttaagaacgcggggttgaagggacctctcagaggggttctgccagtcttttatccacgttcctcagttttggggttcttgagaccttagcaaagcagttgcagatttaaaatagatatatattttttcgaagacaaacatttttacattattttggtgacaaaggtttcaatttttttcccccgctggtttcttatttatctttttggcaagttccaaatcctgctatttggaaacactttaaccctaaacaccactttgggcatcccttaccttacaagagggtagtaggggagggtagaggtgactaggtagataattcaaaccaaaatacctggagcattcctccggacagcatgtggaagctgaagagttatgcgcataatcgcttcagtgatccctttcaggatgctgttggagaccttgaagaatatttccttaatctctccttgtttgtgaagattcagcttgcagagttttgcaagcctggggtggagttggagtatttagttgagaagtgacaattaaaataatagtctacataattaagacaaaacattcctgccttaagtagtttggtaattaatacaaaagcgttctttggattgaatccatggagtaatttacctcagttcagcgattcagtatcactggtagataaaagaagggttttatcgagcagctattatgctcctagcaacaagtttcttgagcacctatgatgtccctagcactgtgttaagcaccataagagactcaagtgtgtgcgacactgcacaatttaaaactattagaattcgatgcatttggactacatttgggttcacagctgaaatgggctgtgaaagttacaagagggtggtagggggtggggggagagaactggagacggtaggggaaggagggcattttaggcatgggcgggacaccagcaggggccccagctgaggagtttggaagtgatgtgattggctagactgtaggggcgctgccgtagattctaggacagaatagggcatgaggacagggagggccgctgccgtagattcttggacagaatagggcatgagcacagggagggccggctcatccaccacttgatccaacctgtatttgttgccatcggatgaggatgacaaaacgtgattttgtggtgttcttagcaagagttttcagtggacctttgacatgttgaaggagatagaatgtgatttattttcttaacattgcatatttctggaaataacttgctttctgcataacacgacccatttcaagtcctggaaggagatgcagtgtgcttcctagcagttttatgggagctgccagttgtgtagtgagagggagtaaagtttttctttttcaatggactggatgaggacacttctgaggggcacactcactttgcttacttttggcagtttcagcatgactcactggtcttgggccaaatgttatttactcagtactaatactgtcacttgttgagcaactgccatgtaccaggcatttgttatatattatcgcatgccttacgattcaataaaatagctattattatcttttttttttttttttttttttttttttttttttttttttttgagacggagtctcgctctgtcgcccaggccagactgcggactgcagtggcgcaatctcggctcactgcaagctccacttcctgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccctattttgtttttataacatgatagtggatgtaatgtctttatgatgaggattgtcccattttacagatgggaaactatgggttgtctgtttgtctccaggtctactttgcctactaatgacataagtcacttgttctgttgccctgtccttgatctctcattcattcattcattcattcattctgtgctagattctccccctagagaagaagcgacagtttcataaatgcagatagacccaactagagaggtgactatacaacagtagccatatagatttaatttcattttcaaagcagaagtgattgtgtagagatcttgtttgtgacagagtgagctgagtgttcacgtcagcagtaagtagtgtgagcatttgcattcaggagtaagatttccctgctgtcctatacctcagtggacgtccgtgaattgaagtgagtaatagctccacatttaagttcattttgtgcatcagtctcatagataaattcctcatcactatcagcaaagaaatctgttagatgctgctttcttggtaggttgttcttaaggttctagacatgaatttttatatgaactgggcatcaacagagtgcttgctacacaaacgaaatggatagaggtagcatattgccctagttagaaaacaacagaagagaggaaagtatgagattttaaggggagagggatgctgagggatagtttggaagaagctccttctcctgcggtttaaaatcacaggagcgtgtgtgtgtatgcacattgtcttattctgcatatcctcctatctgccaaaggcatgttaatgttatctttttaatacagccagcaaattaaagggatccactcgaaaggctgtgtcttcaaattgactttcatgctttgtttaacatgctggggaaatgtggctttataaagagttggctttataaagagggcagaatacatcagccacaatgtgcagactaatatatgctagatgagaaagagtccgtgtgtgtgcatgcgcgtgtgtgtgcgtgtgtaggaattggtgataagaattattgtattctgttgttaaaatgtccatataatgattgccttttaataaactgtcaattatatgttaagataccagcttgagttttagggttatagtgtttgctaatcaaaattgtcaaatcagtttcacatatgtgcggagtaatgaggtttgatagagaatatgttgactgatgtagtggacatctgctgttgcagaaacacatgaccatggcagcaaggtgggggagaaactaattgtcattgtataaaaatagaagcgttcattctgcacatgttctcagtacctactctgcaccaccattgcagaaagctctccagagagatgttggtgaaaagccacagtctctgccctcaggggaactccatccaaacattcagcaggtacacggactggtgtgtgggtagttaacatgaaggacagcagtgccaagatggcaggaaaatcggggacatcttccaggatggcctcaagggtggaggcctgagctaggcacaggggctggaggggagagggtagggggcattcagggcagaaggaacagcataggcaaaggctcagagaacaggaatgtggcctcctggagggcagcctccctttgtgggtcgttgaggttgggtgggagcctggaagctgggctcgtccctcagggccatttcacagaagtctccctgcttggctgggggctgtcagctcttcctactagccatccctgtctcacgagtgtgctcacgtgttggcctctagtgttttccctggagccacgaatgcttcacctggatctcacctttctgggcacagactggtgttatttttaatcttgcctgtttctttgttggtatttcctttttgttaagcagttttaacccatctccctcagtatctatttcttttcatatcagccccctcactgcagccctccctcagaacaagtttcttgtcaagcttctccagcgatagaacattcatttatttctttgagctttttgttttttctaaaagcttgcccagctcctggcctccttttctgcagagggcagcagccttgtaatgaatccatattgctttggtgtttggatgttaacattgctgcaggccagcgtcaaggaagaaggaggcaagttgtgactttgacttttttttttttttaagaaaaatagaagaaattgttttttaaaatacatgcttggtatgtgtaagtgctttcaagtttgtaccttgctagtgttaatgctttcagtgttcttgaactcaggcaatcagttgtaggagataactgagtttcaccactccttcaatttggagcaaggtccctcaacctcaggactattgacattggggctggatcatcctctgttgttgggggctgttctgtgcactataagatgtttagcagcatcctggtttctacctactagatgccagtagcaccctcccagttgtgacaaccagaatgtttccagtcattgccagatgtcactgggggagagggtgtcccaaatcatcacgattgagacccactggtttagatgataaaaagattttgattggaagactcatgctgtgcagatggaagacgtttattatgatggagttgtggctacaatgcattgcagagatgcaagagtattaatcttctttaagataactcccccatcccattcctgtatttatagacccagataactatttttcttagaatgacattaaatgtcaaagaaaaacaccgtgatgggtcgaaagaggaaagaggccatggaagaaagaaataatttatatttgggtaccttttggtggggggtatctaaatttgcagaaagactggttgcacctcaaccccagtagcctgaaggtttttagcatggttgactttctgaaaagctttaatagaagacaccactgcctttgtgcatattgaaataacagctccttcagaagcccggctagtgtgtgaactccttggtggtctcattctcctccagatgtttctgtcacaaaccactcccccttgtccccccaggagcccttgtggagcagaaccaagggacagcaagggaccagtcccagccagaagggcagaatggattctgctgtcactgcccttccacagtgagcacctggtttcttttctctggggttgccattgtgggggcatttcacaagggacaggaagaaaaatgcagctcctttctgctccctggacccccatacatggtttagaagggagaatatgtttataggtatttattagtttctactactgggtatgcacatttaggtggaagcagttgtgatatttctttcatatttggagaaaaacgattggaaatgagaagccaccaatgattgtttaaaaaagaacaaatagccctcaggtgtcttctacacagggcagttgaccctgcgaatcctccctatctctttgctgtctgccattcttgacccttcaccaagttgagaggacaggttgggtaatggggtgtttcagatacataggatgccgctcagaggttccagaagatgacagcttccagatgtatgaacagcctgatccgtgtgtttagattatgcaccacagctgatgccgagattaatgctggctggacaagccatgggagatttgtctggtttccacaatgccatgtttatgtttcatttgagtttctccttcaaagctgacctgcctgtgaccctgggctctgtccactcgggcaagctgaaactcgggcaagctgaaactcgtctgccctgttctcctgcttgtattggggtaggggagagtcacaattgggcggagaaaggggcgctttggtggccgccttctgcctcaccatgccagctatctgcccagatttagcccctgatgagtgttcagttctcctcggggatgtgtttcactgtaaaaggttttttggcttttaaaacaaatatggaaatattataaaataactgtaaaggggaccagatttaatagaagccactttgcataaatgtagtattttaacttctggcactcttttgacactatttagggggagaaaaagttgagggaatttcagctatgtcagacacccccacataataaccatggctgtgtcatcctattataatactattaatgtttcctgtgcccctcgctggctcccagaacctctgctgcctcctccctctctcccctgcccccttccctcctgccccttctcccgcccacccactctaacctgcccacgtcatttccttccaagtggatctctgcagttactagtgtgaactctgaaatggtagtaagtctggctaatcacaacctaagaggagggaatgagaacatttattatttcaagccagctgtgggagatactagatacagagctgccatttgcatccttggcattcttattttggttagggttggttccaagaccacactctttgatgggctcttggcagaagatgtgattcccctgttgaagaatcatgactttttttaatggactgctgaggcaactttaaaatccattgacaagtttcttcaacccataccacaccgccagagagagtgggaaataagtcttggtcccctgtgcttaccgtggcgcatggacagtggaagaactgggttccctagcatttctgagacagtgagtggagcacaaaccatggctttccctcccaggtgccccacttcaggtcttccttgcttagaactcccaccaaagccagtgggcacatggagcttggctagattgaagacgatggaattccttatccagattttggccgactctgaagctttatgtgttccatcctcacgagaggtcttggttgacatccagagaccagagggccttgctggtgagggcacttctgcctgcaggaggaggaagctctgcgggattctctcagtgggaacattccttgaatacacagatataatcagggtcatcaaaatataaacacttctgttactttctcttctaatctttgaatttgggtgcttatgataatactcactggattttttttttctctttaaattggatttagggcactttttttcctttacactgcaatgtctaatgccttccgtacagcagaatactgccattgagaaactgctgggctgtggtggaggattttaggagcctggtgtacaggaagatgcgccccatccttagtccctccaggagggaatatgactgttccatttggggtttagagcatggctggaaaaacagctgtcatgtgttagggaaactgtattgttggtgggcagtcagatacctgctaatgaatggcaagtttgttgttggagagatttataatgtgggggcaggaccttatttctaatccagaaacccaggtgtgagttggcccaaatagtccactctgcatgtgggtcccataatgccactgctatgaaagcaaggctagtgagaagcaagtccccataccacagcgcaagctttatttattattgttcggataaatgaaaagaagcagtagacttacccaatttagcaaccaagatagttttcagttattaatgagacatgtataaaagtaagcaaaaggaactggaaatgggctttgttaagtcaatgtgcatgattttttttcccccttaaatcattgcttaagggcttctggcccctagctcaggaatcctgcccaaaaatgccagatgtattacacagtcaagtattgcaatgtaaacaccactccgtgccacgaggcagggtggtccatctcctatttaagaagagtgcgagattgagaggatggggggtgggggggtaaaccctctgctctgtagtgagcccagtggtggttgtgtcatttgtgtttttggctgcacagtcaagatttgaaactacaaaacccagataaacacattggaatggcaaagaatagcaacttgaattgggatgccaaacaaatcaagatgtggcttggatagtgttgcttcattgggtcagataagtttataaaatgtgggacagaatggagggtggggagagacaggaagagcgctcttgtcacagcagcatctttaagttgcatgagcatcctgttattcatttgctggtggttaaatggaaaggtgagtggaagcgaggcggagagagcccgagcctccaagatgacctcctccgtgagaggaagccctcccgggtgggtgcaccttccaagcctggaaaagctgatgggttgcaaagccagtctggtgttctgtggcactgagggatgtagcccacgatatgttctgaagtaaatggctttccagttttctcctgctttctgcatttctgaagtaagaagtctgctaatgatgattgttcggagctgagaaagtcactggcactttgggccaccctccggtataacgtgtcgtacgatgctgccagcaatgacaggaaattggagtacccaaatattacctatccttccagatagcctaacatgaagcagccctgagagtgactacactcagggtttttaaaaattaatacgaacatgttttgtgagttaggaagaaataggatttcagtttgaatttgcggaattgttgaaatacctgcgccaatattctcctgattaagaaatttattctacagagtgatctgagaaaacggctttaagaaatagtgatgataaaaacaggaattttgagatgaaggaaaatgtaggcttcttgactccctctttctcctcccaccgctgttttttttccttttgtgaattcttccacattcccacccccactccctgatttcctctgctcctttactgggaaaccagcaaccttcacaaaatagactcaaacatcacacagcctctttttaaatagaggctttctaagagaaaataacaaaagaatttttcctagctgcctaagaaattctttcttcttactttattttcctcatgagatttacacattgttgtaataagtaaaaaatgataaatatgataccatcattttggtctacacatgatccagaaaaaaaaattgcacatgtttaataccttgcttaattgcaaacaaagcttgcaatttgagagaattgggattagggctaaatatctattaactgctctttctagagatttggggactaggatgacccttttttttttcttttttttttttaataggctacagtttcacatggctcccaaaagaaatctctctccctttttgtttcccacaccaattgatttatcattttgcttgcaagcagatccagaatgttagggcaagaacacactcacttttttctcgtaacttttttgttgcggaccgaaaccagttgacttgaataaatttttctgaggcctgaatgtagccagcaacgtggaaaaatcttgccattcagggccgtctgaatgtacatttcagccacacagtaagctgcattgggaggcgctggactgctaaatgcaaccatttttcgcagcagcgagttagacaggtgattagcataattagcaccgagcagctatacatatggtaatgctgagtgtgtaaatgccagctgcggtgtaaaatttatgtcaggggtcggcagggctgtgcgaaagtattgtgttccagctgcaggtcagggccgccaaagcttacctccttttctcttgttggtgaatacgccaaacagaagagaaagacagaaatataacagatacggctttgatgggacagcccagttctgtgcaagagggactgctctataaaacacacacactcacacacacttgcagaaatcccattactttctgtagaaatcgtgtgtgtacttcatgcagggtccagatgagtggggccgggatggaggtaggtaaatgattccctgggaggaaaaaattcagtcattgaagttttaaaaggagttaaaagttctgttttgtttttcttcccacccatccttttaccccccacaccattccctccaccactctcctgcccacattgtcttatttcacattagatggggggatatccttgctggatgggatagcattggtcctttagaagaggaggaactaaccgttctggaggtgttagccttgaacaaaatataaggtttcagcagtgcaactcttcccaaactgcttgactagctttagaaaggggctaaaaaaagcttttgtgggctttttgttcttcctctgggtagctatacttactcgcctacctatacttactccccctacctccactgtcagacccaccaaattctttatagatttaaaaaaaaaaaaagaatcacatgggtttcttgtttgaaaggatagtcttgaatggctcacatactttgaaatgcatgatgcgggaatttattgctatgatgagtttatacattttgcacttgaggtattttctctgccacgcccccacctccacccttccgttttttggttggtggctataagaagtggtggtgttgacagaatatagttcacaccatgctgacccggtgatgaaacttcctcacggcaccagggggtccttatgtactggcccctaatccagctaatcctgatggcaacaaaatcatgaaagtggcccccagtgacgtgagtctccctgcacagatgcagagggaaggaacagtgcaggagataaatgaggccagcgtggtattcaccggaggccagggagcctgcgtgcgaaggtggagactcgcattgtcttctcccccatgtcggctcaagtgggaggccaatgaagagaggcccaggctggataatggcaagaagactgttcagagctgagaggtgatgtcagccccacagaagctgagagaaggaaactggggttaatgttatgcaatgccttgagtgctgtgatggagagcctgccgtggaagcacttgggttttgttgttgttgttgggtttctttctgtttctatttttttaatgaagacttcaggaggtttcaactaagcttgatgaaaacacgctgtgttggttcctgggttctgctgcctgctgctgctggagtgtggcctctgagccagcgcgcgctcgtcatcacacctctgggcccgcccacttcctgcagagcgacgggacctgggtgtgcatctgcctgcctgttgcgcttgagcggcctggttgcacctgaggttgtggtagaacctgggacagttcccagcttggaaagtacgctgttccggatggaagacatttccgcctgtgctctgcaggaagtcagcaacgttcttgggcctgtctcaggtggcgcggtgcacagccctcatttgccagtgtggcaagtaaccaatgaagaaggggcctcctggcagatgcagcgtcgtctcgggaactcgtggctccttgggagctggtgggagctgcgacaggcagcaggtccagcgtgggcagagtgccgggctgacctgattgcatctgacagggcgagcaggtctgcgtcagggaaagccattcagagggagcagcctgggcaaggctgataacagatggcactgccagcagctggtgggggcggggaagcttgcttccggcgcatgcgcgttgcagaaccccgcgcgagcgcctgcgcactacctgcgcccagcctgccacatgccccgtgcggtcccgtgcggttccgtgggcaggtgggggtgtccttttctcgttatgctttggtggttgacctctcactgggctcacttcatgaaggcacattctctttgggctgattgtagcgtttttcccatggcaacacgcaggggcacaatctcataaggaaaaaaacggcccagaaacttggacagcggttggctcctcctgaataaaagagatgggtgggagaggactaaaattcacagcccgtgaattttcagccaattgctcacattactgaattttcttttttttttgtttttcgattataaaaaagaggcagtgctaataattttgcagttacacccgcttagagatttgtactttttcggcctcacagtaagtaaatgcaacattgaaaggaggacctgagcaactaaaagaaaaagaaaatctctctagaggctgttagataattcatgggattaatcaaatgcaaatgcaacgcttgcatatacacagaccctattttcctaattggactctgagtgggtacttttcaggctgaaagggtcatttgttttgactgattgactttttgaggctttggggggaattaataacttatacagatgactgcctgttcccaaggctctgtattgagactgcgcattcatttattcattcagcacacttggtgtgccatgcccctggtgcccctctgcgtccctcacatacggaggtgcatgggcaggacttgaattttgtggaaaataacttcggttggtccctcagatcatctttatgtggatcacaataagcttttgctaaaaggtttttgtgtgaatgacacagaagtttcttaagctctgtgcagaaggctgtgctgaggaggggcacagcagggaagcgtgatgagggaaacatctcttgtctacagtggattggaatcatattggcctagaagtatgggcctctgggtcagctggcatcccacctgagctagctagcctttcttcactttggaaagttaagcctggcttgatttggggatgagaggatcagcagagcttgatcaaaaacttatttgcagaagtgatgcttcttttgcctttcaaagaattggcttaagccttggatttctggagaataagatggcagaatttgcaggtaaagaggcttagggctgcatgttctctgtgtgccttcatctgccccctctaagacaggactctctggggaccagaaggaaaatgaggcctgtccactgtgacccagggagccctactgaaaaaaatgcatctcctcactggctgagaaaagtctttgatgcaacatggttgtactttaaataaaaatacggattattgtcatatttcacgcattctaaaattctagctgtgagcgtaatacaggttgagtatcccttatacaaaatgtttgggaccagaagtgtatgggattttggatttttttaagggggggtgatattcacacataagcatgatgagaaagcttgaggatgggacccaactctaaacatgaaatttgtttatgtttcaactactttatgcatctagcctgaagggaattttatacgatattttaagataattgtgtgcctgaaacaatgttggtgtatattgaactgtctgaaagcaaagatgtcactatctcagccacccatgtggacaatctggttgtgtggcattcccatccttcctgacttaaaatttatatgctgccgataagcaatcattttcttaaactaattcacacctacgtacttaccagtaaaaaaaccacgacattccattaatgcagtgaaaaaaataatgtgttcagggtacccaagcagcacaatagcatcaccagatacctgcatcagtggctaaacaacagcagcttccggtctccacctgcaatgctgtgttttcactgagaggttactgtacaccatgttttatttttttaggtgagaagaaacatcagaagcagttgaaggatcagggagtgggttgtgtaggggcgaggagacatctgctggatggcttttcagaatgtttcctccagcatcaccggcctcattaacaatagtttctgtcttaagacgtctctctttgattttatgaattgacatgatttcctgtttggttgtgaatgcacgatgcgttagttttcaataagcccatcacacatttttaccaggtctgctatagttaactttttgtgcagttgtaacatgtcatcttcatggttgtgagcctgttttgactgtgactgattacatgaggtcagatgtggaattttccacttggagcatcatattggcactcaggaaggttttggagcatttgagaccttcagattagggatgctcaacctgtctagtgtgctctgtggaatttggcactcctaggctacctcctgctgtactcatgttctcagctggtgctcagaaaccatgaggctcgcagggtagttggactctgggttaaagggtcagttctgcctcttactaataaggtgggcaaccttgggcaagccacccaaactctgcagctatgccccctcccctgtaacatcaggacagtgaaacaatgctctgtgacaaaggcatgggtgaactgacacttgctccgctcttgggtaagggtctgggaaatttcacacacattgtcagctaaggctctcacagtcctgtgaggttcatcacagcatttgttatccctgttatcctcagcaaccaggaaaggtggctgaggctcagctgtgtcagggacttgtcctagatctctctgccactagtggcaatgctggggtcttccggtttccattctcactgcctgtctggtacagctggccccagcttgatggaggagcagcaatgatcaaaatatttccaaagacgtaaagaatatggtctcaaagggctttgcaaatggaaagcaccacccaagtataaaacgttattttgtgtctcaggatcctgagataatgatttttcttgagtcttgttcagaggggttgttattttattgttaatataaaaggacttcagaatatgatgaagatgcatatgattatttttatagtttattagtattattgatacataatactgtatatatttgtggtgtacatgtgatgttttgatataagcatatgatgtgtaatgatcagatgagggtaattggaatgtccatcacctcaaacacattcatcatttttttgtgttgagaacattctaaatcttctcttctagctattttgaaatatacagtgtattgttgttaactgtagtctccctactatgctatggaacactagaatgtattctttctacttaactgtatgttggtactcattaacccacctctcttcatttcccctctcattcttcccagcctctgataaccctcattctactctctaagtccatcagattaatcttttttacctctcatatatgagtgagtacagagatgcctatttttttttgcattgagtttgtttttaattcatatctctaccaagtagctctcatatctatctttcttttgtgtgtgtgtgtgtgtgtgtgtgtgtgtgtgtgtgtcacatagaaggttttgtttttctgggttttgttttgttttgaagtggggtctcattctattgcccaggctggagtgcagtgacacagtcacagtgcactgcaccccccaactcctgggctcaagcgatcctcacacttcagcctctgaagtagctagaactaaaggcagcctccactactccacagctatttctttaactttttatttgtagagataaatacgtttatctgtgttgcccaggctggtctcgactcctggccttaagtgatccttccaccttggcctcccaaagtgctgggattacaggcatgagccaccatgtccaaccatagaagcttttaattatactctttcattgtagaaaaattgatagaaataaactcaaaaaagcaaagcgggtaaatattatccatagtccggccaggtgcagtggctcacgcctgtaatcccagcactttgggaggccgaggtgggcggatcacaaggtcaggagatcgagaccatcctggctaacacagtgaaaccccatctctactaaaaatacaaaaaaaattagccaggcctggtggcgggcgcctgtagtcccagctacttgggaggcttaggcaggagaatggcgtgaaccctggaggcagagcttgcagtgagctgagatggggccactgcactccagcctgggcgacagagcaagactccgtcacaaaaaaaaaaaaaaaattatccatagcctaccacacagcaaaaatggctattaacttggttccctatgcctacatctacataacagatactagatttaatagttattttcttctgcactatttcacgaacattagattattttaaaaatatgttaggactttgatcctgacagtggaaaaaagtcatgcctgaaatcccagcactttgggaggccaaggcaggaggattacttaagctgaggagtttgagaccagcttgggcaacatagtgaggcccccgtatctacccaaaaaaatgaaaagttagctgggcatggtggtgtgtgcctgtagttggagttatctggggtattaggggaggaggatcgcttaagcccaggaggttgaggctgcggtgagcagtgattgtgccactgcactccagcctgggcaacagagcaagaccttgtctttaaataaaagaaaaagaagggggaaacctatttctccaagaccatgaccttcatctcagtcatctaaaatgggttctgtgggacttcctgagctcaaagcttcacacttagggatgataaggaagacagcaagataatgaacagctttcagctgtcattcagcagtgatttaggataggcgtttgctagggtagcaaatgtcagacgagtcagtaaaattgctctatcctgaagggtttctgtttctggcagcttgctccagagtgccttgggtcaatactgatgtcagaatatatgagtgtcgtgcactttatgacacagttatacccgagagggagctgattctaccagttcacatggtgaatgacacaagacttaattatggtctcaccaagctccgccacacttgcctcccttctctccctgcaacaagccaaacctgagggctttgcagttgctggttcttctacccagaacgctgtttctccagctcttcaaagtcacctaaatgttgtttccctttaggtcttccctgctatcccatttgaaatatcttttccccttccccactacccaacatggcatcaccatcttcgttttctgcatcacacttgtgctatgaaggtatcttattgttttgcttggctgttgcctgttcccttcactgaccagcatgcctcttggagagagactacgctgactggtttcgtccaccacatccccactgcctggtcaaagtacccacccacccacccacaaatgcttgctggatgaatgaatcatgttacagctattggtcagataaaatgggtggcaactaaacttcattaacgtttttgaatcattttgcaaaacattcatatttggttaaatataagatgaaatattagataaaatataaccatataatatgtaaaagtgaattgcatttaatagtatatatggcataggtggttgagaaaaccgtagacttcagagtctcaactctagttgcttggccaccctatcatgatagtcttagttgaaacatcacattggcaaaatatttgtgttcatcattagagcaaagagatgggggagcgacaggttttccaattccagagaaaggacaaatctatacctttattaaaatgtttatgtaaatatacatcttaaaacatctaaaaaggggacatgatggagaccctgaggtacattttatatcttgtagaaaataaatgccatttctgaaacaccctgtgataaaataactgctccattatgaggttggtctggaagagtctggtaaaaatttcttagcagcacaaactttgtgtttggttttgccatttttgtgcacactgcactctcaggtcacttcgaggattatatagttaacaggcggctgctctgccaaggctcgaggggcagaatcttgctgaagccaggctgtctgtcatggactgctcctcactataacggcacctaggtcaccataataagggtggggggtgtgctttgttgctgctgttttttaatttcatgggtttaagtcacctgatatgttaagcttcagtaaaggtgcaggaggtgcaactttgtaatcagaatgaaaaaccacgtgcatgctgatgttcgaggaggcagtaacaatgggaatgatttctgggtttgtggcattagatgtgataacacaaagaaagggtgagcaaaagctgcattgagctccttggtgggcagctctgcagctgtgacctctggactcataactggctttttagcctcatacagcttctgcacttctaggggatgtgggctggctcaaattcagttaattggttggaagtctgcgtggtgttaagtactgtgctttctgctagagtgagcaagcccctgccttcaggcagctttcccagggcttgcagaaaaggccagccgagtaggtagatgcttctctgtgcaagttgtttcccagtgttttcctgtgatttttccttaacttcacattgatggcaaggccctcggcaatgccccctggcatttttcaaagttttctgcacacagaagtcttattcctttttattaaccaactgatatattcctccctccttcccgaccccacacgcagtatgttaaacctcacctcacggagctcctggccttggcatccgcgtggacctgcacagagggtcctgccaggcggtgaatttgtactggttttcctaatgagggcattatttgctttttagcctgcccccttgtttataaaatatgccaagagaactaaacaacccgctgttcccagtccttatttacttgtccaaaccaaatgtttatgtccttgaatactaaacttgaagaaaaaggattcctcctcgtgggaaagctatgatcactgagtttttttctaaactgtcgctgcaggcctgcttttcagtcaacatgcaacttatcaatgactttaggaacaattcagacccgcttcctttgccctagactgtggagtgggggagctctaggttcctgggtctgtaactattagtatctccctgagacacctcccagcccaggtgcagcattcggagcttggcttggcccagaaccgttcattgaacataaccttgggcctaaggatgtaaaaaggagaggaagagaaaaggcatttggcagtcacagtgttgatggttttctttggtcacctgctcctgcgctggctttgggcataccccgtgctggccagcttgctggaaagctgggttggtgtgaggcaggacttctcggcctgggcagcaggttcagggtcacctggggtgcttccggaaaacaggctgctcacccccagctgactgagaacctggcacctgtgttttctggatgctgaccaggtgcgtctgatggaaccaggttccagggactgcccatgatggctgtggctgatacagtttgttcctctcaattgggatttccccatgggcatctgacttgaatcactttatttatcttctcctggcaagttttgtgctgaacacacactggccacctttccttgtttctttttccacagaggagaaacatttccttgttacctttgccagtttacttaggagaagagtgtaaattgaagccatttatcttgaaatctgctgcaggggcgcattgtttatacaagtgaaagaaattgtaacagggttatttggtctggtctgcaaggaaaaggtgtctcaagttttcctttctgccccccactttcgtcacacagtgtattagttagaattaggtttgtgtctgtgacaggcgggacagccattaatgggcttagtgagtattttttatgtttactattggtgaagttaacattgccattaataaagtgaatgttactgctcacacatcagccagtctcatgactagagttcatctattgtgtatcctatggcaggtagtcagataacagataaaacatgagtttgcagtgattttgctattctaattaaacctgtacatatttgtcagttggaggacgagtaagtcgtgaattaaattatactcgccagaagattggagaagaggctatgtttaatcctcaactcatgatacagacccctaaagaagaaggtgctaatgtcctgaccacagaagcgctcctacaacacctggactcggcactccaggccagccgtgtccatgtatacatgtacaacaggtaaggcccgccgcgtccacctactaatgagcagcaggtaaggcggtgggagaaggctgctggtttaggccccgttattttagtaaatgaagttgccctggaaatgcacctggagtattagttcaaatagctttgcaatgaaaggatttttttcatcttgatttatcgtttctcgagtttggtaacaaagcaagtgcattacttgataatgtattgccagtaagtatcttggcactgtccccaaaagaggatgacgctgagccacttggggactatacacccaggctgtaagatgtttcattgcttaagagatttttggagagtgatattttgaattgcccttgctgaacttaaaaacaatgcgaaaaagaagagctgcttcttgtgactttgtactcttagttgttttgtgtcacacagcacgttgggggctgagccaccatgggaattgttgctgacacctttttatttatttttttgagacagagcctcactctgttgcccaggctggagtgcagtgatgtaatctcggctcactgcaacctctgcctcccgggtttaagcgattctcatgcctcagcttcccaaggagctggggctagaggcgcccaccaccacacctggctaatttttgtattttcagtagagatggggtttcaccattttggccaggctagtctcgaactcctgacctcaagtgatccgcctgcctcagcctcccaaagtgctggggttacaagcgtgagccaccatgcctggcccgctgacacctttttaaaaagtcatgttttagcatcgtattgctaatttcacaatgctgtgagtagagtaaagcattaggaagagttcaaaactcggtcctttttcttatgtatctagactgttggttactacagggcaggggccacctcttgtctgttttcaccccagcattgagaacagagtgggcattcagtttgttgattgcttttgaggttggcatcactaaaccccatttccaggggacctctgagttgatgtcacccaaccccatcacctcccctaggctttcagcacctcttcactgaggcctttgttagtactgtttatttttcctggaagaggtgaggaagtagcagtataggcatattcagcagccagggagaaccaaagaagagaataaaattaagatttttcttgtcccttctctaacctctgcttacattccagctcgacaggatcctagggacaagcacagccagggtcgagtcacatgtctttggcacattcttgtttgtttatctgtaacctgggcttatggtcatgtgtgctcgtatccttcatggttcccagaacaagaccagatacatgaatgcaagggccttagaaaatgtaaaatcatgtttctgccaggcaaacttgccctgttggtctgtaacaagtattgtagggaagcaactacctggtacagttttgcagaatgtgaagtggcatccctgtggggagccaggttgtcctggggccactgcaagcatggccaatgcattcttagtgtttgtcacctacatgcttcaggagaagatgtgagggtctgtgccattaaattacactcttaagctgagatgggtccagagtaattttatgcattggaatgaactttaagaacatgtagttcaacccatcccatgttttaggtgagaaaactgggaattagactaattagagcatttgtccaagttcatgcagttatgaaatgagagagccaggtttcaaagcctttttctggcttcaagcccattcatttttctaatgcacaatgatgtccttctcaagtgtaaatgagagttgatcaagtaatataaagtgagaacctactcatgccggatagtctatgttgatgctgtatagaattaaaatataaatatgtccatggatgtgtggctaggtggaggatggcggagatatgggtaagttaggcacagctctcaaagagaggaaagacatcagtatagatagacatggacaaaggaaacgtgggcggtccccatgacagctgcgccaggtttcagcaggagatctgcccagccagggctctagagttcaggagaagggggtcattttcaacaagcttaacatgggggtgacatttcaacagggcgctgagagacaggaaggcacagggaagaggacacagtaagctccttgggtgaagacaggcctcccttaggaggccaagaatagagcagttgggagggaagtttttactgtgtttctttcttttttttttttttttttccttcccttggacttttccatccccactcttccagattttcttttttttttcgttagactgatctccctaacacacctggaaagatatgggcttatataacacttttctagagacaataaaactcccgattaattcttttttttttgagagatagggtcttgcttatctaggctggagtgcagtggagcaatcacagcttactgcagcctcgaactcctgggctcaagtgatcctccacctctgcctcccgagtagctgggactatatatgtgtggcaccacgcctggcaattttttttttcatttttttgtagagatagagtcactctctgtcacccaggctggagggcagtggcataatcacagctcactgcctcagccttccaggatcaagtaattttcttgtctgtatagctgagatgacaggcatgcaccactgcgcccagctaatttttaaagtttatttatttatttattcattcattcatttcattcattcattatagagatagggtctcactttgctgcccaggctgatttcaaactcctggcttcacgctgtcctcctgcctgcacctcccaaagtgctgggattacaggcgtgagctgcagcacccagcactaaattaattcttgatctgtatatttattcacatttctgtaagataggaatagaagagactgtgaagttagaatttgacccacctggcacatgttgttgtttataatattaatggttaagagcaggagagttcattttgaatactacctattaaggacatgatctgccagtaaaacatctccgcacctgagtatgtgtcaatactttgcaaacctaatttaatccccgcctattttgaatttatgataattcagctgggctgccctgaagttgtttaatgtatgtagaaaagcagattaatggtgtaaacaagattattgggagaacacttaagaaaacaagacttttcaagtactttggtagcattcatttacataaacaccctacatgttaattacgattgagtattatctattcattaaagcaagcttgctgggtctctacttggcaaaagctctgctcgttttgacagatgcttaaaagtgatcgaaattgcagttctttttatatgttctatcatttcgaatttgcactaattttcttattacagtgagaaatttttgtctctgcttttcattttattaggcagtggaaattggaacatttgtgttacaaatcaggagagcttatcacagaaacaggttacatggatcaggtatattttcttcttgttggcaaaaatttctcaggaacaccccagtagtgtgccttaacctaacgcatggcctcttctttttaactttgacagataatagaatatctttacccttgtttgattattacacctttggactgcttctgggaaggggcgaaattacagtctgggacagcatacctcctgtaagtgtgtgatcatgctttctgatgtctgtgacttctctaggactcagtgtttctaatgttgcttatcattgtttgttccatttcagttttgaacaagaaataaaaacattgaaattccatgtgcattttttgagtgaatagtcgggggagaggggatttcagcagaatgttttttctcttttcaaaaaacaattctgtaggcgtcattaaatttcattcacttttaccaacctatttatatgcaaataaaatgcaaattattgcagagtacgtgtgattttttaactctttaaaatgttcgtagtttcgaagacgaggcatttagacacttattttttaaggagagactttattagtgagtgggttcacatcagaatgaaatattttgagtttgagatcttcctgtgaagtaaaaagctaacctttctttagatcacactaatggcatttaagggggaaatccactatctgtgaaggccacagtagggaatgtttcaccgtttagcagttggatattatatataccgcatcatttagagaataattgttaatcagcatagacattttcagttaattatgcaagagtgagagcttgggttattgtttctgtcctggcttgcacatatctgcaaaagcaatttgcagtggccatcccctgaccttcagtgtacagttttagatgggaaataaggggttttgtgttttctggttgggagattccgaataatgacttcagcctggttaagcagctacagtgtggtttgaaccacataacaggcagccaaaagcctttctggtctgtcaacagcacagattcaaaagtgagtgtggggggaagtggctgtgatggtggtgatggcagaggctgcagggggcttgcccattccattgccaggctgtcagagagcgctcataagtatgggattgttaaaggtagcagagatcaaatattttgattgatgacatttacaaagtatttatttggctgccaagtgctaatttgatattgtgacgccctcttttttaaaaaaaaaaaaatttaattttggatctgtctttttggctaattttgtatgtagatattaaatatacaatatcagcaattaaagattattcagtgccctcattaacttatgagtcctctctctgcttagcatcttcagtcatgaattattttcctgacctaagtttttatgcagatatgctggaaaggagcatttgttttgatgccagagtcccagaactgcagcattgccaggaacctcctacaaggtggatgcagtgggcgcagccgtgttactttacgatgcgtttagaaggctcttttcatggtctcgtctcctaatttcttttgcagaggtaaacctcctttgcggtggacaaacttcgaccctttggaattcctggaagagttaaagaaaataaactatcaagtggacagctgggaggaaatgctgaataaggctgaggttggtcatggttacatggaccgcccctgcctcaatccggccgatccagactgccccgccacagcccccaacaaaaattcaaccaaagtgagtaccagcagtgagcgctctcagaagggtggagagcaaaacacttttttgtgtccattcatcgttcactttattattttcatttttaacatttcattctccatgatcgtctttgtctatggaactaagtttatttatagagctaaattttgctgtaagatttgccatacacctcccattagccttgctattaatgttctctctgaaacacacaagcccttaatgcactggattttaacaaggcatgtgacctgcctactaattcccataattatgtggctgtctttttattttagcctcttgatatggcccttgttttgaatggtggatgtcatggcttatccagaaagtatatgcactggcaggaggagttgattgtgggtggcacagtcaagaacagcactggaaaactcgtcaggtaagccagctcccgaggacaatctatgccctgtagtcttcttcctttcctcaaaagccacttccctcctgacatcggcaagtgtatttgtattaatacttaaaccgttatcctcgctagccaggtggcgtcatagaatattaagaaatagtagcagactgcaacagcttgaaaaagcaccttgtggggaatttttcaagaatggatttgtagttttcatcaggaccatagttcctgactatagggtttaaggagatctgcccattaggtagagaatgggagcaggtgtaaagtaggccgggacacactggtcagagagagttggtggtgcgagctgcacagtgtcatagactgttagcaaaagatggagagccagcggctcaataagaattatcctttgtgcacttgtggactctggtcagtcaggtgtctggcgtttcgtgtaagatttctcccttgggaacgccaccgtctgggatttctgcacagcaagtatgcgtcactgagcccggtgtatctgttcaagctatctgctcctctccccttcctgtttcatggaatggaaactgtgaaaggaaattgcctattaatttaattttggggtatatctgtaaaaggtttgtaaggttatacctttaatatggtacatcaatctattaaataaaataaccatcctggtcccattttaatggaaacatgtgctcacagagaaggaaaagaattgcagccagtgagttgggggagctggctggggatttgaggcagtggaaactgcttcctgggaatactgatgatgtgccttcccttggactgtgctgcagcgcccatgccctgcagaccatgttccagttaatgactcccaagcaaatgtacgagcacttcaaggggtacgagtatgtctcacacatcaactggaacgaggacaaagcggcagccatcctggaggcctggcagaggacatatgtggaggtaaacccaccttcgaatcggcgtgcagactcgctggttatgcaattcttcattttcaccattatttaaaacatttctttccattcgctttattttcaaaacattgcaattctgggaacttgatgggatgaaaacttttttcctcttctttgatattgaaaatcctgggataatatctaaaagactagttctaattggggtgccctgagacatgtttagtaaccagttgtgaattccagaactaaagcacataacagtgtttaaaaaaacacttggttagcaaaggtgtctggaaaacattagcaaggcatagaatctgttcacagctgcaggccccttggtcaggtcatgtgacaggagctggcctttgtttcccaagcagtgacctctactgagctgcatgtgaccttttaaaagtggccagcaaatgaacagggggaggagggccataagaatgagttgttttggattagtggggagccgatgggaccgcaagtcaattgtgaagttaacggagaagagacgagcagtctcagccctggagtaaatacagcactcagagtgaactccagcgacaccagccctcagcagcacccactgccactgattagccatggcccttgtcctaaaacagggttctttaatgttagcccaacttcagcttctctccctgccctggaatcacgtagaacttttttaaaaaatgcatcagaaaaaaagaagggctgcgctgtgtcacctgagatctgtgctgtcgaggcttgtggaagtgttcattgcatttgggcatttcgcattctgttgtgaccacaggtggttcatcagagtgtcgcacagaactccactcaaaaggtgctttccttcaccaccacgaccctggacgacatcctgaaatccttctctgacgtcagtgtcatccgcgtggccagcggctacttactcatggtaacgctcgatgccatgctcctgggggctggagtttggtttggttgttttagtctttacttttccatgactgctcctgcttcttaactgctcttaacatcgatgtgcatccaggacagagagagcgtggcttcacagtggtttaaaagtggtcgtgtaaagcatttttcccatttgccgtttgcctacctttgactcctgtcattttatgtgacgcccttgatgtaaagttttgttgttgttggataagttctgccttttgatttggggtgatgggtggagggaaacattagaatcacaacacattctaatgttcggcttttgttctgtgcccccattgttctgcttgcagctcgcctatgcctgtctaaccatgctgcgctgggactgctccaagtcccagggtgccgtggggctggctggcgtcctgctggttgcactgtcagtggctgcaggactgggcctgtgctcattgatcggaatttcctttaacgctgcaacaactcaggtactaaaggagccatttatctgctgtccgttgacaaatgccacccggcccccaggcttggcccagccagcctcctgtgtgctgtgtgtccttctcaccggaagggtcttgcagccttttccactaggatgctactggtttcaggggaatgctgtctcttgatgctgtccgccctcagggaagtgggtaggaagtctgttgggcttattggttagtagagacacttggctgataggaatgtatgtcattgaccagggttgtggctcttcagctctggtgggcatttgcatggcttgcagggcttgtgaaagctccgattgccaggccccacccccagagtttctcagtaagtctggggccggggctgagaatgtgcacttcagggcaattcccagtgatgctggtccatgggccacactctgccaatcattgcttaaatgagttggattccttctcatttactagcttaaaaaatgatagtacactgactttcgaagtagaaacgtgcaggatctcctgtgagctgaaatggctaggctttgggacgtcaagtgaattcttcaccatgaggttacggaagccctgcttcaggagctgttaggtgctggtggcagagtcctaactagctttagaatcatctgaattgcatctcgcatgtctaatgccaccatcctctgtttttgctgtaggttttgccatttctcgctcttggtgttggtgtggatgatgtttttcttctggcccacgccttcagtgaaacaggacagaataaaagaatcccttttgaggtaatgcaaaaacaaaagaagagagctttggggacatcacagcttcctctgttcctaagtatttgtcctttaattttcctcagtctgacccagtaaagatttcagtcccatgtcagatgatgtgtcactggctgccagtcaatgaaataagctggaagactctcaggacatgtatttgctatgagaagtcccaagagctgcatctcgggtgcctttaggaatacgggtgtttgttttaatgtgacactttatccctaactgccatacattcccagagcctgcatttgcttctctggagatgtctgtcacttagccatcacctccctccactcccttttaaaattatacttaagcgttaagtcattatcttgcagctttcttctctggatggtaataaccatgaagaattgatgactctgtagatggtactgaataatgctggtgttagggggtaaggcaggtggctctgtttccctaatgccagcatgataagctgtaataacagttgtgttattctgccacgtatctgctcacacagtctgtgctccaaggggaccatgtccagtgcagctctcagcgctgtgtttttttattcccaggacaggaccggggagtgcctgaagcgcacaggagccagcgtggccctcacgtccatcagcaatgtcacagccttcttcatggccgcgttaatcccaattcccgctctgcgggcgttctccctccaggtgagcttctggtgatgaaggctgtggtgatcctgaacggggcactgacttccagcatcccatgtctgcggtctctgctaaggcacttcagttacttatgaagtgaaatagaaatgcctgtgtttgaggctctgtttaactgggtggatgctgctttaagcttataaccctgacactccctctaaaaaactaagcccttctggagtttttccttcctttctagccctatgaagcccagacgtctgttgccttatagagtggccatgtcctttatgcatggctttcggggctactccatgttgccctctggggtcaccagcgctgcagccagcttctgggccatcccctgcttccaaacaccactcccagtacctgcacttaccccctctcccgctgcccacttgatcccaaacaggctaccttttctttcgcttttgccaaagcacccccaacccaagacagtattaagctgaggtcgcatgtcagacggcactgcaggaccgcgaactggcgaggctctgtggagaatttcctgcagggtccgcctcggtgggccctttctttccacctccctttcctaagttggccgccacaatctttcctgtcccctcttctctttccttttggtcccctgctcccctctcaggctgcccaagcagactcatgatccctctcaccttcccatgcagagcacgtgggcccctcgtgacttgtcctctccttccagaccaggccccgtcacccccagaggccgtcagggtattttctaatccagactcagcttctgtgaattgtaagcatggacagttccctgggatggggatagagctgtagtccgttctgcgcctggagtaaattactgacgttgcccttgagctacctgaaattcataggaatcctaaaattagttactgcagccagtaaagcagagacttcaccagtttgtgccatggtcttcctgagcgcaaagtggcctggagttttgatatctcaagatgttgtgggggttttgtgaattaatttcaaatttcaaaacctcaattgtttcccctttctttctctgtgatgatatgatgtctaattctcaagctggccaggttgttaaaggaaatgacttctgtgtcactttttcacttgttgttaggatgcccggcacactcacacagctttactctactcaccaagagttcctgcagatgcgagcaggaagagaaattgaccagtcttgcatctggtttctgtttatattttgtcaatatgtttagctctttcctagtctttccatttgtcatgtaagaggaaccaatcaatcacgtatttgaatgtcatttcgctagtaaccaagaggcctgggcaactactgatcctactgggtttgggaatggaggcatctttagtatttagtgtgaggcacagctggagaaaagattctatgccaattaccgtaaccgccagccccaaaagaaacataaaaagaaaagaaaacagggtttatttatattataaatttatatagaagtaaaaatagtgaatcaatgaataacgttcagatctgatgctcgaaccaaagcacaggacaaggaaactctctctgattgctcagtggcatgaaaggtgaaccagactcgcagtgcagctgaagttgtagaatgcctttgtgcgcaggtgtgtgtctgctcagcaccctgtggtaccccagtctcatttcacgtgcagccggtgctggtattgagaaactgttctagagtcttttagtcatgggaccctgtctgcccattctctctcctctccccttcttttctgcttgcctttttgctcactgtctttctgtatctgctcatactccttcttttcttcttttctctctcattctctcctctcctctcttagtacatactgatggctcatcgaggccgactctcctttaatgataccctgtggtgtggtggtctgaaaagctacatgaggtttccttacgaggagtagccttgtagaaaatccagtgcgctaaattctcccaaggtaagcaccttacagagacaaaaatgagtactgttggtttttgtgtttctgtttcaaagcaccacagtatcactgtagaaaattgcaactatagcttccaagagtcctcatcttactgaagaatacctcctcatgacactggttaattctctgtcaaaagaaaaaaggagtgcttcgcacggtggctcacgcctgtaatcccagcactttgggaggccgagacgggtggatcacgaggtcaggagatcgagaccatcctggccaacatggtgaaaccccgtctctactaaaaatacaaaatttgccgggcgcggtggctcacgcctgtaatcccagctactcgggaggctgaggcaggagaatcgcttgaacccgggaggcggaggttgcggtgagctgagatcgtgctattgcactccagcctgggtgacagaacaagactctgtctcaaaaaaaaaaaaaaaaaaaataggatagaaaatgcaaagaaaagagagagtgtgcaatgatttttgcagtggccatcagaaaattttccctggttctcttttaaatgtattgaccctcaaaattggccattatgtagcttctctttccattgatgaacagtatcaggtttgactctgggtgttcagttgtgtttatatttgcaagatgctacagattaaacatcaaaagggagtgacccaaggcggttctgtccaatagtaaacctgcgttaccttcagaattttccatataaaactcctccaattttgtagcctgaccaaataattagatatttttttccacaaggaaactgtcttaaacctcatcagcctttatccatctgcctaaatgccatctctacaccagaaatcactggcatcagctgtaattctttgtaattaactagggcttgctggtagcccagtagtgtttattcttcaatgaaaactcacagaacagaaccccttgttgttctgtctggtctaggagggttcaagtggaacctcctctgcatgtgtcccagccttagctgctttgaggggatggggcatttcctatgagtacaataactagaattgattcacagttgcagtatcatccccatcatcttctctggtttacttacactctcttgcctttgcgacaacccttcttgctttctgagcagcccttgctggttgttttactattttggtgtacacctggggacctggcactgagaaaatactccgccatacatgtagtaggttatgagaaagtcagtaagatgggacgctgcttggggttcttccctcatcccttcatttccgtcatggacacggagcaaggtgcccagcaggcttctctgaccgatgaggccggctggtgcccatgcctgtgcccgtggggctccctgtgtcacgaacctctgctctcctcatcctcatgaacacctgtccaaattgggatgcccagggtctcttctctacattccactcctccattctaaacatgactgattttaaaagctaaaaggattcggcccccaggatgacatctggaaaatctccgttagaatcctacctgttcttcctgccatcccctgctgtctcacggtcaggtgtcctaaccccgtccacagacgtcctctcagtaagggaccagatctcacaaaactcccggttctcagctgagctaggggcttggcatcaagtctttgtttgatctgatttactggataacctcaggcaggtgacttgaccgcacttcggggactttatcaggtaatactgtcaagagcagtgagaacctcctgtttgctatgaatcaggtatgaacgatctgatcttcatagcttctcctttctcttccccaaagtgaatttcaaaccccagcagtactgaggtgcttgagccaggtgtctcctcttgcacactctgtgtttttttcacagggagcacctgccattcccctgctcctgactgatctcttttgcttttcttttttgagacggagtctcactcttgttgcccaggctggagtgcaatggtgcgatctcggctcaccacaacttctgcctcctgggttcaagcagttctcctgcctcagcctcccgagtagctgggattacaggcatgcgccaccacgcctggctaactttgtgtttttagtagagatgggtttctccatgttggtcaggctggtctcgaactccaacctcaggtgatctgcccgcctcggcctcccacagtgctgggattacaggcatgagccactgtgcccggccctctttttcatcttataaaccctgctgaagcctctcccgggaagcctgccttgactgaccacccctccaccccactgagctgctctgcagcctgacacctgccttcatgacgccatccatcattcgagattgtcatttgtgtataggtctggctctgtgagaattgagagtaggattttgtcttatttatctttgtgtctccagcacccagcacagtactagacttttctttttaaaagatctctctctttctcaggtaaattctcttgtcacagtggtgatgagcttatttgtgtaggtctatcagacaggtcttaaatacattagagtggtaagctaacatgcttcatatttttcagttgatgaaggattttcaagatagaccaagaagaaagaggttaggtagtttttagaagaacgctcttgagagggaattaattattggaagacatctctccggaactcaggcttgctggttcaccttcagcataaactcacaattcccatccaaagccctttgtggaagttctccctggattgtgttaggtggcagttatagccaggttttctttcctcaccctaggacgtttatcagtttgagatttgtgaactaagcagttctttgagaagcctcgttttttattttctttctttctttctttcttttttttttttgagacagactctcactctgtcacccaggctggagtgcagtggtgcaatcttggctcactgcaacctccatctcccaggttcaagcaattctcctgcctcagcctcccaagtagctgggactacaggcatgtgccaccacactcaactaattttttgtgtgtttttagtagagacggggtttcaccgtgttagccaggatagtcttgatcaggagatccctgaccccgtgatccacccacctcagcctcgcaaagtgctgggattataggcgtgagccaccgcgcctggcctcgttttttattttcaaagccatgtctggcaatttcctggctcctcagcattgccagtgcttttctctgtggtgccccttctgccgtgcccttccgagctgggtcgacttccaccggcttctgttggcttcccctattaacagcccaattttgtaatttttactaggtcagcagaagatttgccaacgcactgcagaatttagccctgtgtttattctaggttatggagtgacttttgaatctgtacttatttattctgcgtactataatcacacacaggaatttctttctgcttaactctccttgaccttttatgtttcttgctctcacaccccacaggctactccagaggcaatttggaatgtgcctattaaaacctcaggggacacgtgtgaaattgtatttcacgttttaaagggggacattttgatatactcgatccactttatataaaaatgtttaactgtaaaatcagggtcgcgtgacctcttggaagcattctggaagggaactgcttctgtttgttttaaattctatctcgagtgtgctctctgttctgcctttgtggatttggtttggttaggttactagcaacacgttagtagtttagttcccaggtttgtgccttatcggtttatggaattattagagatagaaaggcccagaaacagtcaagactattcctatcaaataggctcttgatgatgtagcaaaagaaactcttaacatctgtcacggtttcaaatgcttcaagaggaaagggaaagaaaaatattgtttaaaagcatctttattttcgaagcagtcctctgattgggcggaggcatgttggtgacctctgaattttttttctgctcccaggcagcggtagtagtggtgttcaattttgccatggttctgctcatttttcctgcaattctcagcatggatttatatcgacgcgaggacaggagactggatattttctgctgttttacaaggtacattttcagactgctgtggccttttgattgggtgcagaatggtgctgtgagagaactctttcagcctgtggacttataaaggaatgtgggtaacggggtttgtgctggtgtggagaacgtaggggagagattggacagaggctgcttccctagggggacatcagagtccctgggcttccttctcccctgccgcagctgaacagtctcacagccctcaagatgctggttccgatgacccctttttccatcatgaactgatgttgccgattgtaggaatgtttcatatctctgcattagagcagaacaagattgaaaaacacccatctagaaaatatatagtcctttgatggtggtttggttttgtttggaattgtgctttgaaggattcatcatcatggaacttgcttttgaaagccaaatttaggatcagtcctccatgtggcctcctcagactgacttttatctagttcaccaggcgatgaaccaggtgatgttatcaaccaggcgatgtttctggaattcagcaatgtgatgtttctctcctaagtcagagctgtgtaaaatgggtattctccgtacacagtgaaaaatggcagaatgaaagcaccatttccctgtttcagcataacattgcaacatgtttcccctcctttcagcccctgcgtcagcagagtgattcaggttgaacctcaggcctacaccgacacacacgacaatacccgctacagccccccacctccctacagcagccacagctttgcccatgaaacgcagattaccatgcagtccactgtccagctccgcacggagtacgacccccacacgcacgtgtactacaccaccgctgagccgcgctccgagatctctgtgcagcccgtcaccgtgacacaggacaccctcagctgccagagcccagagagcaccagctccacaagggacctgctctcccagttctccgactccagcctccactgcctcgagcccccctgtacgaagtggacactctcatcttttgctgagaagcactatgctcctttcctcttgaaaccaaaagccaaggtaatctgccacaacttaaggctcttcctgtcttcaaaaaaataacagaacctttggagttcatcagattgcttctacttttcttctttttccttaaaaaaaaaaaaatttcgtttaagtatgatacatttcagtcctccaaaagtcaatgcttttagagcatagggccattttaatgaggtcatcttccatgggagtgaacctctatgcagcaagtctttttatgaatgaggttgtttaaaaatgtgattattgccacttgcggtggctcatgcctgttaacccagcgctttgggaggctgaggtaggaggattgtttgagccaggagttcgagaacagcctaggcaacaaaggccaaccctgtctctacaaaatattttaaaaattagccagggacaggtgtggtggctcacgcctgtaatcccagcactctgggaggccaaggccagcggattgcttgaacccaggagttcgagaacagcccaggcaacatgatgaaactccatctctacaaaaaattgcctgggcatggtgatgtgcctatagtcccagctgcttaggaggctgaggtgggagggtcactgagcccagggagtcgaggctacagtgagccgtgatggtgccacttcattcaagcctgggtgacagagtaagaccctgtctcaaaagagagggggaaaaaaggcatggtgctgtgtacctgtagtcctagctacttgggcagctgagacaggaggatcatttgagcccaggagttggaggcaacagtgagccctgatcatgccactgcactccatcctgggagacagagtgagatcccaactcagatacataacaaaacaaggctgggcatggtggctcacgcctgtaatcccagcacttggggaggccgaggtgggtggatcacctgaggtcaggagttcaagaccagcctggccaacatggtgaaaccctgtctctactaaaaatacaaaaaaaaatagccaggcgtggtggtgcacacctgtaatcccagctacttgggaggctgaggcacgagaattgcttgaacctgggaggtggaggttacagtgagccgagatggcaccactgcactccagccttggcaacacaagactgtctcaaaaaattatatataaaacaaaacaaaataaaaatgcgattactatgattttatcctttttcctatgggagaacaacccctacaagataaatcagtttaagtgtggtggtgaaaacaaggtattaactagacagcttctctttgtccaggaagagtcagtggtgctccctggggtctgaccttgtgcctcttctgttccaggtagtggtgatcttcctttttctgggcttgctgggggtcagcctttatggcaccacccgagtgagagacgggctggaccttacggacattgtacctcgggaaaccagagaatatgactttattgctgcacaattcaaatacttttctttctacaacatgtatatagtcacccagaaagcagactacccgaatatccagcacttactttacgacctacacaggagtttcagtaacgtgaagtatgtcatgttggaagaaaacaaacagcttcccaaaatgtggctgcactacttcagagactggcttcagggtaagacggcgtgggaggctctcgtcctttcggtcttttgcgtgttcagcttcaacaggttcctttgtcatgattatgagagcgttagattagaatgtaacactgacgtgtttcatggacttttaagagttgctcaagattcttacatgaactgtttctgcagcagcctcccagatctggcttttacctataaaatgatgcagataattcagatgagcttctgtgagaatgtacaagtgcacgtcaggaaaaggggagcatgttgtaacaggtggagccgaggcttctggtgctctttcctcttggatagacggtggctagtttggtgaccacataaaatcaaagtgcggctgggatttccagactgattgccaaattatagcttactgcaccaggagatgctagataagcagtggacatagtcttacactccatattttgaccatctctttaaaaattatctatttctaattgactttgtttttagagcagttttaggttcccaggaaaattgagcagaaggtgctgagatggcccatatcccccttcctcacccacacacagccccctcgactgtaaacatcccgcaccagagggatgcatttgttacagctgatgaacctgcacattattacccaggctccatagtttacggttgggttcattttgaccattttttgatttggtacttgaagtaaagttataaatgcttagtaacatttcacattattttataaataattaaattctgttttaaaatgcctttcttggtggggcacagtggctcacgcctgtaatcccagcactttgggatgccaaggcgggcagatcacctgaggtcaggagttcgagaccagcctggcctactagtgaaaccagctctctactaaaaatacaaaaattagctgggcgtgctggtgggtgcctgtaattccagctactcaggaaactgaggcaggagaatcgcttgaacctgggaggtggaggttgcggtgagcctagattgtgccattgcattccagcctgggcgacaagagcgagactccatctccaaaaataataaataaataacagtgcctttattggcttcttcactcttagaaatgtttctaggaaatattcatcagctggaggggaaaaaaaagtctaaattttctcctgaccgactgcacgtaaatgtatgcagtgattccaggaacatctgttcatttattctgcattgacacatgcaaagccaagtagagaatcaggataattatccacccaattcaagcaaaacacttttactggagtaccaaatcattatggcccccaacattttttggcttggattatccaaatgattgtcttaatttcccacttaattaggcttgtttaaacacagatgtaagtgccttttttggtctgaagtcaatacacttgtatgtaaagactcagcagccagtttccctgagagtttgcaggaaatggtcaacaacttgaggttggtagaggatggttccatacagcttctggccttgacttgtgtttaccagaactttgtgtctacatgtacacccaatttgactttccttttggaggaaggtacagagaacatgccatgattattatttattaacaccctcctgagacgaacgtgaatttgttccaagttttatttttcacatttagtttagaaagcaatggtttttgggataatgagttaaaagagagacagtggagagagtccctgctttcattttccccccattgaccaaagacatataaataacttgccacaaatgacaaagagatctgctgtgccctgccagtctgtgagcagagaagggttattgtagagtgtatttcagtgtctttggccattgctctggaggctcaatgtggcatgttaggcagggattgggaagggggtaaagggggattgtctcgaggcagtgcaaagggttaacctttttatagagcattgtagatcatctctatacgtttcttcctttatagatgtaaatcagctggagttgagtttttttttttaaggtgcatttgaatcatgttttgattgctgtgtgaacagcatacacctagaccaagtgagatccattggtgctaagcaatcagggtcccaggcagccctgggactccatgactgactcttacagggtccgctagagcactcaacacagaatgaccagacactggagccctttgctgcctacacgtttttcaggcctgttgaatggttgatgtggtgtttgaacattttctacaaggaaacaattatccttgagtcagctttccttgctgacatttttgtgtggcttttaaatggtgggagcctcattggtttttaatggaattcccattaaaactatgtcatctcattggtctttatcgacattacaatagtttgtctttgattttttttactcctaaaactatataatggttaatttcaaaactatcccacatgtcacatcttaaaacatacatgcaaataaggcagagtcagataaaaaccatgcctcgagtcatgtacaaatgtgttcatttttatttcacactggattatgcaaacaaaattttgattaacattttacttctagggtcccatagctgaaggaaaatgggcaattggggttattcctttggcctagaactttacattagaaaataattattgacacaaaatattcataagaggagaacttctagctaagatattaaggtttgctgtaaaataagtaaaaagtcacaattttctagagtgtgcatgcattggaatatgaagcactggctaaagggcagtggaaacccaaccttatcccttgttttgtatccagggtcgtaccttgtacatgtgcttaggccagccccttgttacttgagctttttggtgattagtcagaaaatactgtagtaatggggaaagaacttaactgttccagaaagtcgatgactgtttcgtattcatctttgaacccccagtagagtgaatggcacctaagtgaccagcagtgtggattctgagttgaatcgagtttccagcaaggctgacctccccagataggatctttcttcctttgtttcaccctcgggtgtcccagaagtctttgtgtgtgaatatcataaaaccgcccccagattttggggaccccgtttgccaccagatgttattgatgctggagttgaacctgcttgtcttactcctgcctttgacacatccttgggtaccacggtgtgtccccgcactgtaggccagtgagtggctccagctgcctctggtgacttgctgcctgggtttgagctccatccaacactcacctgctgggtggccccctccagtctcccctttccaagactcagttcctccatctgtgaagccggagtgattaactctaacggggctgtcccttggttgccgtgggatgcccagcgccaccccacactcaccaagtgtgagcctctcttcaggattagctggttaagggagaggggcttaaagcccaggacacgtcatgacatcatgaaaattgttacagcgaggaaaacagacgaggcctccctttttgaggggaaaggaggcgcagtaatttttcttctgctgtttattgtttttcaaaaacagaaagaaagggctttcagtaataaaataacatctgctcagtaccctgtgtgtgcatgcctccctatgaaaacccgtctgtctgagaggtgcacggcccacccggtggtctcctgtcccgtctcccctccacgctcaccctgacacagactcctttcaccaccgagcccactgtcatccccaaattgttcctctagccagtagtgtcagaaggagggtttcgcttcttagagagacagaagggggcctgtgctccccctccctccccacacttcagaccccaagagcttaaccattctgagcactaacgcaaccagattttttttgaagcctttgaaatcatccaaggcatgtcccgaaatgaaataaacgcttctcccttcttactagccgtgtccaacccatacatgtacagcttgttcaaaagctgtggtttcctgagctgctggggcttgggagctctacttgggaggtggctgggaggggcaagggtgggtggggggaggggggtgtcccggagagcgtgcgcaccagccagcgctcagaccctaaggccgggtcaccggggccctgttttctcttccaacatgcttatctctttacagctgcagccaaaccgtcaggtctgtaatgatggttttgattactgaggccaagcgcagctgtgtgtggtgtgctggcgggctcgcccatcccccaggcccagaaagctctttcctccccctccccggcttgtggtttgtcatctgttctcacagagcctccttgtattggcctgtggcttcctgttctcaatcggatccaaatttaccctgtgaggtatttccctgcgtgcacacgagcgccttcccttccttctcctccaccccctctcctgaggaagggtggcagagaggaagagagcagtcgagagtgaataggtgttggctgtgatctttacacaacctggcagcggatcccacagcttgtgttagctccacaagtcgaacagatggaacaaattgacagaatcgtgttcgctcaccctgggctccagaagcagctgagctgctgtttgaagttgggggagtttgaatgtgctttttcccctctgtgtggaatttctggttgtattgaagaactcatgacttagcaccccgagtggcacgaaacggttaatgaccctggtgcgtgtctttccgtcgcactcttgccttcttttgtaattgtcatggggcgaaaggaggagagtggtttttcttaagataaaatatgagtatttgtttcatagaaacagataatctccttccccccttttgagcagtggctggcagcagctgcagttcattcatgaaagatccagtgctttcagtcaaagtggatgtgggacacagagggtgtgtttctgatggacgtctaagagccccctgccctgctcagtctcctcagcccaccccgctaggaccagggtccttctggctgcgagttataatgtgttacaatcatttgccatttctaggacttcaggatgcatttgacagtgactgggaaaccgggaaaatcatgccaaacaattacaagaatggatcagacgatggagtccttgcctacaaactcctggtgcaaaccggcagccgcgataagcccatcgacatcagccaggtactccagctgctgggcactgagggcgcttccagggctgcggggccgctgccctggtggaggctgcttgacagcgtgtgaccccaccctgtgctctctggagacctaaggcactgggagctggtagaaagaatattgggtgactctaattcacctcctcccaccagctaattgtgtgacctcaggccagccagtgcacctcactttcctcatctgtcaaatgggacaggcgtgttcctaccaccagaacaattgtcagaataaagtgcagccaagagagtgcaggctctttccaatgttagaaatgcagcggcgtgtgattctttcagttctaggactcggtaccttgttggtcttgatggtattcaagcttggaaagatggatttcttgggtagcagtcatttggatgagcagaatttggggtaggtgggtgggttaggagattggagaggtgacagaaggatgggaagatttgttacatttgagatctttgggtggccctggccccaggagtagacagatcgctctgtgatgagtgaagcaaacggaaatgtgcacccttggaatcagagtggctgcgccattctgctcactcctgcagtaataaccgtttctgtttgggaatcatattctccacttgtgtttgcatcttcttgctgccatttggattccagcataccccttttggttctgcaggtgtgttcaggagtgtgttttggactcctccaattgcacggggcccgggctacctcagcttcctcggagcctcttcccttggctctttgtagcttgcttgcttcaccttcaggcagaaaaccgtcatgctaatgatcttctcagcagctatgtttattgtctccccttttttgctggcattcaaggtgacagatttacaaagtacattgttcagagttgttatggagtgtgaaactctgagctcacagcagcaggcagcagaccatcacgtttcccaaggatgcaggcagaggagtctgcctcagagacaccaggaaagtgcccaggcagcagggctgggcgagggaccagggatactgtgggacaaatgggattgggccagacccccagataccatttcctcctcccgggagggagaaaggcgtgctgcatgcacagaggccacgggctgcgctgtttgattccagggatgtgttgaggacatgcagttgttacatatcctgtggattaattgaatccagatccccgaaatccagttctctcactctctccctgctccttcttccttcactccttctctaggagccgctgtcactggtgtttttcattttgtttaaaaaagacccaaagcgaggaatgaggcctgaatctaaaataaacaggaaacggaatttttctatgtatataaaacgtacaaacacatactgagtcccacagagttccccacctcagcaaagcccacaagccctcctgccgagggagcacatttggccacgcagaggacgcggcgtgcggagtactacgacctccgggaataagatcacctggcgaggcttgagggtgtgcactcgtcccttgcactttctggcgctgggcattttttgaatccacaggtcataggaggctagtgttagcaaaatttatacagatgttgttttatttttatagctctcctccatttactgggtggcatttccttcagtgttaacaacagaggttaactgcacacagacgtgcatggggattcttgccaggtttctcccccttcccctcctataaatatgtttctccagattgttcattctctgccttggctgcagacggtcttttagcattcagatttaattggttcagccaattcctgggccatctgcagaactgtgtttgttataaacacgccagtgattgcatcctccgataagtgcacattgaaagaaatcaaaggtgttctgatgggattttcgacactttcaacagtaggcattctattctttgttgtaatgctgtgcgaagctcagcttctgtgctctcaaggcagaagtgtgtttacccccaaccccattctcaaaggcctctgttcttcccgtttttgtagttgactaaacagcgtctggtggatgcagatggcatcattaatcccagcgctttctacatctacctgacggcttgggtcagcaacgaccccgtcgcgtatgctgcctcccaggccaacatccggccacaccgaccagaatgggtccacgacaaagccgactacatgcctgaaacaaggctgagaagtaagtagcgttttatcgggaggtctgggaacttacagaggtgccttccctggttctccaaactcagcaacagccttcatccgttgacgctacccagggttcagaagtgtaaacagaacaatctatttcttctcgtttaaaactctgggagacgaggatgtgtaatgggatacaacccccgcactctatcacattgggaaatcagtgtctcgtctccattcgtagctttaatgctaagacgttcattaggcgttgctctcacgtgccagctgttccctgtgaacaccggggacgcctccaggttaagtgttattttactattgcagagttttatcgctggggattatatgtttatcttaactttgtcaactctggtgttgaagggatttttggcacattgggtcattcctataagccaccaagcacctgcactgtgtcaaagctgtttaaaccggagcagaaaagtctgtatacaacagcgtcctcttcctttcacctctcagcccagagtttgaaaggtggttctgtgtggatttcatttgcatttctggtggagatattagtagcgtatgctttggataccgggccaagggaggatgtgagaaagaagacgggtccccttgcaaacatggctggagactcagcgagtagtgcttccccggatccagtgctgcccagagccctgtggcaggcagccaaggcttgtcttaatgaaaatttatagttgagattataatagggcaaatcatgtttagcaagtcaactgaatgaccccagagggtctggaacacacaacggcagtaactaaatgcttgttgtgtaaggatttcttcccctgttgctgaagacttagcattgcattagaaaagaagcatacaaggttgaagtttgttcaggcactaaaaggataagttaagcatttttctcaggaaagcatgactcttgagttcttttgctcttgcaagtgattgaataaaactgtgtgaacttggtattttcatatgtgtcaagggaacaaaaaaatgttcccaaaatgtaagcctggagtttttagacccctcacaaagaatgactgctggaagattaaaatcaaatcttaaaaaatacacacatcacagagttaaacatttttaaaccaaatgggaagatcgtaaaggcctggaggctatgatcagcattgtttgttctttgtatcatgtagaagagcagtcagtaagctttcatgcaaagttcttctctctttccattgaaactgtgatgctcttctaccctgggctgctcctaacctgtgcccttctctgtccagtcccggcagcagagcccatcgagtatgcccagttccctttctacctcaacggcttgcgggacacctcagactttgtggaggcaattgaaaaagtaaggaccatctgcagcaactatacgagcctggggctgtccagttaccccaacggctaccccttcctcttctgggagcagtacatcggcctccgccactggctgctgctgttcatcagcgtggtgttggcctgcacattcctcgtgtgcgctgtcttccttctgaacccctggacggccgggatcattgtgagtgtattataaggggctttgtggaagtcaaattcctttcagcatagctctttctgcagccgggaagttttgtttatgtctgggcctctggaggagggtatagcttgcatcatccgtaatatgtttattctactcgaggtggtgaggtccatggttaaggtagaacctctaatggccttattcgtaggtcctctctcctgtagcttgaagatttttgtggaaagataggggactttttaaagcacaccttccatcacagctctgaacatttattaaatcaaaacactcaaagcctagctcattttttctttaattgaaaagtgtcattttgtgacctcatccaggcctaataacgacatagcaggttcttctgcatttaacatgaagggacaatcagagaagttaggagagtgatatatggagaaaatgattttgtgtgttttaagtcctgggggaaaatgataaactaatattacgaacctgttttttggcatcccttctccaaaatactctcagattttgatgtaagtttcatgtagagtctaataaaaccgtggcaatgtttaaattctgtgaactatggtatagcctttaaaatgccaaaattataaaaacaaaggccagattttgtgtctgcaccgtgagtctgtgcagcaggtacattaaaaggtaaatgtttagtctgtgagagttttcatggcacttagcaattgatgttgtccatctttcatcattccttcccctccctccacctctgcccaccacccacccccagagaagaaagatcatttttctccttctcttccatctggtaacttgttgtttatttgtatcttctccgctttggaccaagaaactccaaatctaactcacagattttatttccatttccccacaaatttttacaaggaagatgaaaggcaagaagcttttccttggattttaacagttggctcagtccaccccagctgtccccagctcttcaaagtgcagggctcctgtaacctgacagcgtcagctgatgacgacctccccgcttacctggcccccacatcatctttgcttagcctgcaggttcactcacaaaagcaaaactactttgacctgcaaatcttttattcaccccgtcctatcagctttctttagaatggagagtgaggcaaccaaaaacttaatgatgggttcacggatggtctctggcggctgagacccaagcaggaggagagatgggtcttgttgtaaactgtgaaattcgcagctaagtgatgcggccatgcttgtgcaattcctcgtggattgcgctggtggagttgttctgtatgttttttgctttctggagaaggtacattggaaaataatttgcattagaacactctactttgccttctacagctttacacatcagctgtcccacagtctcccttcccagcgggaagatgaattaggcagtaaaggcagtgtccagagttaaagcaagtcagtccattcattgttttgatctgaaccgaggacaccttagccctctggcgacctcccttgtgggcagccccagagggtgacctgcccgcccactgaccactgtgtgccctgctccaggtgatggtcctggcgctgatgacggtcgagctgttcggcatgatgggcctcatcggaatcaagctcagtgccgtgcccgtggtcatcctgatcgcttctgttggcataggagtggagttcaccgttcacgttgctttggtatgggagacatttgaagcaaaaactttgtgaaaaaacaacccatttcctctggctctgtttgtctccaagtgggaaccttgcattctccctgtgcgtggcagtgaaaaggcctcagggcacaggggccccctaggagagcctgcaagatttctggattcctttccctcaagggaggctaaggagaggggtatggaaggtacatggcagcgggccctgtcagccgtaggcagtgcagggttggtgtgttggagtgggccttgaagggccgtgctcacctgactttgactgtcattatacccccacgattcctgacgttgtgacgtttgttcataaggcggattatgtggtgagtgtgtgggtgggcatacacagagttttaaaaacaacaggaacagtggggataaaatgagaccacactcacaggcttggggatggcatcactgaggatgaggtgagctggcagccaaggaagtaccctcgggcttaggagtggaggctccattgttcagccccggggaactggctcttctacctaagcccacccagttcctcagacctcccagcctctacattcatgatagcagaaagtaagagaaccagtgttgctttcaacagacatttttttccctctctttttctctatcttgccctgtgaatgctttgttggaggtaattaaacttcagaaggaatctttagtccaagagataaatctgttgtatacatttatcaaagaattatccaaaacatcacaactgtgtaaattatgttctgtctgcagattagagcctaagaacttggggttatcagtaggcattcaataagtaaatgcgttcacctgttaaatatcgacgtgcgaaataccctagctaggaagccagcactgggcttgaccaaatcacttccgccattgcttttgcaatctctagcacaggtttcctttgggctcagcacatggcacatgcatgtctccacataggctgcagccttgtgccttctgcagtctttccagggctactgtgatacaattgagagattgtaaacttttgtgttttggaaggaatgctttgttgaagttatcccattttttttacagtgtatcataaaaagccaataatatggcaacagtattctctaaattttgagcctgctcaaattattttcttcctttgagctgggaggagggactatttttttaaaaagaagagtgccagcctagagtttagaaaacccataattccaatacagttcttcaaaagggagataaatttgcatgtgagttaagaatccataagttattttattctgatgcaaatggaaaccaccttttttggaagctagcagggcaaatgggtatcccagagcagatttttaccatggaaatgctaactgcagtctctaaactctaggacttctagtccaagtcattttcagtattctgatcctctatgtgaaattgcatttagagttggcagttattgctctttcaaggtttgtaaaatggtagaataaggctgtgaagaagagtcttctttcatgaatgtctttaggaaatcagtgggttcccgttcatttgctgtctcagtaacatagaaacagtgtgtgacagggtagtcacaactaggcccttatggcctcatggcccaaatatgatgcaagccagcatggctgaaaaacccctttggtgccttgccccaagagcagaaggcagctatattgaccctaatgtctttaccaactctgaaagagtagaacctgtttgagagaaaagtatgaaaactcttagcacacctttgtatatttgtattttttcatctgttaaggagaacgaccgtctcagtccttctgcaggtaggtaagggatagaaacgcatcctgccaaagacacccagccctctcctctcggcataatccagagcagcctgaacttcagagagagaacttgtgccaggttcaacactccctgcaggggtcacacgttcaggccaacagtctgatcttccagaatttactctgcaaagttcccgtttagttatcaacagcatttctggcctaggagagctttaggactgcaggagagacagggatgtgtccacacaatgttcagaagggcttgattcaaatgtacggtcctgtgtatttcttgcaatacactcatagtgcttagatgtactacaaacatagcctgaaacagtgacagaaggtctcacctctgcataatcgtgaggaagtgtgtgtagcacccaattgcttgggacactgagctaagctcttagccatccaatgcattagccagaatcctgtgctgtgggaattggaggtctcacgtgtgagtggtgtgagatcatttaaggaggggggaaacttcggggtgagtatcagtgaaaagaaggggacatttctgtccatttttatatagttttgattttactgtgttcaagatttacgtcaacaccaaatatgacccagtgtcatgaagaggtcatcttagtttaagtctaggtgctgctagttgagctactctgattacacattctagcaactaaaacagtaagatgtgagcagttctgagagcttgtaacatttaggacagagctgagcatttaccaggtgaagtccagcaacctgatcttgtgaacatcctcattgcacaggcctttctgacggccatcggcgacaagaaccgcagggctgtgcttgccctggagcacatgtttgcacccgtcctggatggcgccgtgtccactctgctgggagtgctgatgctggcgggatctgagttcgacttcattgtcaggtaagcaggcgtgtgcaaggagacatgttttagaaatcattgtgattgggccgggtgcagtggctcacgcctgtaatcccagcactttaggaggccgaggcgggtggatcagaaggtcaaggagttcaagaccagcctggccaagatggtgaaactcatctccactcaaaatacaaaaattagccgggcgtggtggtgggtgcctgtaatcccagctacttgggaggctgaggcagagaattgctcgaacccgggaggcggaggttgcagtgagctgagattgcgccactacactccagcctgggtgacagagcgagattctgtctcaaaaaaaaaaatattgttattagctcaggtgatcttcgttgcttatttccttctgtatctggtagattgcagcacctcgtcatcgtgactctgctttcttttgaacttgttaacgtagagatattcggaggtataaagacaagctctcttctagagctgtcttggggagtatcttgaaaacagaaggtaaaggatttggggctggcagcaaagacaactctgcagcttgaagccaaaggatcacccaataggtggcccattattgtctcgggttagaaacactgcagaaagaaatgccacatttgacctacgctccctctccttcaaactgtagaaaggaaaacttaaaaatacctaaaattgtcacctgactttattcttttaagaagtgaaaatgacgtgctcagatttcatattcgagtccccacaattaggaagcatttagcattggactttggtgtcaactcttgggaatctaagcctagtttggatctcaaggcaagtcgtttccagttgatttaattaagaatatgactttgtgaaatataaaagaacagtgagttttccttttgaaaagaatttgagaactgcagaggaggaaaccacttgcttctttgagcagcctccatggctttgtgagggacctgctcttggatagaactctgctactttatggagctctaaggccagaatcaccaataagtaaaagatagtccaggattagaaccatgacagggcagaaccagatgtgagaaatgattggtttgtttggcacgcttcagtactgagaggttgtgtgtgtgtgtgtgtgtgtgtgtgtgtcagagagagagatacgcttcttatcttcaagtaaaaagaagagggtttcaactagaagttttagccaaagttttattacgggaaagagatgagtccattggttggcctgtggcatagcccactgggcaatttggcatcatggaggccgccttcttagaatgagtgccaagcttgcttattgtagtttttgcatagagtgaatggtgaagtggaatcgctgtagaccagcgcttctcacaccgatgtgctgaggaatcatctgagggtctaagtgcagggccgatttcggggggcgggaggtgggatgagggctgggtctgcatctccagctacctccctgcaatgtccatggagctagacttctcagcacaaactactgctaagccagcaagccagttcctaaattcctgtttgccaataccaagtagagagttgcccaactgagttaaatgttttggtctgtgttttattttagttcttagtttgattttagcttttcctttgttcttagtatacactttttcaggcactaacgttatcattatgatataaaagctcaatgtcaagtagagtttcttttgcatatttactttctcgtttaacacaaatataacaagcaccccataagtgccatttgcacaacagcaaataatggggacccccatatccctctgtgtagcctaaggtcttttaggggagagacaagttcacaggcaaaaccaggggaaatgcaaggtgtgctggggtctcatgagttacaggagggtctcgctcagccttgtgggggatgctgaatgaggaaacttagcctgaattagagcccccagctggaaacctggcagctggaatcccagcgctctcctctcagccggggttgttcccgcccagaaatatcagggttcctctttcaagcacttaaaagggcttcccattttctaggatgggatggattaacctgataaaggcctcaccaaggtcaaataaatgagcagacactgtatatgctaagccgtcagaaatctaattggcctgtttatgcttcagctagatggatgggatgcaaatgtcttaatgtggctgctgatacatgccccagccgaaagttccagcagtttacattagaccaagacattggctgcttggtttttactaatgtagttcagaagtttctagtgtttacaatagctgtgaggtatttgtatttttatggggattctctctcctttcatctgatgtcaaaacatatatagacatggcagcactggttgcctgttccattttatgaaccagaggaccattaacagatagatatcttgccccccccttcccagaacatcctgagcctctcccctaccccagcccacttccatcagagttgccctagaaatcattagttccagaaacgcatccctgcgtggagtctgtgccctccagccatgcagagtgtctgccagaggctgtccctggctgacaggtttaccttggtattcatgaaggattccagaccttagccctcaatggtgggaaagcagaactacttctgcactctcctcctctgccatggtgctgcggcctttatgtttgaattggctgacgcaaaacaagagtattcagagatgctaaattgttcaacaaaagattggcccgcagagcagccccgccattgtggagtgccctcacccagcacaatgccccagctcccacagaatgggcagcattttctttgcagaaagctggttcctgtgttctaaaaaggttgcaattggagctatttggtaaaactggaactcacagaattctaggcagaaagttgtgattaatgaaaggccagggaaagccttacctgatatgctagagacttaattagagattctgccgtaagatgcagaagcatttcacagtggattagcagcctgcagaagtgggctgcttttcctcctgggctaaattgtttaaattctacacccttcacttcatttgtttgcttctgctgggttttcacgagcggggcccctcggcattgtgtttgtgctttcagtctgcccagccattcaggtcgcattccatatttttgtgtttgtgtaacacattcataaataacattacatgccatcagagttcagcaaattaacaaactaattttttttttcttcccttcatgaactaacactttgggttgtggaatgtagtcctcaaagtcataaggtaaagaaacaaaaagcaaaaactcaccttgtgttgaatgtgaactgcggttggataacagccttttcagtggggtgggttttgttcatttctggcgttgccatgctgctgtgtcgggcacacggagggtggcgcgatccaccctgtcacagcgcgtgttcccgtttcctcttgatctcccaggtatttctttgctgtgctggcgatcctcaccatcctcggcgttctcaatgggctggttttgcttcccgtgcttttgtctttctttggaccatatcctgaggtcagtagtgacacggggatgtcccacgtgtaggccggctgaatgctgtgtttcctgtgccgctcttcacttcgatacttaggtgcctccccacttgctggtggttcttcagtaaacatctcagagtcatgtctgttttcctcttcggtgtactggctttgagggctagagggcgggttcggtttggttcctctaaatcaactgattggcagcctgggtcttacagatctttatacagtaaatgaagactttccccttgagatgcataattggacttcacaagagtaaaaagtacacatcctgcctttccagtgtggagcagaggacagttcttctgctccagctgcgggacctgaaggtcctccaggtggtagagaaggggaggttaatacggcacagtgcgcagggccccagggcagggaacagaggcccctgaaaaataccgtgctttgagctttgagtgtggccagcaggtaaatggacaagaacacttttaacatggaatccccttaaataggtgtctccagccaacggcttgaaccgcctgcccacaccctcccctgagccaccccccagcgtggtccgcttcgccatgccgcccggccacacgcacagcgggtctgattcctccgactcggagtatagttcccagacgacagtgtcaggcctcagcgaggagcttcggcactacgaggcccagcagggcgcgggaggccctgcccaccaagtgatcgtggaagccacagaaaaccccgtcttcgcccactccactgtaagtgactctgcagaaccagggggaggggtcttcccaccgtggtagtgggcctggaggtccagcgggggctcctgtctgctgagcagcacatcacacaggcagatgggatgcagagataaggtacagactaggtcaaatcataggaaataaccagtatttaactctttctcaactatacaaatgccatcttcctgtggtttgatctcataaaggataaaaagggcaggggccagtaatgtcactgcacaaagcagtagcatctatcttgttcagggtgaggacagtttgggcttcaaaggccagagataaagcattcctgccttttttttttttttcctcttaaggtgcatgtcatttgagagtgatattttctaaaactagtagtatttttattgccaacagaggtcaggttttttccttctctcatttctgttaggtttcaatgcccttgatacaacattcattattattgtctaaatactttaccatagcttttggggctccaagctcatgttccaggtggcaggaaagagcagagaggccaagaaccacccctgagttcttagccttcagtgattcaggaggtcaccaggagcctgggagcccctcctcggaggctccaaggacctgggtcctttcctccaccctgtgctccctgggatgggctcagccctgaaaactcaaggaaggttctgggctgatgttgctccactgagggccccctgctgtccctccaggaaatgggtattccagtcccaggccagagcagcccttccgtgaaagagagaaaggccaaccaaataacctgaattgtcctcctcctaccccccgcgacgacgcccgctgagctgcagtgtgaatctggttttgttcagcaggagcctaaaaataggtacaagctgaacgactttgaagttggtcacggtccttttgattgatgtggccactgtgttgctctgtgctttgtatagagacgcagagaccagattcttaacaatcagatggaacaggctgcccgccacagccctccgcagtgacgaaaatgccctctctgctttccaggatgggagccaccggccacacgtggctgtggagcacttgaaatgtggccggggctaccgaggagctggattttggattttagttcattaaaacttaagcaaccacatgtctggagcggctactgtgtttgacagagtaggcagagacagtcctgccagcgtcctgcactcaggccagccagggccgcacacttagcaacttcgggagaggggcagctcagagcctgcagaacctaacagggtcgggggcaggttgtggggggcagcagcttggatgctctgaccacagcccacatttatgggcagcagcagtacgtgtccagccagccgtgtcagagaaagcctggaaacaggattttcaaacaacacgctcctccgccaggtcctggaggttattagaaggacaggcttttcttttgtgggtggaaggcccccattggctccccagggttgactgagtctttggtgaaacccaaggagggaagtgtgggagctgcggggaccatgcccagcctgggataccacccttctaacccaccctcaccctctgcaggtggtccatcccgaatccaggcatcacccaccctcgaacccgagacagcagccccacctggactcagggtccctgcctcccggacggcaaggccagcagccccgcagggacccccccagagaaggcttgtggccacccccctacagaccgcgcagagacgcttttgaaatttctactgaagggcattctggccctagcaatagggcccgctggggccctcgcggggcccgttctcacaaccctcggaacccagcgtccactgccatgggcagctccgtgcccggctactgccagcccatcaccactgtgacggcttctgcctccgtgactgtcgccgtgcacccgccgcctgtccctgggcctgggcggaacccccgagggggactctgcccaggctaccctgagactgaccacggcctgtttgaggacccccacgtgcctttccacgtccggtgtgagaggagggattcgaaggtggaagtcattgagctgcaggacgtggaatgcgaggagaggccccggggaagcagctccaactgaggtgagtgccactgacaagggcagccaagggacctagagccaggcaaagaggaggacaaggttctcctggggttctcggcatccccgaggggctgtggcgctcgggcacatcccacgctggaccccagtgaccttttatccccagagcaaggctgatgtgtccaagctttgtcatccttggggaaccagtccagctccacactgctctcttcccccactgctaacctgcggagggtcggtgcagcgccacaaggacacaaacagcaccaccttttaccaatatttgccagtctttatggaggtgcatgccacagcgaattggtcacatgggaacgcatccgtgtaaccagcccccagatgaagggagaggtcacaagcagcccccagggacacctcaggcccacaccccactctcgtgatttctaataccaaggttactgctgcctgcttttgtactttataaatacggacttgcacacctcttactctgttcaacttccttttttgcttccttttaaagggtgattaaaatctgaagcaaagaggccaaagattggaaaccccccacccccacctctttccagaactgcttgaagagaactggttggagttatggaaaagatgccctgtgccaggacagcagttcattgttactgtaaccgattgtattattttgttaaatatttctataaatatttaagagatgtacacatgtgtaatataggaaggaaggatgtaaagtggtatgatctggggcttctccactcctgccccagagtgtggaggccacagtggggcctctccgtatttgtgcattgggctccgtgccacaaccaagcttcattagtcttaaatttcagcatatgttgctgctgcttaaatattgtataatttacttgtataattctatgcaaatattgcttatgtaataggattattttgtaaaggtttctgtttaaaatattttaaatttgcatatcacaaccctgtggtagtatgaaatgttactgttaactttcaaacacgctatgcgtgataatttttttgtttaatgagcagatatgaagaaagcacgttaatcctggtggcttctctaggtgtcgttgtgtgcggtcctcttgtttggctgtgcgtgtgaacacgtgtgtgagttcaccatgtactgtactgtgattttttttttgtcttgttttgtttctctacactgtctgtaacctgtagtaggctctgacctagtcaggctggaagcgtcaggatatcttttcttcgtgctggtgagggctggccctaaacatccacctaatcctttcaaatcagcccggcaaaagctagactctcctcgtgtctacggcatctcttatgatcattggctgccatccaggaccccaatttgtgcttcagggggataatctccttctctcggatcattgtgatggatgctggaacctcagggtatggagctcacatcagttcatcatggtgggtgttagagaattcggtgacatgcctagtgctgagccttggctgggccatgagagtctgtatactctaaaaagcatgcagcatggtgcccctcttctgaccaacacacacacgacccctcccccaacacccccaaattcaagagtggatgtggccctgtcacaggtagaaaaacctatttagttaattctttcttggcccacagtctcccagaaatgatgttttgagtccctatagtttaaactccctctcttaaatggagcagctggttgaggctttctagatctgtttgcatcttctttaaaactaagtggtgagcatgcattgtggtgtagaggcaggcattatgtaggataagagctccggggggattcttcatgcaccagtgtttagggtacgtgcttcctaagtaaatccaaacattgtctccatcctccccgtcattagtgctctttcaatgtgatgtgggaaagcaggaggatggacacaccccactgaaagatgtaggcaggggcaggtctctcaaccaggcatatttttaaaagttgcttctgtactggttctcttcttttgctctgaggtgtgggctccctcatctcgtaaccagagaccagcacatgtcagggaagcacccagtgtcggctccccatccaaatccacaccagcaccttgttacagacaagaagtcagaggaaagggcggggtccctgcagggctgaagcctaagctactgtgaggcgctcacgagtggcagctcctgttactcccttttaaattacctgggaaatcttaacagaaaggtaatgggcccccagaaatacccacagcatagtgacctcagaccctgatactcaccacaaaacttttaagatgctgattgggagccgcttgtggctgctgggtgtgtgtgtgtgtgtgtgcgtgcgtgcgtgtgtgtgtgtctctgctggggaccctggccacccccctgctgctgtcttggtgcctgtcacccacatggtctgccatcctaacacccagctctgctcagaaaacgtcctgcgtggaggagggatgatgcagaattctgaagtcgacttccctctggctcctggcgtgccctcgctcccttcctgagcccagctcgtgttgcgccggaggctgcgcggcccctgatttctgcatggtgtagaactttctccaatagtcacattggcaaagggagaactggggtgggcggggggtggggctggcagggaattagaatttctctctctcttttaatagttttattttgtctgtcctgtttgttcatttggatgttttaatttttaaaaaaaaaaaaactttgctgatatttataattttgtatcataagaatgttttcctctacagtatttgtcatgccagtttataacaaaaaaaaatgcagggattttatttctattggaaacattacagctatgttttacttttggacagaatttttatttgtatagagtgcttactaatgttaaatagttcagagtatataacatttacattaaggactcatggtaggttttagggtaaggagtttaaaggaaataaatattcaaactgggtctcattgccaattttggtggaaatgagtttgtgtcatttcaattacaaagataaaagtatgccatataatttatttatatgaagatttatttttgtagtgtacatagtagtcatcaagtcttttgacagaagtatatttttaaagaatttatatgtgatgaatccataatgtctggaactttgctgagacatgagtgggcacagttttcattgtaaattacagcaaggaaagaaaatgtttaacagtgttaagagagtcagagcagagtggatattcatgcgattatgaagtgtttattagttaccattggcgacctagcatgcttctcatttcaaaccttggaaggtgaaaatgtacaaactctctaaataattaatgttcaaacactgatagaaattctaacatgaataaaaaataatataacttgttggttatatctttgtttgtagaatgctttttttctttaaaatacttgggagagacagttagtgttggagccatcagaaactgttgtttcatcttgctgaccttgtgacactcttcttttttgctctatctgatggagagagttttaggttttcctcctttttgttttgtataaatagtgggtataagcatagctctgttacatggatgtattacaaagtgggggctgagcttttagtgtgatcatcacccaaatagtgtacattgtacccattaattaatttcttatcacctgaccctatttttgttttctcataccaagaaacttcctaagttaaccatcaaaattagtccttctgtcatctctcttagcatacttatttcccttatgtgatgcctaataatgagggaacataaataaagccaaattcaaagat

SEQ ID NO: 26 - DNA, 49063 bp, Homo sapiens
ggcgaggcgaggtttgctggggtgaggcagcggcgcggccgggccgggccgggccacaggcggtggcggcgggaccatggaggcggcggtcgctgctccgcgtccccggctgctcctcctcgtgctggcggcggcggcggcggcggcggcggcgctgctcccgggggcgacgggtgagcggcggcgcggcgggcgggcgactgcggggcgcgcgggccggacccggcctctggctcgctcctgctctttctcaaacatggcgcggggccgggggcgcaggtggcggcgccggggcccgggccgggctctcgtggcgccgcgcggctcggcggctgccgggcgaaccgcaagcggggagcggaggcggggcaggggcgtgtgtccgggcgcgggcggacgtgtccggctgcccgaggccgccccgctcgggactccccggggaggtggagtcgggcggagtcgtccgaggtccggggctgccctctggggtgtgagtgggcgagggccaggggcggagagtgcgaggccggcggggactggcagagccgtggctgcccgccgccgccccctgggcacggcgtgaccttgttctggggacccccgccccaagagggtccgtgccagaggctgccgaacccggggcggggtttgaggttggggtggaaggcggctcccgggcggggtgtgagctccgagcctctagggcttcgtccagtgggagtcgggggcgacgtgtggtgagacccctgggtccgcaggccgccctgactcccgcccggctcgacccgagccgaccctgctggaaggggctgctcctccagccaggggggctttgtgtgagaagaaggaagcgcggagatgcgcggaatgtttcttctttcgtgcgtctggggagtgttgaagtgagtccagtaaccagacggctacggattgttttcatagtggaaacttgaacgtttgctcattctgcgggttttggaaattttgggaacgactgtgaattgattaaacgctttttatttcctcgaaggaacatcactcacgttgttccttttcttgagtgacagttaatagtttgattcagacatctgtatagctggttttcaaggaagactgttggctggatttttcaaaatagtaaatcaggttggggtaggtggttggtatccacaaagggatgagtgaaaaacttcgttagcagctgaactgagacactagaagctaaaatacacagcctcagtgttagcaactaaaatgcagtgaaagtacatttctgtttctgaaactggacaaaagatgttgaaatttttttaaaaaatcaagactgacggtgacgattataatcagtcctaatagctaccgtctatgtattgtgcattactacgatgtaaatgcatacactattgtataattacattatttaatcaccacaagtaaactcccaggagtagtggcatttgccccactttacagatgtgcaaagtggggtacagacacgttaagtacccaataacttaagtgctaaagctaggattttcactcagatctcagtttcccaaacctgtatgtcatatatatatataaatatgtatacatcatactatctggcgtagcccatttttcttcttcagtcgtctgatgagcaattggtctttattatccactttggattctgtcctcatgatttgagtatcagataggcttcattccgactcttagcacattgttgagtcccttcacgtgggcctgcattagaggaaacaatggatttttgacattggcctagggaggaaggcaggataactgtgtggacatttgggagaatcagtatagttaggcatgaaacacaggtaacatttccacaccgctattaacttgaataacacagtgcactcttttccaccagaagtagcacaagaagcgttcatgtattcaagtaacagtagtggacttagttgaagacacagaacattgctcagtccatgtcctggaggagtttacagtctccatggtatgcacaaaatacaaagctgtccaggtgcttattactctaagcccagactgcctcagcttgtctgcctcccctgttggttatgatgatgcctcagtccacccttaaaaaacattctgaaaaaggtcaaatgctttttatttcctctgtaacttggcttcccttttaaagacttgcacctttttatgttctgagtatgttttaatgttctctgcccaacttctgtctccaacataggtttctctagggaaattgattccttatccctagtgcacagtttagtaccactatgtctatatgtatatcccatctgagaatgctatttgcttcctttctgccatttcataactttttttctttgaaaacgtgcccccaatccaactcttctatgaatgcctcttgaatgtctcctcctttcttggtatgcagccttcagcttaatcctgcctgttatcctccaaatctagttgctttcccatgtttttctcatctaggcttttctatggctactgccaaactaatcttcctcagccttccccgtgaaggtttataagatttcccatttgtattcagcacttagaacaacacttagcagcttatgattggggccatctctgagtatcctaccagggatctcatttctcattactgcagaccttcgagcaatttctctttctcactgactcctgactgttcagccttttcactacacatttagttttgcccctttttttgggagtgcgagaagttctcagccctgacttcctgtgctggtttagttcttgaattctttgtcttccagaactctgcaacacttaacagtttgtgttgtccatttctactgcctgtgctgctacttaactctacttgaatgcgttataggtacccagaggacaagattcatgccatttctttcttttgtggcctcagaacttagcactgtgttttatattctattccacataaatgcttgttgatttctatttgagcattcctttaatatttatactgttttatgtaagtccagtttatgcaatattaacttgtaattccgtataaataatcaggaaaagttgtatggcgtgttgaaagcaattggttatttgtcctaccttcaccagcagttatgcagaaaatggggcaatacctacttttgcctaattcatgagattgtgaagatcacatgagaaagtggtatttgagtttgaggttgctattctgtgttgttgctaaagagcaggactgatgttcaataagcagttcccactgggccatgtgtgttttggttaaacatcctttctgattggttggtacccttgtagtgccagttgttaaatatttttaatatcatttctatagggaggcattagtattcaaaaagggaaatgattagtgtaagctggaatgattgggggaggcttcttggacactttaggacttacactgactttgaagggtgggtagaattcagagggggatttgatgagtgtgaaagttcttttgaagttgtgtccccaactgtcctggggcctactccaagggaggaaacaaggcttttactgactgactggcaagttactcttcagagttaggttccttattctgtactgtggaatttggatgtattaacctctatcattttttccccaatcctaaaagctatagtacatagctggaaacaaaacataaaagtaatcaaagtggaatgagtgagggagaataacattatgggatgcccagtaggactaggcattcaaatggtggaagtcctaagtatattatcacttcaatttacagatgaaaaaacgactcaggtgaatttcttagggtggcacaggggcagaacagagacaggaactttgattttctgattccatatcttgtgccctatatggtgctttaaaatgtgaaggacttggaggtgggagtgggacagggttgggataggtggttggcatccacgaagggatgagtgacttccttaagtgaagtaggccttgaacttcacagaatttatgaaaagtgaattctaaaggtggaagggagggggaatgattaaagccttaaagttctcaaggaaaaggtcaatttttttttaattgctgataaaaggacctggtatatacttattgattgagaaaagtaggcctatagtagtttggaagatggtcttgagtaagtacagttaattgaattggggtgtagttagaaggctttggtttagaatattagatgatccgctttgttgttgaaattaagagaggaattgacataaaaataatcaagaggaagataaatcttgttcctgtgaggagggccgctcatgtagggaagacccctgtcaaaaggttctaggccttagttgagcagttacagggactcaacaccattcttgtagtgtcattttattgcaccaaatatgttcatgtgtaataaatggaattttgaaaatgccattatcctatggatggcccttctgatgtgagaacgtgtctcttcaaaccacagagccccttgcaaatgtcgacacacctcttgccttttgcagttcttccttggtcatggcttacgtaacacagagttctctgaacagatggactgtggtttgatatcatgtgattgggtcacatctttgcttcctgcttttggaattgagggcagatgctggcatatttctcagggattttttaatgctttgtcccatagaactagcttgaggaaaagttttggagtcttctcagaatttatggtcagttttgacccagcctaactccaatacttaggattacatttaatgccattcttagctgaattttctcaatgtcaaatccaggcagtctccataaacattaaaattgtttaccactctgaattagatccaattttatgtgttttgtttgctttccaggtaagtttcttatggctacccttcttcatcatgaagaaaattggttggtagacttgtaattattcatctcagacatcactttcttaaatactagtggactaagttcagttggttttatggtccaattttatagatcagatcaagtcttttataaagctgctccctcaaagaacaatttctaatctaacttaaaaaaaattgacttgcaaagtatacacacaggttgctttgaaatttcttgaagggttgcaagaatatgctacatattctatctgtcttgtctcgtttaattctctcttctctctttttttttctttgaccatggctaatacggcatcatttagttctcataaccaaccttgaatggtagttgtatagagtaccaaaacttcttacttatttgctgcttaatttccaaactcttaagcccatttgttcccagatacaggtgaccagtgctcagaagataactgtaggttttgataacatcggctctaccccaagattcttttcaactctaaacattatccaaaggtgttagtattttttcatcgtctaatcgtaaatatatatataaaagaaagacactgctttgaatggcacagatgtagactaacagtagttcagccactgagactcaaatgattttgtattaccataaaccccatctgcctgggcaggcagaattgacacaattttgctcagattggaacctagttcatatctatgaaagaagaccctctttgtttccattttatagaccaggaaactgaagttatgctgttaatgaaaggtggagccttcagttaagcactccagggtatgtactcttttcctatacaaatgctcctctacttatgatggggtcacgtacgtccatgctcctttcatatagagtaaatacattgttagagccacttcagcaggaaagtttcctttcccttttttgcaaaccatgagaatttgcttcagattgccttgattacagttttactatttctttgcaactgcaggccattcagatactaacagtctttctttaacattatatttttaggtaatttgaatcttcctgacgagtccagtgatagttgatcacttactatttgtattgatttatacatatattcatagcaaattcttttcttctaaaagttacataagcacaggactgaaaatttgtattagagaaaggaaaaaaaccatcaccagccattattaacatttggcatatcctgcacccatgcttttttttttttttttttttttttttttttgagtataaaaaaccattcttgggctgggcacagtagctcacacctgtaatcccagcactttgggaggccgaagtgggcgaatcacgaggtcaggagttcgagaccagcctggccaacatgatgaaaccctgtctctactaaaaataacaaaaaattagctggacgtagtggcaggcacctgtaatcccagctgcttgggaggctgaggcaggagaatcacttgaactcaggaggtggagtttgcagtgagccgagattgcgccactgcactccagcccgggcgacagagtgaaactccatctcaacaaaaacaaacaaacaaaaaaacagcaacaaaccattctttaatcattctatttcagcagtttatgaaagctaataaaagtgtttaaattgacaaacagcttcagtttacagaggaaagagcttcagtttacagaggaaatagctcatctattcttagcaaatatttagtagtgatcaacatgatgagaaatataggaaaagtaagaggcagtcttgcttttgaaaaaattgatgctgaggaaatatgactacagactcagtactagcaaccacagggactgctttacagaggaggtaggacttgatctctctgccttgcaggaggatagggctttgagtggatgtgtggtggaaaggaggcacttcttggctggagaggatggcatgtgtggagaaagagcattctaagtttcaggatttctaagaggagaaatggaagttcatggtgtaaagggtgggctcagagaattatgggccttgaaaatcaggagagtggttttaatgtggaaaaagaatgtctaattgtgccgcagagggaatggatcagggtggctacccagttggtttgatggcattgagaacggggtgaaatggtgactgtatgacatttgaaacaaagaaatcagaggaattagtagtagggcctgtgtgtggctgttcccttgcttgtgtgctcttccctcacatacctgcatggcttcctccctcacctcctgcaagtctttgctcagatgacacctttttctcagtgaggcttatcctgccaccttttaaaatattgtcatcatcctacagtgctttccttctctgtaacaataccttctaacatactgtatttatttacttatcatatgtacttatttactgtttattgtctccttcctatcattctatgctttgtgaaagtggatgtcttcgttttgttcactaatgtatctcaagtgtatggaaagtgcctggtgcatcctaggcactcagtaaatatttgttgagtggcagtaggtcttagctgtaaagaggtggagtacagaaattcagagtgactccatgaaagaaaaaagaatgactccaagcttttttaggctggataatgcctttaacttaatgagtaatttggcacgaggattaaggggagacgaattctggtttaagcatgttgagtttgaggtgaaggtagccaaataaaattgctcagtagtcagcaaagattaaaaaaaaatggaacctagttggaaatgggagagcaccttaagcaaagaaatggctactagcatctagcattcacctcatattctctctctctctctctgtctttctcttttgggggtaggaggattctagtgtcctaaaacgctaccttaaatggagtttttatttagaccctgaagtcctagcttgtatctggagtcctggtccgtttgctgggatatggttctttcctgttttgcaggttcatgctatttttcccccacctctcttagtaaagatgtatatattcagaattacttgtgatcttctggttgtattgaaattaaccttcagacagtgctgctttctctgcagtaatgcgtttgatcttttgggagtgtggttcttggctgagataaaagagaggaagtttcctgcttgcggcctaggcctcaggtcatggttgctgatgttacaggtgtcagctttactatctcctggagctccctgatggctatccttttaaatgcttttcctgttgtttttctcaatgaaccaaacactggtgcagttgtatccctagaccatctctctttttctatttggattgatctaacttaagtttttctttcagttttgaaggcagattaaattcatgtgacttggttgtcagaaatttaatgaaatatttgtttataggagtagtatataagcaccaacatatctggctgtaattagagtctaatcagtgtatctgtgactcacttttcaaaagaggatagttcctaatttacctgatcgttgtgaagatagtgtacagtagtatttacacttagtacatagcctgacaccagtaggtgttcaataaaggggaattattatatatttaaataagtgaaagaatgtcttctgaaagaagaaatacatgtctgtgtaatgaagaactagaattaattggtagactgaaaggcagaattcagctcaatgtaaggaatgactctctaccatagctgtcaaaatggaacattgtaaggtagtatgttccctgtcaccctggaactattcaggcagaggctagataaccttctgtctgagaaattgtagaaggaatttcttacattaggtaggaggtcggacttgtttatctctaagctctgtttctcctctaaaattctgtacttttgggcataatccaagcttccttgcttactggttttagccaaatatagtctaaatatccctaggattcatggcttcaagatgagcagtatcttgttgctcctgtattatacgagaaaagttagtttatccattgattggcttttattttggtcattttccaaaaaaggattttggaagcttgaaataatagcaaattcagtaagaccaaatctactgaccacaaaagataagaatcagtaagtcaaaaagggaaagaaaaagagaacaattatccgtaagtttagctgaggaaagctttagaagttgaacacaatacttagctctgagttttctggtaaccaaggcaagtaaggaagactgataatttgcatagatctcattgcctatcgagaattcatgaggagactgccaccttccttaataaagtggagccccaaatgccaagattgtcatacagggagaatctccaagtggtaaggggttattgctggatctggcaataatctgattcttgttctgaggcttcccctttaacacgtattgagggttcaatttagtgctgctgcctccatctttcttctccagtttaagtctctgatccaagtatgaacacattagtctttccctaatgccaatggaacagctgatgtaaggctaggacatttaaatcaagctttgctaaaagctggaggataatgaatagagagcaacatgaaactatttagtctggcttacaaagacatttttctcatgcccttatcttttggtgtgtctccatttgatacacttcatcagagtactgctaccaaaggcagagccagacatttaccttcaaacaggtgcaagtcagtaagatccagagtgtctttgcttgggtttcttgtttgaagaactgcttcatttctgagtaatggacgttcggaatgattactttaggagagaccacacttatctgagagtgtggccctactgtactggtctcacagtaatcccagtattcatggaaaagataggcacgtacattagcatgagggcattctgtggttagaagcattctgatttcattgggaaaaacaagcttctctctgttcttgagcagaagcttttatagaagtctttgtacatgggccattgaaaaataaagtgaacaattcgggtttatcactcatgatttgtaaggattcacttttccttttttctgcagttgctgtactacttcaggtctgttccagtgtttccttgttctcaccaccaagactgaacctccttatttttgttcatttgcttcaggaaaaccattccatctagatttcctaggtgtaaacctcactgattacataatagtgtatatttatagttctaggacaccttcttcaggcatcctgttacatttctacattataagattcttaaatatgcattgaattacaaataggtccccagggaaaaggcaaaaacgaatggctttttctgcgagaaactaggactaatatagatatttgggagcactgaacatggaggatagagttaaacttgaaaagacatacagagatagaaaagcagcaactgccctttcatttgtatgcaagcacacgatatatgtatgggttttttattttttgcttgatgtattcatttccaaatcaaactataatgtgctctaattgggtctctttgttcagcacgtggttgttgatttgagtactttctccagttgaaaaactgacattttaattttgttattcaatgtgtgatagatttaaataaaaacacccaagattgtgtattgtagatttccttcaacaataattatatataattattttatcaaaataaacaagttaaagtagttttagttattttgtctcattttacatttgggaaaaaaattacaaatcaggggccagagtctggtcatgtttgtcagtgaggaaagacaatttctgattgccagtcccaccaaagcgttggcagattaacacagcattgtagattactttcctaggaagagatgctccttttttctccctttccattattttgctttccttctttccatggtgcattgtccttttgttttcttccctcttatttcgatgcatgtataaacttgagcctttctgctctcacattctttctccccatgatcataattgtttcttcactttattcttaaaaaaaaaaaaaaaggccacataagtattttatgtagatctcatctatcatttaagttttgtcagatccagcctgctcttgccttaccatgggagaagggaaaggagggaggagttttaagggattttaggcatcaggcagaagtcttaagggaaaactctgcgaggaccaacaggctcagaattagctgtgcattgcaaacagatggtgtgtccctgaggaaatagcgtagttgccctaagcaattgggtgcttccatctgatttagcttagtctctgtaactgggaaaaaggaaaatcttatggaagaaatgagtataatcacctgtgaaccattctaaactattatctagagactagtgattattgacttacatatagatttcataattctgcaagatagtcttcggtgttgtatcatcagttatccaaggtataaataacatcaagacccttatgcctctgagcctgatagatccttatcttttaataaccaaccccccactttcttcagtagccatgatgctactgtatcaatgctaccagcaattggaaacccatattcctaatgccaagtctcggcatgtagattttgaggtctgaaaactttattagcttggttacagtacatctcaagcctaagttttcatatacacatagtttagtctcaaagggcaaatgtttccctgaaaggagttcagtcaacactagatgcttatatctttaggctccaagggagtccaaaatttaatgattaaaaatattataaaaatgcaaatatagaaataatacaaaagctccttccttttggtgggcttttctgtccttgcttggttcaattcagctgtgttcttctaggagactgcaaccacaatttaactgctttgctttggtattttgtttgacaagggagatgaatgtttcagatgagacggagtctcactgttgtcacccaggctggaatgcagtggcgcgatcttggctcactgcaacctctgcctcctgggttcaagtgattctcctgtctcagcctcccgtgtagctgggattacaggcatctgccaccacgcctggctatttttttttttttttttgtatttttagtagagatggggtttcaccgtgttggccaggctggtgtcgaattcctgacctcaggtgatctgcctgcctcggcctcccaaagtattgggattacagcgtgagccaccgtgcccggccttcaattttttgctttaagttagaatcctgtttgcttactttttctgacccaaatgttttaaaaatgttttcctgtgttttcatttaaaagattggttttacctctcacattgagatgtatctggagttggttatttattatggtatgagatttttattatttttaaaatacggatatctggttgactcagaaccatttattggtaaaaccttttttcccccagtgtacaatcaccttcatcataaatcaagaggttgtatatgtgagggtctgtttctctgtaatctctgttctgtttgcccatttgtccttgtgccattaccatactgtcttaattattatgatgttaggagtcttgatatcgagtagtgttaagtctttcaaagattgctttggttattcttgcgatgttgtttttccatataaatttcagaatcaacttgtcagttcccactgaataaaaaaaccctgtggggattctgatttgattttattgaatctacagatcactttatggaatattgacctctttacagtattgaatcttccagttaggaacttgtcacttttctccatttataaatacattttaaaattttattttatctcctttgtaatttctatcaataagtaatattttttaagctttctctgcagaggtctttacctgtcttttgttaggtttattcctagtttttagatttttaaaaaacgttttctatttattactggtttaagaatgattttttaatttaattttttttggtatagtgagtaaccttatattagtgaccttgctagattgactaattgattctaatagttgatctgtaggtcacttttggattttccatgtacatagttgtcctctgcaagtaatgatagttctgtgtctttccagtctatcttccttttgtttatttctgacttactacactcagacttctaatacaatgttgagaagtagtgatggatatctctttcttatttgtgatttcaagggaaaatgacagtcatgcaacattaaatgtaatgcctacttttatgccttttatttaatctgattatttcagaattttttttaaattctgcaatttactgaaatttttaaatatcatgaatagctgttgaattttatcagtttactaagatttttaaaaatcatgaatagctgttgaattttatcagtttttttgtttttgtttacatcacctaaactgccaaactcccttactgttttctttcttttttttttttttttttttgagacaggatctcactctgttgcccaggatggagtgctgtggcctgatcatggctcactgcagcctcaaactcctggggctcaagtgatccttgtgccccagcctcccaaatagctgggactacaggtgcgtgccaccacacctggctcaaacttttattttggcatcttttgtacaatgtttttgtatatcctctacctaaaatgactttcctttcttcactagctttccttaagtcttagtttaggtgtcatatttcagagaaatctcccttttctgtcctctgatctgtgcactttgcatcatcatttatcagtggtgtgttctctgcattgtgaatctgagggcaggaatctcaatcctaattatctctatcctcctaaaggttttttctttcttcctacacaggttacattcactgttgtgttctgagaaaaggtgttcaggccttgctttctgcttctaaaattactaactgcccaggaccatcagttcatttcttcaactgtggctccaacagatctttcgctgtttgctggcccaggtattgctctcctctgccccgagtcaatggcagctgggagtggttaccacttccttctcttaccacagttccttctctaccacagttctgttttgtatgtcattcccctagcccaggatgatcagccactttcatttacgttcattattacaccttattatctgtgcaaccaagccagtctctcctacagccactcgtgctttccaaagggaaaggttgaaattttcggttttgtcctacgtgaggggttgtggggagtaggggtggaaatcactgtagattatcaagtaatcctttttttctttgtgtacttttggaataaatctagattatgttgatgtaactgttaggacatttctgtttcttcatctctaaaggagctgggatctgatatttctgttcatattccttccagcatgaacattttatggctaattagatattaacttatttattagggatattacatatacacactgggtgtgtccctacactgttaatttgggttggaactgaaaatatactttctgtgtgtgcctactgctactgtagtgaagttcttgagccaggtctgttcagtcatattgttgaaaaactgtatgaatatttatgaaggagaaagagctgataggtaccatgaacattcactgttgtatatgcatatggtttatattgtgttctgtgtcagtattgcctaccagagctgtctcaacattagctctgattctctgtctagcatctagaccagagactggcacgtaataggagctccaaagaaatacttgttgaaaaagtgcataaactaatttttgaacattttattatgtgctgggcactgtgctaagtattctatgtatgttatttcattaaccctcaaaccttctgagattggtactgtttgttagtatgttataaatttaggaagtaagttgaagaaatttaggttcaaataagttaagtgacttcctcaggattactcagtgcctgactggcaaagataggattttaacttaagtttttctgtctctgagttccatcaacttaactaccatatccttataatacctacccactagtcaaattaaaatctaataagaaactgtgtaaaagcatacttagattgagaggaaataagaaatttggttattgttttagcactcacctttagacatagaagtttctccatttcttttcagggcctggggtaaggcaaagtgtgcacatctgctctgtatattaaaatatcccctcaactcattgaagtggaacaaaaacaaggtcacttgacaggactgtaattgtaatcacactatacagctttacttcctgccctttagtagtaggaccattcccttgtccttaaacatgcttctaaaataccagttttaatggctatatagtctttcatttatgattgtataaggattcattctgtcattgtattgtcattcacataggttgttttcaatcataaaatactgtaatgaacatctgcaagtttagatttttgctctcacctattgtttcctcagacaactgtaagtagtagaattgatggattaaaagatactttttaaaggctctgactcttctaaaatgtgttgttaaactcctcagatctgctaaccagatctttatgctgtacttgtgtgatttatttcgaatctaagtgaaagcctttgtattagttaccctgttaaatcccatcttgccatttgggcagcctattcttagtgtgttttctctgatatcagttaacattatattggctaattccatagaaactaggagactggaaaatgaagataatgtggaaaaacaagagcttgtgaatttgggagtgccctgttcttttaagatgtgatgtgggttaaatgataaacaatgcatcttaaattctttaaaagtggcagaagtaaatggaatttatctggaaaaaaatcaggcgtttattctgatgccctaaattcaggggtgaaatattatctggactagaggaaaattttatgtacattatatggtgttctctattttgacaagcttactttgatattactgctgcaaggtagccccaggagggttgaattgagaagaactgagtattttgaggaacaaaacctaggatagtaggctggagggaattggaggtcagggttttagccatgtatacagagataagcaacatatttaataaaaagaaaaggagaatctatatagtatgctttactccaaagctggatgagggagaaaagaggacacgtctccttgagaagggggcatgtgttgagaatggagaaaaggggtaaggcagattactcagaagaactggggtagaagaataggttggatgataaaaggggctgacattagtccctgaaagttttttttaaataacttccaacttttgccttcacctttgccagcagtgatgtgatctgctttcagctgtagtgaagcaaactgcataaaggacattgtgcatgttaggtcttttacttgcctgttggtacatgtttgtaatatttggaaatactctcactgcgaagaaaagtatagttgtgctgtagtgggtagggtgaggaaaataagggtcatcaccagcaaagtcagagtgatgaaaaaactggattacaacactctgcttgactttgcatagataagtaagccaagcagagtgtttcctggatgtagttaaaatacaagcttggagcacaggtaaaaggccaagaggcttggagatgtacatctgagatgtaccaaagggccaagtgcaaagtaagtttgggaagtttagtgtcatataaaaactaataaagaaagggtggtactctgtctcatatcctgaaacgttttgaaaagaatattgaatttgaccagaagggcattgctagtgaatttcaaagagagatttcagttgagctctgaactggaggaagatgggtgatagaaggctggagagggccagtaacaagggttgaaaaaggaaagagtattcaagcgtatgcataaaaagactacgggtaggttgtgtagatgatgacacactaagcctgggaagacaaggtttcggtgctaatttttatttctttaacaagggtgatagaaatatctgttccatatattaatactatacacaactgtttacctctcagcttttctagcaagacatatgggcttgtgaattaaccctgggtagccctggcattagatagaattaatagtgcttccatatgtgacctcgagacgtactgaaatgaggcaaccaaggaaatcctttatattgggaccaagagccaagatctcaacttgggatatgttaccccgagagttgttaccccgatactataataccatgaataataaccccaagggtcctgttgtctctttttcctcatgtcacttcctttggtactaactgtcaccatgctaacatctgcaaactttgaaaattctgatttattctgcaatatttggaaatttcactgctagtaattgtatttcctggcatggttctgatataattttctgtgtacacagtagcttttccttttagtgctgaatcacactgaaatccttgtttaacctaagttatagttgcaagggagctatcaagacaaataattacagtgatggtgaagtgaatacaagtcaaacatcccaatctgaaattcaaaaccttttgagcacaccaacatgatgccacaagtggaaaattctgcacataagtacttaacatgacctttgtttcatgctcaaaattatttcaaatattatattaaattaccttcagactatatatataaagcatatatgaaacatgaatgaattttatacttagacttgggtcccattcccaagatgtctcattatgtatatgcaaatattccaaaatctgaaaaaaatcccaaatccaaaacacttctggtcctgagcattttgcatgagggatactcaacttgtaatcttttctatgtatagccaagtttgcacatacataggttacaacaacccatcatgtcttaacctttcagtctggaggctggagttttctttttactttgattgtaaattgtattcagattttagaaatgtaaagcttagagaaatgtgcatctcaagattaagaaagctatgcccactgttaaagactggggcatggaaacaaagttggacagtgtagtagaaaggtcctaaacaggggatttggttcttatttttgctatcaagcagaagagtcaaaactgtaggagtctaaaccaaatcaggtccacctgggagtctttaaagttcagggttacttagcatggggatagtggtatagcaaatagttgcgtaggtttcactcgtgggctggtgataatatagtgaggattcacatccgcctgtaatctgggtagaatatttgtataaatcattttggttttttggttttctttttaaaatttttaaaattgttttgcttttcttaagttttggtttctacattaataaaatgacagaactgaattgcctagatgatattcaaagtttcatgtggttctgttagtctgggattctacagtggaattttgtcactacttttgggaagaagtttacctttggtggcctacgaataaaaaccacattggcacaatgccatttatcatatgggataattctgtgtgtttatataatcatttatgttcgtttccaaatgtgttaataaagtacagtatctcatttgattagctcagatgatgaaataggtcagagaggtattatgtttattttcctgatgaaataaaacatcgtagttagcatcttgaacaatttaaatttgatcatcttacttggtatgccagccactaaggatgaaatcctgccactgagaaagaaaacccagtcaggaaagctttctcacccttatctatctaacaaattgtacatattctccaagttctgacttgaatgctggtgaagcttttcttgataatctcttctaccgcagcagagtagaaacactttgatcattcttctcaggactcaggattttaattatctgtttaatgcctttcccttccaccctagtgaactactcaagtgcaaataccttgtcttactcatctctgcacctcatagcccacactgtacctggcatatagagatgcttagtgaataattgcagaattaaatgaaagagtcaaggtgatgtgttgcagagtgaggagaacttgggctttgggctggcggaaggaggtgtcttcgtttacgttttttagattgaaattttgccatgtatatgcgtttaaaaatttaaaacctagttgaataaaaggttggggggggcagtatccaggggccaaatctatctattaataaaataaatttgaattttttaaaaaaatggcaattaaaactcatgttcatggaaaaaattaagttcttattttagtttttccctaaacgatcttgccgtatcacataacagcagtcttgtagtcaatcaagactgacttcaagtggtgaaatggaattttttaattccctgaagagagaaatctttacctagttaagctttgtgttatcttgatgtttttatttgtctagtgacctcttctgattgaaagagtagttaagaaaaaccctttagtactgactttttcaaatttaccgtaatgtaatgacctctttgaaaggagaagtacagagtgtatttttcataatgttacttaaattctgtagacatgaaactagatataaaacccttatgttcttggctcatacaccactataaaccaaatctgcaaattaaatacaaagacaactacaaaaaaaaacaaaattcaaatgaatacaattattccatgtgacagatgatgtttaggttttgcagtagaaaaaaatagctttaggtctaattccattttaaatgtgtttctgtattttaacttcagtgataataaaagctgtgagtagtgcctcttctcatcagtaatgttatgcaggagggcattaatgacttcaaggccttgttggtaagttcaggatgagacatcatacctaaccaaaacacttgacagcaagcattcctcaaatacaggcttataagttttactgagatgtcatccattttgttcattggaagataaggttaatatcttgacattattgaaatcttcattaaatgattttctaaaccagttattgctggaaatgagaatggaaaaacattgcatacctacaattatatttactgctaacaaatgtttgcaaattgtactacacatgtaggacccatatagcacttgcatataataaagtacatatatggtattggctgttaggctattggcttttgaatatgcatgccatgcctgtattgccatatggtcgattcaaattccctttattttttactctttcttttacaatgaccatgaaacttatgctgtgtgtagtgtgccacaaggacatttggcctgaaggggatcttcacacagctgaagaagcagcagtgaaagcctagtgccagtgttgagacagtggctactcatgatcttgaatgtttatccttgtttttagattatctttgaagtgaaaatatgttctcaaaccttgtacccaacttatacatcctttttttctcccagcatatttgggagacattgttttagcaaatatttttctgatcactatctaaggagccaggattcagagatgtgaaaaacaaaacaagcttggcccttcctgaggcaatgaaagaccctttaacagcaagctataaatagattgatttgtgctgttctaaaggtatgcaaagagcactatggaacatattgaaaggagataccaattattgtgaaggtaagggcgaggtttagagcacataatggcaaagatcctgttgaaatagggtcttaaaggatgagtcagataagaagataggtttaaactagacagagagatggtatatgtaaagaccaaggtcatgaaagacattattattataatggtgagaggtgtgtggccctagatagcatttgccatgtgagaagtaaattggaaccccaaactaaaagtcttgttaggctaggtgtttagcccttatctcatcagcataggggagccatggtgatctgagaactgggagagtattcagggcaatattttttatgtatagcggttaccacattgtattacagtgttctccttcacttgtcattggagctcttcaagtgctgtgaccattagttattaatctttgtgtgctaagcttttggtagagtaactgataaaagtaatgcttagaaaacatgggttgaatgactaatcatgagtaaagaggatttaggagagaattatgacaatgtccttcggtggtagttttaatgctttgtgggtcacagactccattgtgattgacttggaaagcttttccttgaaaatgtaaatacatataacatttggcttatagttttatgggattcatgtacctctgaagccagtccatgaattcctggttcagaattcctccttaggaaatcatacccagacagccatcaccatcacaccttgtcatgaataattactgtctcttttagcagtctttattacgattgtgtctctttcttgtcatttccttgagtttctttcatacttaggaagcaaatagctgacctgtctatgaataaagaaagcgtttttaataatgattaaggtaaaactttactggtctgtaaagataatagacaagtatgtgaattaagccagcaaccaagaaacagctacttgagggagaacctgacattcctgaatttgagttgagcaagtgagttgggagtctgcagggccatcctcagacttggtttgctagaaggactcacaggactcagaaaagctgttacagtcatggttatagtgtattacagcaaaaccatacagttaacatcagcaaaagcaaaaggcacccggggtgaagtctaggagaaatcagacacaggtttccaggtgtcccattccagtggcatagcatagatggccttaattctctcaacaacaatgtgtgacagcatgcacgaagttgtcaaccagggaagttcgcttgagccttggtgtccagggtttttactgttggtcagtcacttaggcttgcagcatctgcatgacaggcttcagcccctcagacttctcctacccggccccccagcagtaataggtgttcactgtaaatcacattgttagaataagctgtctgacaaaattggtaccatgtgacccaaggcctcaggcatacagaaatattcttatcagggagaatattccaaaggttcagagctcatctaccaggagccagccaaggccagttttgaagacaagtctttcttgggaatatgcagggtttgagcaactcagtcctgctgagttaaccctttcttgtacagcaagttagctcttcagggagttagctctgtctatcctgcccctgtctgcctagccactccttttctaggtagagtggaccttgctgttcacgtcatagatggccattccgtgtacctagactcctttttattcctttgccaacaagtaattggaatgtttggatttaagaacatgtctgtgctttgcaatttcatgtgaccatggtgaaattatgcacacattctatcattgtgattcaacaagtattttttgaatgctgctgtgcatgaggcatggtgttagatggcagattgacagaaatgactaatacaggtatctggcctcaaggagtttacagtttcataggagaaagaaaaacaaaactagcaattctggtaagcagtatgtgttttggagagcacttaacttcatcagagagcatggttgaaggtgtatctgtgtgtatgagaaggtgttggtgataattagaaggcttccctaaagaggtcactcctggggttgagccataaagatcaagtagatacaagtgggcatgaagctagtattttgctgccagtcatttctgtagttaggttgcctatgtggttggagcatgtatgtattgttacaggtgtagtctgcttggcttccctaagagaatgccccagtcctggccagaatatacatgtcttttttagggtttgcaccaaggggaatagagagtgtctggctcagtacaaatctgtttccgttactccattatccagaaagccactgaaatggcattagcctacacttaatgggtggtagtgttttcacacattgcttctcaaaggaggagtatgtgaatgtttagtttgggcctggtaaaaaaaaaaaaaaaaaaaaaaaagtataaccattacaaatttaaatgtactttgtttctaatgggaaggcaaatgcttgccttgctttgatgaaattgaacataacaaaatttttctatacttggaagcaaaaaacttcaggaaaaaacctgggtccaaatgttgctacatttccttgggcttccacgtgtatgtggttcttaatataatttgaaacttctaagagcaacaaatagttgttttttgcttctaagagcaacaaacagtgcatagaaattgtgtgataataggatcaagaatgtattattagagtgaatattggataatttcaaactgttaaccttgagattttttctaagaatctttctctttttccagcgttacagtgtttctgccacctctgtacaaaagacaattttacttgtgtgacagatgggctctgctttgtctctgtcacagagaccacagacaaagttatacacaacagcatgtgtatagctgaaattgacttaattcctcgagataggccgtttgtatgtgcaccctcttcaaaaactgggtctgtgactacaacatattgctgcaatcaggaccattgcaataaaatagaacttccaactactggtaagttgtataaaatttttttcctagatactacaagaaaaactcttcatactctgtgattttagaactggaagggatcataaaaattgtctaatccagctcattccgtttagaggcaagaagtgacttgtccattgttacagacttataagagtaaccaagatcctgcctcctgggtatgtgttgtttaagaaggtggttccagggtggacttcctctgaggtctgttatacctaaaaggatagataaaagcaaactctgacaaagcccacaacaacatcttcagattgtctctactttgttctcagagtgaatttcttcttccttgtataatgctcctatcttttaaagcaatcacagtcttttaatgagtggggattcagagcagcacttaacagtctagatgttttcattttgtaatttcagcttgttttatgatctttttgcgtaaattaattatacatgatttctagatttttggtccttcacctgtagtttacatttaaaatttcctggggctgggtgcggtggctcatgcctgtaatcccagcactttggaaggcctgaggtgggcagatcacttgaggccagaagttcaagaccagcctggccaacatggcaaaaccctatctctactaaaataacaaaaattagctgggcatggtggcacatgcttgtaatcccacctacttgggtggctgaggcacaacaatctttgaacctgggaggcagaggttgcagtgagccaagattgtgccactgcactccagcctgggtgacagagtgaggctctgtctaaaaaaaaaagataataaataaataaataaaatttcctggcagaaccagcagtttgaagacttcataaactttttaattttaagattccggtttaatatggaagtctgagcacatgtatttaactcttacctctttccccagatcccaaaggaatataaaaatgagggcaacctgtattaatgctagtgggattaatggtagaatgccacccacatgccagcacttgtgaggaacttctgcaatttacagtacagatgacaccagactagtaaagaattgactagccatataagaaaggttagtcatcgaaaagtccagccaataacttagacaaaggatttggggggtgaggttagggtatgggggcaaactctcagttcccttttaggaagcacctggcttcagtgctcagaggagcagacacagttgctcactctccactcaaagttggtccaggccttgtgctaattaaaggaggaagcactgctgtagcgcagaaggaaaaggccagtcctccacctgttcagcatgataatgcagctcccctgtggtaagggttggtcggactacaatatctttgtgactttgatgaaagcatctgcagttataatgtggcaaagaaaaggataattccagaatttcccatttccatcatttgagcttgaaatatctgaatagatatttacaaaaccttgtgaagaagtcaccttatttctcatgtttctaatgaacatatataaacttctcatttccagctctaggataagcaaacagcaaaaaattaccaatgaaaagttaggagttcaaaagaagtagtctgaactagatagattagatgtcatcctgtgaaataggtttaccacatgatagggaagaactttcaaacagtacagggtctattttcagttattcactatgaaatgagaacatttcacagttgttaaaggttgctttcagaagaaaagcccaactgatgaatgtttttaaaaatgcactattgagagcgaacaacagactggatgccataattttatagtcaagtttgggacaagttttaagaaactgtgttacaattcagagaaaagacagttggtgagcatattaagagatatagggaacagatttagatgatccaatatgcttattatcagaattccagaaaaaggcatgaaatcataaagaagacagaataccaggcaaaattaatgaaaaaatattaatccaaacacatataataaaaagtatcaatttcaagaataaaagaattatataagcatttaacacacataaacattggttacctgtaaaaggtgaaaaaaaaaaacaggttcagattttctgcttaaatatcaaagggcaaatggaacatttttacgatcacctaaaattcttgaaataggccaagatttttcatatacaaaggcaacagccttcttgccacaactaagttcagtgtacaagggtgcatggactcttcctgaaagaaattactagaaataggattctgtatgataagagattaatctactgaagatcttaagaatgggaaagatgtgatatgaaagaaatggtggtaagcagtaaaccagtaagactcaggatgaatgtcaaaataattgtaattttctgaaacaaccagaaaatcttaattattaatagaagttacaagaaaatgatctggacttaaaagtccaggaggttaagatagtataaaaagtatatatatgcaaactctgttaaaaaaaaaaagtaaaagatatgttctgcctttaaaaaattggtggacctattggccgggcatggctcatgcctgtaatcccagcactttgggaagccaaggtaggtggatcacttgaggttaggggttcgagaccagcctgagcaacatggtgaaaccccgtctctattaagatacaaaaattagccaggtgtggtggcacatgcctgtaatcccagctacttgggaggctcaggcaggagaatcgcttgaacccgggaggcggaggttgcagtgagccaacatcataccactgtactccagcctgggcaacaagagtgaaaatccatctcaaaaaaaaaaaaaattggtggagagatatatactgaaatgtgagttgtttagaagtgatgaagatgtatgtggttttttttttcgcttgttttgatattttgttgttttttttgttgttgtttttcttgctatgagcatgtactggccttggaacaagaagacaagccaaacattaaaaaaaatatgatttttaaggagatgttaataggtattgttacaggttattggtattagtgacctgatgtgataagtggggaaggtcctatgatattggcggcagttggccttgtaatgatggctgaagaatacaggagtaagtgggtgctgacagagctggtgtgcataaaaggaggcctagtgggagaagactgattcacttgttctgggtttgagccctgtaaactgctgtaatgaggctctttggctaagtggtggcagtggccagctgcaggaattgtgtaggattgggaaaatgggggttgccacctacagtgtttttgtcgttgttgatgtttatttcactcgaggccctttttcagtaaagtcatcacctggccttggtcctgtggaactggcagctgtcattgctggaccagtgtgcttcgtctgcatctcactcatgttgatggtctatatctgccacaaccgcactgtcattcaccatcgagtgccaaatgaagaggacccttcattagatcgcccttttatttcagagggtactacgttgaaagacttaatttatgatatgacaacgtcaggttctggctcaggtaacataattgtttctcctttttcctaagacatctttttaaaattaagcgatacttattttattagttttctaataagccaacttgctagaatgtgagatagtataaataatattgcaggtttgaacctaataaaaatctttaagcttgatgtatatatgactgtggctggtttaaaatagattggaacttaactttaactgttaaagcgaatcaataagtcagctccatggtggtataaatttcaaagcgttctcacttgtataatctaatttgcttttcatcactgtgaggtagaaaggataagaacaattattctcatatagatgaagctgaaggtcaaagatattcacatgatctgcagctaacccattctattcaggattgtttagcagcttgatgtttacatttgaaaacaggcatgacagaaatgtattcagaattgtgaaggttatttactttttaaacattatatgaaattgtctttcgtataggcctggttttttaaaattaaactaatgaactcttatgtcattttctcacttgagaaaaatgtctaaccaccttcttatttaatgtagttttggcccctaatgacgttttcttttctcagttctatttgttgatatttgtggcatcagaagtagatgagctaattgtcagagtcatcccaaggtggattttggcatagcagtgcttcatgtttaaactgaaagggggttatcttttactttttcttgcatgtggtttggaaaaatattaagagaggaacactcctatcccctgtgtttttagaatttgacacttggtgaagaataaatagatctaggtttcaaggcaagctttgtcattgattggctgtataaccttggttagaacatgtttcctctttgggcttctgtttcctcatcaaaaatatggaacccatactgttgataaaaacacttcaagtggtttgttaagacttttaaatgagatgtactatcctttgaaaagtatgagtcatcttcaaataagggctaaattcatgaataaagtgaaaatttgtaaagcgtatataatgaaaatttcactaattttggtgaaagcccatctctattaaaaatgcaaaaaaattagccgggcgtagtggcatgcgcctgtagtcccagctactcgggaggccgagacaggagaatcacctgaacctggggggtggaggttgcagttagctgagatcgcaccactgcactccagcctgggaaacagactccatctaaaaaaaaaaaaaaaaaaaaattttcactaattttataattgagtgatattaaaggaatgttaaagcagaagttgtgactgggtaagaatataattctgaagcataaaatcacatctaatgttgcagaaagctcatataatgacaaatgtctatttattttaaggaaatgaatatatattggtatgtatgcatatccattcatttaagaatgaagaaactgattttattacctgaattattcttctatagaatttggccatatgtattcaataagagagctctctccttgactactaggacacacacaggctcgcactggagctcacgtcccagaaggcaagcttagggattcctgaaacagttgtgcaaggaagacaatgagagtttggacttagatgaagcagtcttagtactgaaggtgtgatagtctttaggcaggcctggtggacagaggttattttagagctttcctgggacttcccatttattctcagttcagatcttcaaaaagattttgctcattctggaagtcatcctgctcaaaactgtgataatcaaggaccagagtcacagaaaatcaggatggctacagatatttggaattaatccctcaaacctgttctcttgtttctaaacttatactccggaaagacacagcactcatgccacttgccacagtggaataagcccacctaactgattaaaggaattggtgggtgggtggcagttgattactggataagaatatcttcattaaccttttaagatataaacatgagaaacaatggaataattctgtttccattatatatatatatatatatatatatatatatatatatatatatatatatatttctagatccatgagggaccatagctctctgttctctgaaagcttctctccctcctttgatgccttaccctgcaaaaacttgtctgcattgcttgctagctctgtggctttgggcagttaaccaatgtctcatgcttgagttatttcatctttaaaatgaaagtgatggattctgtgcacatcattggattgttgtgagttcaagcaagacaaaatgtttgcatgaaagcacttggtaaattgtagagttatgtccaaatgacaagtgttactcttattgaaaacatacttggaggaaaaatctaacatacagtatcagttgaccacattgtacaaaacttagtttaaggcctcctttgcctgtcatagttcattgtgtactgaattccctccaaacctatccaggcagaagccatcttctggtgaataatagcagaaaatgccatctgtttcccttctattcattataaatccttaatgccaccttaggcatgagactagtgcctgtgaataagtaaactgtgtgtttgtaatactctgtttttagttctttcattaattgaggaaaaggtataagcatttcacattctgaattcatatgtttattacttagtaccgtgaccataattaaggaaaggccctgtctctacctctaaagactgtgcttttaacttgggaacttcagggaatacaatgaagagctgggttctggcagctgtacgccaagtgtgtgagtgtgcacatgtgcatatgtgccagcttttgtaagtgagtcttctaggccagtgtttgttatggcgtgtgcagcttatgagctcttgtaatatatgcatgttgttcgggtcttatttcctgttcactgcatgtaaagctgtggagtccctgtttcccttttgaagttttctctcaaacagttctaaaggtacagaagagtagagcagagaatatagagatctaaattaggcctattcagttttgtctttagaagaaaattgttactttttttttttttttttttggagacggagtttcactctgttgcccaggctggagtgcagtggtgggatctcagctctctgcagccttcacctcccgggttcaagcaattctcctgcctcagcctcctgagtagctgggattacaggtgtgcaccaccatgcccagctaatttttgtatatttattagagaccaggtttcaccatgttggccaggctgatcttgaactcctgatctctagtgatccaaccacgtcggcctcctaaagtgctgggattagaggtgtgagtcactgtgcctggccaattgttaactttttaaaaatgctcaactattcatgtgaagtaatccaatatagataatacagtggatcaagatttgctttttaattttaattgacatctagaatccagtgataaaggggaagacaaaacctttcctcgtcctgttggcctttcttgaccataccatttacacaagtcctgaacctgtcaggtgttttcagaatttgtgtttgtgattcctttttcttttttattacttgtctttgcaatttccagattagtctcctgaaattaactcttaagtgtacttttaagtctgtggtgtggccctctacaaggctttcataaaatgtaataaattagtatctacactaaacaacataattagaattgattatacatagtgcgaaagagctctatgatttaaataaggatttctgacagatctgtttctaactagcagcctccttataaacacaaacagttatttatagttatactgctaactactttacaggaggtggggagggtagagcaagaggaagaaaggacccgtttgagaaacttaagaagaagagcttctgatcgctttaaagatttaacgtttggatttataagcatttcacatcagggaaccaaagagagcagataatttcatttactgtcattgggttaatttgatctagtaagcagctttgagtatagattataaatgacaccaatttatatgtacatagattgtataaataagatatgagtgaggaacatgatgtacactggcattttctttgttagtgtcaatgtaatttaaaatgacacttaccggatggtggataggatattaagtgatggtctcacatatagtgccacttaaatgttgcaggtaagttagtaaacccttttaaatgaagtaagtatggcaatacttaaaaatacatattttggagaaagccaagttccattagtggaaaaacagtgctccattaccaaggtaagttacttagccttgttcttcaagatactagtgttgtctatgtagccagttgtcagcaagtaaattgctttccttgaaatagtttctgtggtgatttttactgacttatcaaaaagccagaatttacttctgtgtttctgcgttcacatccttttttcctcccatcagtgaaactgttacgagattcatctttctaaaataagattttaaaattatcttgcttccagccatggccctttttctcagaaatctttaaaggttcctcttttacctaaagctcttcattggttattttgagcttggtattcagtactcttcatcttctggtgacagcttactttctcttttcactgctttgccacatatatcctctctctgattgcccaagctgcttccctaaaaatgtgtcattcatttccctctacctttgcctgcacattcttcctgcctaaccaccgtacttaagggatagtcaaaattcaacttacttttacaaagcctaccttgaccctctagcaggagtttctggattcttttattatatttattatcttattttccttttttaattagttattttattgcaaatataatatctccccagtgagataaattcctaaagggatagcttaaagtatcagttttctgggtcactcattagtgcctatcatgatgtttgaaacatgtaatattgttgattgtgttgagtactatttatttttacctttaggtttaccattgcttgttcagagaacaattgcgagaactattgtgttacaagaaagcattggcaaaggtcgatttggagaagtttggagaggaaagtggcggggagaagaagttgctgttaagatattctcctctagagaagaacgttcgtggttccgtgaggcagagatttatcaaactgtaatgttacgtcatgaaaacatcctgggatttatagcagcagacaataaaggtctgtaacatttgcttttccttatgttatatataacaagatctctttaagtctttacagatatggtgactaaccatcatcaaagtagatgagacatagatgtctctcatgtagattagacccattaagtcgaatacaatatattagtaacttttagaactaggaacttcttcaagattttcttgactcttgatagcattcctaaaatctcttaatgttttataaaatataaaagagctattttaaaaagccatgtactttgttggtttagtttagggcagttagttattgagagtactcatgatatagaaaagatatataaacttgctcaaaattttgagaatagggctcagatagctgtttccttttaatctcttcctgaccagtaggatgtttcaatatggactattgaccttattaatggggagagtaaaaataacttgtcagtgttctgagttgccaagggctaaatagatgaatcttctggcaaactcaaagagataaattgtttcttcaaccaccctggtaactgtacggacacttttctgcctatcatgctggtgcctgaggcccagtgtcaggtcagatgctgaagaaggaaggaagcctgtcagcagggagtcagaatgagtggggactgcaagcagtgaccttagactgtgctgctgccactttcttagcttccgttaatacctttatgcccatgattcctactttttttttttttgagatggaatctcgctctgtagccaggctggagtacagtggtgcaatctcggctcactgcagcttctgcctcctgggttcaagtggttctcctgcctcagcttctcgagtagctgggactacaggcgtgcaccaccatgcccagctaatgtttgtatttttagtagagatggggtttcaccatgttggccaggttggcctccatctcttgacctcgtgatccacccacctcaccctcccaaagtgctgggattacaggcatgagccactgtgcccagcccccacgattcctatttttactgcctctgtcagagacttgtgtttcagctccactcttgtcatccctacccctgaatcaaatgtatttcccagctttcctatttaaaaaaaaaaaaaaatgctgtcattatctcttagcttggccagacctgtagtcatctttttccttctcccaccttccatttacttcagcaatatttatttattcaaatattaacagtgtttaacctcagttggtaattatgggtgatttttattatttttcttttagcttctctgggttttcaaatttatttacaagcatgtactgcttttttttgttattgacttttatttgtagaaaatttccaatatgtagaaaagcagagtagttacagtgatccctcatcgtccagcttcaacagttgtcaggtcactgccaatcataattgatgtctgatcccacctactctgccctaactgtgttatttgaagctggtcccagacaatatgttttcatctgtaaacacttataaaatgtaatttgtatcttcaaatgatgaggaaatgtttttatgaaacaaccacactaccattgtcagttttttaaatgttatcaaatatccagttaggttcaattctataattgtctcctattaaaaaaattatttattcaaattatgattctaagtccacaagttatatttagttgatatttctcttatgtgtcttaaaatttaggtccccccttcatcttttttctcctctcgcagcttatttgttgaagaaattggattgtttatcctgaagggcctatcacattctggattttgctgattgcatttccatagtgtctcttaacttgttcttctatcttttctgaaaactggtagttagatttagaagctaaacctaattggagttttattggttttctcaaaatacatactaaggatattatatacatcctattgcatcatatgtggaggtgtatagtgtttgattaagacggggcagtgaggtatatgatgaatgtaggtagcgattatcagtggcacctgacaatgtaatacctcttaagttaaaaacaaaacaggccgggcacagtggctcacgcctgtaatcccagcactttgggaagccaaggtgggtggatcacgaggtcaagagttcaagaccagcctggctggccaagatgatgaaaccccatctctactaaaaatacaaaaaaattagccaggcatgatggcaggtgcctataatcccagctacttgggaagctaaggcagagaattgcttgaacctgggaggtggaggttgcagtcagagctgagatcgcaccactgcactccagcctgggcgacacagggagactctgtctcaaaaaaaaaacaacaacaaaacaaaacaaaacaaaaaatagtaatcagtctgaccaaatccttagttctcattttcgtttctgcctttatcaccatttatttcctcccccaactcttaaaacaaccttttctttatttactgtgtttgatgaccctagactttccttgttccttcttacttcttcatagttgtctttgttttctcaactcttactcttctcactggttcatatgaaggtactgattttataagtggtaatttcttccttaagaacatagccacattcatggtttcaaactctaccatgttggcaactctcaaatctccatttgaaagcttaaacctcacccagggtctggattttgtcacattccaagttacaaacacagcagcacaaaatgttggtgagtctgtgccctgaacttctaaccaggctgatgctgtcatctggtggtcaccatgggaactagctgaccctactggctcttccctactccccttctttcttctttgtcaggggttaatgtactttctctgagcctagcccctccacctcagttcctttatcttctcctgatttagttaattccacccccggcagccctttatatttatggccccttacatataaccttccttctatcttgtccataacctgtggtttccctttcttccatctgcctgtcttccactttgtttcttgtatttgtgagcttttcaaaattcagtaatggttaagaggcatgcaaataagctagtgatgtgcctatatcaaggaaaagcaagggtgcgagtttggtcagaatcagtttataaagttcatgaagaacaaattaatactaagtccttttaaatgtacccagaaatctcctccagaatcttctgaaaagtttctattcctttcttaatctcttctaatcagagttggttttcttcttcaaccaaataccttcaaaatagaagctgtttcatgtcaatatggattttttcttttggtttacaaccagcagggaaagaaagagcacagtttatgtacttcttacctaaagaatctagcattccgttttttaaatcttaacagtcttacaaagtaagactttattcttgtataaaaggagaaacaggctccttgtcagtaacaggcaggccgtggattccaaccaggttagaatgactctaagcgtccatcttttactggattgtgctgtctcctaatgttgtaatgctttttttcttcatggcttaattaagcatgtggttttccagctacttctaggttaaattagattgtcgtggaccagtctagcttaggagcctagctagtgtctttaccattattcctatgagaaaacatgttttaaactcgtgttttggcttacagaggaaattttggaacccacgttcctcgttgtttgagtttagtcccagcttttccagttttgctcctgacatttcagttcctatttcagcttccccatgtgttagaggtatcactatttctgtttttctaagctagcaaccttggaatcataatcatcttgtcttgcgtctttgtgaactgtgtacacaatctgtcactaaagcttgtcatttcttgttgaaactcactttcagttttgtcccatactcttccattcccactgtggccacactggtctccggagacttctcacctccttgcttccctctctgttccttccttttttttaaccttctctccttccaggaacagccactgagcacccaacccgacccagagatttttctaggcacttaagagtgccagctctgataccaattatctgtgaagactcaaaaaagtcaccatctttgtctcttaaatgggattaattatacttgccttatctcaagaagaggggcttactctgaggaactaaaggatgtgtacataaaagtataaaacaaacaatgtagaagaaaatgtgaaggaaatacagacttaaggtggcattatattgcagtgtgtgactcaggattgagagtaaaaagtaataaccattgaacaaataaatcataaatggtctgcagcccaaccgaaatgttaattctgttttacagacaatggtacttggactcagctctggttggtgtcagattatcatgagcatggatccctttttgattacttaaacagatacacagttactgtggaaggaatgataaaacttgctctgtccacggcgagcggtcttgcccatcttcacatggagattgttggtacccaaggtaattctataagcagttctattatttaagctttaaattttcatgaataatgtctatgaaaatagaaggtggaggctgggcctggtggctcatgcctataatcccagcactttgggaggctgaggtgggcagatcgcccgatctcaggagttcatggccagcctgggcaacatgacaaaaccgcatctctaccaacatacaaaaaattagtcgggcatggtggcatgcacctgtagtcccagctactcagggggctgaggtaggaggattacctgagcctgggaggtcgaagctgcagtgagcagacatcatgccactgcactcccagctgagtaatagagagagaccctgtctcagaaaaaaaaacaaaaacaaaaacagtaggtggcctaactggagatatttaaaacaaattttttagatgagaacattttatctttcagttcaaaatttcaggtagagctaggaatctggaaatttgtttagagattctctagtcgttgtaacaaaactgtgattttttttgagttcttaaaagtagcattcaatcttatgatttttgaggatctcagtttcagaattcaggtccaactgaatatatttttatgtgtagtatcaaatgaaatgtgaaagtgctttgtaaacatcaacatgctaggtaactgttatctggccatctaataattatatttgaccttgagataaggagactgcatgagatagttttacagttgaaaaattaaatactaagttttagttatgacatttgtatgctgtagtttttgtgcatgtgggatttcagatgccagtatatctctctgctctagcagttgtccacttgcaacccaatggctcccccactccccactttacatacagcataagtgctagttcacatcttagctccatctttgtagttattattattattgattgtaacagttttattgagttataattcacatcataaagttcacccacttaaagtgtaaaattcagtggtttttagaatactcagagttgtacagccagcaaacactacagtcaattttagaatatcttcactccaaagagaaaccctgtagccactagcagtcactcccctttcctcccaaactccttagccctaggcaacaactgctcctttttgtctgtagatttgcttattctgcacattttatataaatgaatcatacaatatgtggtcttttgtgactggcttctttcacttagcatgttttcaaggttcatttatgttgtagcacgtatgagtacttcagtcattttgatggctaagtaatacttcagtgtatggatatggcatatgtcatatatccgttcgttgatggacatttggtttgtttcttttggccattgtagctaatgctgcagtgaacatttgtgtacaagttgtatgtagtttcatgttttcagttatcttgggtatatacctaggagttgaattactgtatcatatgataactctatttaatggtttgaagaactgccatactattttcttaaagtgcctgaaccattttacattcctgccagcagtgtatgaaggttccaggttttccacattataattattattttttaataacattttctagtggttagcatcaaagataatatacttaatactgagtacattgcagttgatagggaagtgatgttctacatgcttggttcctgggctgctggaatatcagtctatggctaagtttcttaaaaagaattcataaggcaccaacagataaactgataactttttttttgccccagtctttgagttgttcatcttttaaagcatgttattgtccacattttctttaaagaaatataaattcagtgacttttggtgtagtgattcacttgagtttaataatgccgtaagtattgtaggtcatgtgggctgaaatgctttgataatttgggttgggagaagagacttttgaacctaaagatgtgagttgtgattggtattaccttttaagcagtcatgtttaatttttgattctttaggaaagccagccattgctcatagagatttgaaatcaaagaatatcttggtaaagaagaatggaacttgctgtattgcagacttaggactggcagtaagacatgattcagccacagataccattgatattgctccaaaccacagagtgggaacaaaaaggtatacttttgaacaactatatttaatatcttctgaaatcaccttttttcccttctctttcatatatacatatcattgctgaaactcagcttaaacttgcactttattagattgccaacaggtaagaagatctcatggtcttgcctgctctgaagccagagttacctgacttaaaaagatgcctgctgatgaaaggttgcccttccagaaaatatcattaggcatgttaattataataacagtagtaactaacgtttatagggcacctactatgtgccaatcgtctaataggtcttttacgtatattacctcatttaatcccttctcaaatactgtgcagtagctagccctgctattttcatatttcagttcctaaaaatatgcctttcttgctttcttagaacttttgcacatgctgtctcctggagcatactttaccctactgtttctcagcctcatacccacctttcccgtaggaagttttttctagtcctcaaaaatcttaggagtccctgccagggactgtcatagcacactgaactgggaccgttgaggcacttatgcgttatgttgtaactgtttatttatttgcctatatattctattaggtgcaagctgcttgagagcagccttgtattcccagcatccatcacagtgcctaatacatggtagatcctcagtagatatttgttgagtccatgagtcttcaaaagaacttaattaggtaggtgttattaccctttaattcacagatgaggaaaccaccttgaggaggttaaataatatggccagcttcatgtggatgataagccgaagagctgagatttgaacctgggcatttctgacccaaaccccttatcacaagctgtcacagcattttttcaaactactgtcttggccttggagacagctggagagccagcagcattagtctattcaaattgcatgtataattttgagatttctggattccctggggactctcaattttcccatccaagtactaagcaggcccgaccctgcttagcttccaagatcagacgagatcgggcgtgtttagggtggtatggccgtagatgactctcaattctcaaccagctaaggggtccttgtcagtggttgctgtaggtctctgtgggtcctgacccataattttggtaggtttttgaagcttcagtatgaggactggcattcttttgtatctattatttttttccctggagtatattcgtgcccttcctttcatcctcagtgagaagacttctaaattaaaatgcatggtttctacctagtacgtgtataggtggtgtacattaggacacctttaacagtcacaattgttatgtatgtctttcattggaaaccaagatcatgaggcagatagtgtgaaactgctattttagcattttgtgggatttagttgacatcattaatgtgcaaaccagtgtggatatttaatatttttcttgagtctaatatttgttatgtaatattgtgtacatatgtctatgtataaagaaatgtctgaaaggaggttcatccaaatatggcagtaaggggatgattttcaaagttctttttgcaaattttttttaggtacatggcccctgaagttctcgatgattccataaatatgaaacattttgaatccttcaaacgtgctgacatctatgcaatgggcttagtattctgggaaattgctcgacgatgttccattggtggtaaattgctctcctctcccccagtagtttgtcatgagcagaagttgttcaagaattgtcttctttttttaattgaatgaaattatgtacagtccattatctgaaacaggatgtcaccgagtgccagagaaaacaaaggcgatgaaacctttgggaggggacagtgccatggtgtgcacatgcacagctctagcctagtgtattctcttcctgtttccatttgaatctggagactcatcagaacccaaccccttgttatattggaatatagttctttagaatggacagctgcttgagaggctcacctaggaagctgtttctagcatgtacctgggtgtcaaacttattttttttctttgagattgtggttattttctccaacttgatagttacagttacatacacagaatacaattatgttaccattgtgttgtattctagagttagtttgttttaacttctagctttttagatggagtacttttaatgtttactcaggaaacagtctcttaggcttggggacctagacttggctgagacctagtgccttaggtttttgaagcagtgagggacagagtatttctctgtattgtagtaaataggatatattattgacagatgcaagtagagaaagggacttggcaccttaaacttgcctcataagattcaagtctcactgatagggtatatatatccctgtgcaagtgagagcctgtgcacttacagaatagaatctcatttgctgcacaatagggttctaggggaaaatgtcaatctggtcatcacagctcatagtttactgtcatttcaaataggctttattgatctcatggcaatacttagtttcaaggtgtgggtggaatatcaactcagggaagtggcttgtggatacagatgtggatgagatagagaaagctgtaatctctgttccacatacctactttagtaatgaaacactgtaataggtctctcaggtgatcttttaatgccttggcattagctgaataaattcatcaaaatttaattttttttaaactgatacaggaattcatgaagattaccaactgccttattatgatcttgtaccttctgacccatcagttgaagaaatgagaaaagttgtttgtgaacagaagttaaggccaaatatcccaaacagatggcagagctgtgaagtgagtatttctttttgatattaggcaattttctaaactgcttctgcttagtaagcaaaagtttgctacttttctttaaggaaaacttttctttaagaattttctttttcatagcagtcaaaccaatgtttaaaaacagaataatttggttttcatattcaattgtaagcacattgaaagggccatggaacatttgcagtggcctttagtgtatcagaacatagtttagatctgccgggcgaactaaggcacatatttttaaatgaatgcctcccttcagccggggcaacccagaacactagacagttaccggacatgaatgaggagccctgtattctagaccagcctggctaccatttcaagggtctgactctgaacaaatccctttagttctctggactttaatatccctttgcaaggtgaggaactcagataaggtgattacaaaggtgtttcaaatgattttccgttttattcatctgattgcccagataaccgttaaccaggaatttagggaaaatgcttttttccagcagtatctgagctgctcaacttcagctctaacaaaaagttttagaaacgtttttgtaattgtaaatttaaagattcgtaagatgaattttatttaacctctccttaattgctagctgttactattacaatattggtgaagcagagcatattcctccaggtttgaagatttgtagcttaaaaaggctataaaaagctgttcagttcagtagttgattttacgtcttaaactattgtaggactcagcagaacctctgataagcaagagagcttgctacctccaacaaaatcacatctccaggcccaaataaataaaatgtatttcagcatgcttaaggaatttgcatgtgacatagtttaataaatgagagtgctgctagattttgtcttttagaaatttgatctacttgggaggctgaagtgggaggattgctggagcctgggaggtcaaggctgcagtgagctgagggcatgccattgcattccactttgggcggcagagtgagaccctgtctcaaaaaaaaaaaaaagaaagaaaaatttgatgtgaatacttcaaagtacaaacttaaaatttcagtgtgaggtcagatttcttctttgctttgcccagctctggtttaggattcggccttttcaggtttgctaaatgagtcactctttgtccacctgctttccagcactggcaccagtaccctattgatggaaatttatgtaatttctactcatttgctattacaaataatgcttaaacaataacaagtgtatatgtcatttaaaaagaaaatttacacgtaaaaattcttatccagaccaatggaaaatggtgcatgcattaatttttttttttatattttcttgtaggccttgagagtaatggctaaaattatgagagaatgttggtatgccaatggagcagctaggcttacagcattgcggattaagaaaacattatcgcaactcagtcaacaggaaggcatcaaaatgtaattctacagctttgcctgaactctccttttttcttcagatctgctcctgggttttaatttgggaggtcaattgttctacctcactgagagggaacagaaggatattgcttccttttgcagcagtgtaataaagtcaattaaaaacttcccaggatttctttggacccaggaaacagccatgtgggtcctttctgtgcactatgaacgcttctttcccaggacagaaaatgtgtagtctacctttattttttattaacaaaacttgttttttaaaaagatgattgctggtcttaactttaggtaactctgctgtgctggagatcatctttaagggcaaaggagttggattgctgaattacaatgaaacatgtcttattactaaagaaagtgatttactcctggttagtacattctcagaggattctgaaccactagagtttccttgattcagactttgaatgtactgttctatagtttttcaggatcttaaaactaacacttataaaactcttatcttgagtctaaaaatgacctcatatagtagtgaggaacataattcatgcaattgtattttgtatactattattgttctttcacttattcagaacattacatgccttcaaaatgggattgtactataccagtaagtgccacttctgtgtctttctaatggaaatgagtagaattgctgaaagtctctatgttaaaacctatagtgtttgaattcaaaaagcttatttatctgggtaacccaaactttttctgttttgtttttggaagggtttttgtggtatgtcatttggtattctattctgaaaatgcctttctcctaccaaaatgtgcttaagccactaaagaaatgaagtggcattaattagtaaattattagcatggtcatgtttgaatattctcacatcaagcttttgcattttaattgtgttgtctaagtatacttttaaaaaatcaagtggcactctagatgcttatagtactttaatatttgtagcatacagactaatttttctaaaagggaaagtctgtctagctgcttgtgaaaagttatgtggtattctgtaagccatttttttctttatctgttcaaagacttattttttaagacatgaattacatttaaaattagaatatggttaatattaaataataggcctttttctaggaaggcgaaggtagttaataatttgaatagataacagatgtgcaagaaagtcacatttgttatgtatgtaggagtaaacgttcggtggatcctctgtctttgtaactgaggttagagctagtgtggttttgaggtctcactacactttgaggaaggcagcttttaattcagtgtttccttatgtgtgcgtacattgcaactgcttacatgtaatttatgtaatgcattcagtgcacccttgttacttgggagaggtggtagctaaagaacattctgagtataggtttttctccatttacagatgtctttggtcaaatattgaaagcaaacttgtcatggtcttcttacattaagttgaaactagcttataataactggtttttacttccaatgctatgaagtctctgcagggcttttacagttttcgaagtccttttatcactgtgatcttattctgaggggagaaaaaactatcatagctctgaggcaagacttcgactttatagtgctatcagttccccgatacagggtcagagtaacccatacagtattttggtcaggaagagaaagtggccatttacactgaatgagttgcattctgataatgtcttatctcttatacgtagaataaatttgaaagactatttgatcttaaaaccaaagtaattttagaatgagtgacatattacataggaatttagtgtcaatttcatgtgtttaaaaacatcatgggaaaaatgcttagaggttactattttgactacaaagttgagtttttttctgtagttaccataatttcattgaagcaaatgaatgagtttgagaggtttgtttttatagttgtgttgtattacttgtttaataataatctctaattctgtgatcaggtactttttttgtgggggttttttttttgtttttttttttttgttgttgtttttgggccatttctaagcctaccagatctgctttatgaaatccaggggaccaatgcattttatcactaaaactatttttatataattttaagaatataccaaaagttgtctgatttaaagttgtaatacatgatttctcactttcatgtaaggttatccacttttgctgaagatattttttattgaatcaaagattgagttacaattatacttttcttacctaagtggataaaatgtacttttgatgaatcagggaatttttttaaagttggagtttagttctaaattgactttacgtattactgcagttaattccttttttggctagggatggtttgataaaccacaattggctgatattgaaaatgaaagaaacttaaaaggtgggatggatcatgattactgtcgataactgcagataaatttgattagagtaataattttgtcatttaaaaacacagttgtttatactgcccatcctaggatgctcaccttccaagattcaacgtggctaaaacatcttctggtaaattgtgcgtccatattcattttgtcagtagccaggagaaatggggatgggggaaatacgacttagtgaggcatagacatccctggtccatcctttctgtctccagctgtttcttggaacctgctctcctgcttgctggtccctgacgcagagaccgttgcctcccccacagccgtttgactgaaggctgctctggagacctagagtaaaacggctgatggaagttgtgggacccacttccatttccttcagtcattagaggtggaagggaggggtctccaagtttggagattgagcagatgaggcttgggatgcccctgctttgacttcagccatggatgaggagtgggatggcagcaaggtggctcctgtggcagtggagttgtgccagaaacagtggccagttgtatcgcctataagacagggtaaggtctgaagagctgagcctgtaattctgctgtaataatgatagtgctcaagaagtgccttgagttggtgtacagtgccatggccatcaagaatcccagatttcaggttttattacaaaatgtaagtggtcacttggcgattttgtagtacatgcatgagttaccttttttctctatgtctgagaactgtcagattaaaacaagatggcaaagagatcgttagagtgcacaacaaaatcactatcccattagacacatcatcaaaagcttatttttattcttgcactggaagaatcgtaagtcaactgtttcttgaccatggcagtgttctggctccaaatggtagtgattccaaataatggttctgttaacactttggcagaaaatgccagctcagatattttgagatactaaggattatctttggacatgtactgcagcttcttgtctctgttttggattactggaatacccatgggccctctcaagagtgctggacttctaggacattaagatgattgtcagtacattaaacttttcaatcccattatgcaatcttgtttgtaaatgtaaacttctaaaaatatggttaataacattcaacctgtttattacaacttaaaaggaacttcagtgaatttgtttttattttttaacaagatttgtgaactgaatatcatgaaccatgttttgatacccctttttcacgttgtgccaacggaatagggtgtttgatatttcttcatatgttaaggagatgcttcaaaatgtcaattgctttaaacttaaattacctctcaagagaccaaggtacatttacctcattgtgtatataatgtttaatatttgtcagagcattctccaggtttgcagttttatttctataaagtatgggtattatgttgctcagttactcaaatggtactgtattgtttatatttgtaccccaaataacatcgtctgtactttctgttttctgtattgtatttgtgcaggattctttaggctttatcagtgtaatctctgccttttaagatatgtacagaaaatgtccatataaatttccattgaagtcgaatgatactgagaagcctgtaaagaggagaaaaaaacataagctgtgtttccccataagtttttttaaattgtatattgtatttgtagtaatattccaaaagaatgtaaataggaaatagaagagtgatgcttatgttaagtcctaacactacagtagaagaatggaagcagtgcaaataaattacatttttcccaagtgccagtggcatattttaaaataaagtgtatacgttggaatgagtcatgccatatgtagttgctgtagatggcaactagaacctttgagttacaagagtctttagaagttttctaaccctgcctagtgcaagttacaatattatagcgtgttcggggagtgccctcctgtctgcaggtgtgtctctgtgcctgggggcttttctccacatgcttaggggtgtgggtcttccattggggcatgatggacctgtctacaggtgatctctgttgcctttgggtcagcacatttgttagtctcctgggggtgaaaacttggcttacaagagaactggaaaaatgatgagatgtggtccccaaacccttgattgactctggggaggggctttgtgaataggattgctctcacattaaagatagttacttcaatttgaaggctggatttagggatttttttttttccttataacaaagacatcaccaggatatgaagcttttgttgaaagttggaaaaaaagtgaaattaaagacattcccagacaaa

SEQ ID NO: 27 - DNA, 87641 bp, Homo sapiens
ggagagggagaaggctctcgggcggagagaggtcctgcccagctgttggcgaggagtttcctgtttcccccgcagcgctgagttgaagttgagtgagtcactcgcgcgcacggagcgacgacacccccgcgcgtgcacccgctcgggacaggagccggactcctgtgcagcttccctcggccgccgggggcctccccgcgcctcgccggcctccaggccccctcctggctggcgagcgggcgccacatctggcccgcacatctgcgctgccggcccggcgcggggtccggagagggcgcggcgcggaggcgcagccaggggtccgggaaggcgccgtccgctgcgctgggggctcggtctatgacgagcagcggggtctgccatgggtcgggggctgctcaggggcctgtggccgctgcacatcgtcctgtggacgcgtatcgccagcacgatcccaccgcacgttcagaagtcgggtgagtggtccccagcccgggctcggcggggcgccgggggtcttcctggggtccccgcctctccgctgcgcttgacagtcgggcccggcaacccggcccccgggcggaaacgaggaaagtttcccccgcgacactcacgcagcccgactcccgtagctgcagggattgtgagtttttcttgaaaaagagaaggaaagttcagttgcaaggggcgcggggcacgtttggtcccctttgtgcgagcaggaaaggcgttgtgttggccgcgttcgaggcgagcccccacccccggaaagggaagtttgagaagttggttatctgaaggcggccggggagcagcggcccggagcggcagcctgagctgccaaagcagccagcgcacctgggccactccgcccatggcgatgccgcgtgcccacccagctctttctgagccacccgttcaaaaggccagctcctcagtccttagctcctggagacggccacgctttccctcaggccggcttcttggcccggagtttttggaaacaagtttcaagaaaataatcgatttccaaaagaaagttagctggctccactgacgccttggcatggatggatagggagtggagatgctcaggtgaaaccgagaatccctcactgaatgcctactgggtgctagaggctgtagattttgcctggaacaagatagtcctgtcttcagggagttgatggttctatgcaattatcgtttgttggaaaccgaagggttaaaatcctaactaggctacccacctgatcgctgtctctgaaggtttttaaggaaaaaataaaaataaaaaaatatatatatatattatatatatataaatatatatataattatatatataaatatatataatattaatatatatatgcatgcaggaatgggggttcttaactatttgttatggaaagtgtaaaacctctgagacttcaaaagttagattttttttttttggagacggagtctcgctctgtcaccaggctggagtgcagtggcgcaatctcggctcactgcaactttgcctctgggttcaagcgattctcctgccttagcctcccgagtagctgggattacaggcgcgtgccaccacgcccagctaatttttgtatttttagtagagacggggtttcaccatattggccagggtggtctcgatctcttgacctcgtgatccgcccaccttggcctcccaaagtgctgggattacaggcgtgagccaccgcgcccggccaaaagttagactttttgcagctatgatccaaataacagtatctgcagctgtggtctgggtaaccgagtatttgggcaagtcatagagctttttctgggccttagtttcctcatctgtaaaatggccagcttgaatctgggtaattttacatcatcttcatgtttaacatcttacgtatcgtgcccctcccctcctttcccctggctcttctggtgacttggagatgacccatgtagactttggatgaaatgtagaggagttgacagtccacatcacccggaggcactcattttatttatccagggacatgggcagatttacctttaggtttgtctagaaaaaatgcgcatcacggtcagttgtaaattttagagtgtttgaagtggattgggaactttttaaaaattatggcatacattgaaggtggcatggagatggaagcttttaatcaaattaggaagaggcactattgcaagcaaaaagtcttgacacacatttgagtcctatggttttaataaaatcttagtgtttcgttcttggcgtttttcctgcattgcagtaccagaatgttcaattgtctctcattttcctccagacttttaaaacctaagtgacattttgctaataaatatttaaaatggcacccttaattttctgtggatgttaaaaatcattacaacttttgttccagattataaaagaaggaaattagcaggccctgatgttgttagttaggttctgtttacaaggataaggtttatgatttgcaaattccagacccaatagttcacgagtcactttcatttcatcaatatacacacttttaaacaattagcttaaaaacgtggtggctttttatttgggtatttagacagttttacaaggcccacagatttcatatttttatagaactgaagtttcaaaatggttgaattaatgaatcattttgaatttgtattcatttgattcaaattaaattttcaaagttggccaatggttgaagacagatatattgaagacgagaaacctaattctacttacattttaatttttcatgtaagtaaatagtttcagaatttctctaacgtaattggtaaactgaaaacattttttcaaaatatcttaatgcaagataatatatcaggtaatgagattgtttaataaacaacaagctccttttacgtcacctaaaaaggcccaaaaatctgtcttctgtttagtagcttctgtacttctgtttagtagtatgcaaaggatttaaataaaagaacaaatttcactaagaaatagaaagtttttttttcttcgtttttgacttaatagattcactcttcctaaatgatcaaaattaagaaatgactcttttggggaaaactgtaaagtgcacaataactcttcaggtctgaaaaatatgacttttcaggttcctggaagtagatagattcttattgaggacaaagaatttgtaaaagtgtcatagtgatcaggttcttcacatcactttaataacctgcttattttgtcagggtaagagactagacatcattaggccccaaatctgatcttcagtctactcgtgctttttttccgcctcataaaaacacatttccacctttaggccactcaacatcttatttttaatgagttatgatttatacaaaatactaatcacattttgaactcattgccttcttttcaatgtagcattccctaatgatgactgttgtctatgtagtcaacataactactacatgttttctactcagttatgaacatgactttttaattttttcagtaaggttagtttttaactctggatcaataaggcacctctgatatcattgcaaaaactgggcattttttcttctaccttttcaaccatatttattgagtatctcttgccaggcaggatgctcagacctgggataccatctcagatgaataagacagacctggtctttgccattgaatttaacagctgggagcatgttataagtaaagaaaaggatacgtgttttaactgtttatatttgaaagcattatggaatactggtgttttattttctacacctcattttcaaaagcctcatttttttttgttgttgtatgcactaggaggatgtgcatgttgaatgtttccttctaggtcccattgaatgtatttttgaatcaatttgttgtctctttcctatccctgccttgtcacggagccccagttgggcagcctttaattgcattctccattccatagccagcatgatggacccaatgcgttcatttagtgctctctttgaggataggctggtggtagaagagtgtagggtataaactttggaatcaggccgtcctgggttccagacccacttgccatgtactggctgtgtagcctgttgtagttgctttacctactagtcatccctggtctcatttgtaaaatgaggattatggagttatggtgaggattaaataaaatattgttttaaagtatttaacatggtgcctgcaacatagtaaatgctcaataaatatcagcttctgttattactattaactccttaattgggcttaccaggggcctctgacctggttcccatttgactctgctgcttcacatcccaccacagcccacattttcccagtctatttgtgtcactacacatacacacaatgtgagcaatttaggcagctgttcctttgttcaggatgtctggaactcctgctacctggctaattttcactcatcttttaagacgtagttcaagtgtcatcttcttgaggaaacctgctttgaatgtcccagtttgaggtaaatgtctcctatgagatacagacctctcacttagctggtaacaataccaagccaaagtcatatctttacgtaactctcttgcccattatacctttaatcctctcaatcttattcagttttctatctctgggatctctggcagtgcctgacacatcatttagcacccaggaagtgctgagctgagcctccacttcatcctactgtatctaatgcaactgaggtcgagcatttaactaagcagtcactgtttgttaggtgtttggtccaaatagtaaaatctttactttcagttagaatagttttagttctgatcacaataagtaatttgactgtttttgaagtatggaattggttcttgtattctcatgaaatatggaaaaagatgtttcaacttctgacaaacatgatggaaagctgctagaagttttcatgcaattcctttagccataaattttgaatcagtgtagggccttgaaagccactgcaaaattttaaataaagtcaccagaggaattatccagtagatactgattcctcttttttttttttttcatagaagggtgtcggaaagagaattttattacgaatgaagtgctaaaatctaaatttattttttaagtttcttttttcattgggttttatgttttggtttataagggtgaagcagcgttggttgaagggaagtgtggtcttgtagccaccactgcctactctagagtagcgtggatattatttaggtctgatgcaaaccaccaaagcagttttaaatagggtgcaggggaaacatacttcctggctacagcatggcattatttggccaagttccacataaaagcataactctgttaccttgttagcttctaccctccaggtccttatgtacaacttcagcagatttaagttatgattttcagtagaacagatatgcattcgcagcaagaatgctcaccgcttcttttgcactctctactttcctggtaatattttgctccacaggtacttgttgcttgtgactgaggcaagataatgactcatacttctttgcttggcatgccaaagggtttggaatgctggacaggcaaattgtctcatctcagggagaaggaagagaaagacaattaacatttgagaacctaccctgagacagccacttgatattatgtatctcatttaatcctaggaagaaatctccaagataagttttattatctttattttatggatggaaagatggatcctgctcagggtctctctggagttttgcctgggtgcatgtatgagtgtgtggcccaagcttcttgtgcttgcatgctgctaggttctttcgtgtggtctctatgtgtgtatgcgtgtgttgggagggaggctgaagaggggtgaatggatatcagatttgagagaggggaagcttaccatctaatgtcatcagttcagtgctcctgatttaattgatttggtttgcttgcattatctgcctccttcctgactacatttgtaccacagaaaatcaagataaggcagagtttctttgcataaggaaactctacagcccacagtttgacaatggtgtcttagtggtaggactcatggtgggtgacctgtggtttggccacttatagcagttggacataccccatttgcaaagatgtgtattgtaaaccccaaattttgagtgtgtaggacaatcatttgtgtacaatcgtgtacaactgctgatgagggcaagaagagccgactttatccaacataacaaagaagaaggggacagtttgacttttgaaggggacaatttgaaaacttataggaggttaagattctcttcctcacccattacatcaggagtacttctgccttttacttgccacagtcagctttctaggtcttagcacccaacaagtagcaactatcctcttgggtgtagtcagtttagtctacttatggcctcctgcttagactcttaagggttccctagcatctgtgttttgtttgtaggtttgaagctatcattattagatgagatttagcttcagggcccgtacctatgactggggagattctatctgggaaaggtcaagacatgcagctcttttttttttttttttttcttctcttttctgagggaatattttcctccaatttttttcagctctacaactaaaatatagacctagtatatgaacacaactggcctctgtcctgggccttagatggtactctgctgtcattcttctctggtcagagccatgcctatggggtgaggtgacttttgggccttccagtcttactctcttttcatttttagaccatgatttggttatgtgggaacccacattcgctgtccagaaggccctgaactggtatctgcagtttgcatggatccttgaagccatcttcctgaaggctgtcattgctactggttgtgcaatctctgcacgagggttgtttaagggatagctctgtgtgtgtgtgtgtctgtatgtgagagagagagagagagagagagagaaagagagagagagacagagagcgagcttgggtgtccacatatcacaaggcccctcttgatgtaggatggagcaggcaggggggaggaaggcaaattgattaccagggctcaggatgatgtctctctttaaaccacccatttctgtggaaggactatgaacattgtaggagttctaaagttgtacctggtcttccaagacattgaaaagatatatttgtcagtctaggtagaaggataacacctattttattgagcagtttgctagcttgatttgtaactttaaatgttttgacttatggtacatgggcctctatttgctcacttgccttgggccttcccatgttgggggtggatctgcagcagcaacattcctttgcagagatgttgggtagaaataagttttggttaattgtaccattttttccctggaatagacaacattgaacattaaagaaaaaatgagttactttgtagacatagtgctctatttcctttgggaaatgtagtttttcttagtttgcgttgtcctgaagtgaactttagctctatactttttttctttcctttttttttttttttttttagatttcctagtgccctagttgcatttcttctgtgtattgagagaccaccaggcgggcaaggtgaagtttatctgaatgttttttcctcctattgtaaatattttatttgaaccaaaaaaaggcttggttcttctcaagcctctttaaagaaaacaaggaaaaaggcttctcagtgctttagaagatataagattgtcaaaacttcattttagagaactagggatttggttgaaccaacatgaatgcctttgaaagaagatatgggttgggtgcatattttcagtatatgctgcagcagctctttattaaagtataaatcattacgaagtcttcatttcctatggggcgataacactgctgctttgtggatgactacctgtcacgcccaaatcctgcaaacttttctacatagggaaatgaaattgggcttatttcccctgtagcttttctcaagagacttcatggactaatttcccaataatcatagtagctaccacttattgaggtcttgctactgcacggatcatgctgagtacttcaggtgtattaaccctcaaaacaactttagaaggtaggttatattatgcttattataaatcctccagagtcaataaatttgcctaagtccacctagttagaaaatgattaggctggggttggaaccaagatggtctggtttggggatctagattcctaattgttatactgtactgagactagtctgccttaattgacataaactacttgtccattatagcatgggtgttggaagactagaggttaagagaaataataatatccaacatttttctagtgttttagcattcttcatatattatcccattgcattttcttagtgtaataaaataacactcggtttatacaccaggtagtcaaacatcatgcctgtcttgtgatctcaatggaaaaatgaagtgtatacctcaagtgatacagtcttggctgaatcatggaacaattatgccatcaggaagtttaggtattctgagtaaaacaggcactttatttgaaaggactgggagacttcacagatgcatcaaatatgttgaggatataaatgccaggctcaggtggatttactgtgaagtgcttgaacttaaccttcaaggctacctataccctggtataggtccatctcctggctctaggagaggccctggcaatgtggttaacaagtgtcatcaagtcaaatactacgaaatcttgcagtgccctgaatcttacagctcacatataaaagaaacctgataaaagttttccaaatttgaagtcaatccaaaaaatttatatgacattacctgtaatgaattatgaagctgaaaggaacttttccaaattattcaagaataaattacaaattctgatctacatttctaaagggaagactgaattatttttctattctctcaatagagaatattgcaaaatgttattggaagagatgatcaaagagtgtgcaaccaaaaaatataggagaattatttcagaggtatggcaatcagttaataaaaatatttgttttttaaacacttcatatttgtagtatttatagcttttaaaaatttgttgtttgtatgatactatttaaaattttttttccagagatgagatctcattctgtcactcagtctggaaagcagttgcataatcataactcactgcagccttggagtcctaggttcaagcagtcctctagagtagctcggactaaaggcatgcaccaccaagaccggccagttttttgttttttgttgttttttaatttttgtagagatggtgtcttactatgtaccaagtctggtcttgaacactggggctcagaggaacctgtccacctctgcctcccaaagtgttaggattacaggtgtaagccactgcacccggcctgtatgccattttaattctaaataaatattcactttattcttaattttatattcactttattcttaattttgtattcttcttcttaaagagtgcccctgaaatttacaagcttcagattccaaagacctgagtctttgactaatggtaggatttgtttgttggtttagaaaataaatgttaaaaaatgcctcttcctccttccccccattgcaaacagagactgaaatctgcattgttatttcacaaaaccaaaatatttttcctccaggtttagctaaacccttcatcattttcctactttagagccccatgccaagtagaaaagaagttgcaaagatgtaattatcacaaaccttcatcttggatgaaagataacctagctctgacccttagtttgagattagaaggactctacctaggagacagctggtaaagactaaggtatgttgtaccaggaatctaggtgtctgggtgaccaggctgtctttcttcccactggggctcattttccttctatacagtgacaagaattggactaaataagatttccagtattttctcttctgaaacatttcattctttgttatccctgtactattttgttagtagaataaatcattgaagttgagttagaaaatctttagctaatcaaaatagaaaactaacaaaagtcatgacaggtcagaactgagaaataccacagacttccactggtgttcattggagatgactactattaaaaaaagagaagaaaaaaaaccatagctattttgaaaatttccgactacaggtgtctgagcatacatcctgactaaatagcatgtttacttcagctagagctcactccttcctaaataaaaggcttacttggttttggtggtaatattattcctctttggttaattatggtattttcattctccccttcctctgaattggttaaaatgtctgtgaaaatttttcctaaggtagaaagttatgaaatgctttgctatgcctaggagatgtaaagcctaaaggaactttcatattttttgggaaaaaaaaaaaaggaaacttgtctagatataattagtgttctgttgcctttcaaatatttctctaccacttttcttaaaatattctcagaaaagacagaatttgcaacagattggcagttttcagactgctgttttaggcaggggagtagctgccgcaacctctaattgcatttctgtagagtttgcagacacttgttagcgtagactaggaatctttcaacttttgctgtgagtgactaccttgttactacatatcggatttgcgtctcattctctaacgctcatagtattggggaagaaaaaaagacaatatgatataatttgtccttcaagtatgtgaaaaggaaaaaaatctaataataacattttatgttcattattttggaatcccttaagttatatcattataaaataatctaacaatctcaatacccctgggcactcttacttttatttttataatttatattgttagaatacatttctattctcttaggcctttgttcattctactttctcacttctttaggagcctcattccttcctgaatattacattttatgagttattatatgcatcaaggcccaaagcttgagctccagcattctgaccccgaaaatgatggtttcctatcatcttctgataacagcaactgaagatgttctaataccttgccgcttacaggaggtctggcatcactgagaatttattggaaatgaggattgtgggtcctctccccagacctactgcaacagaatgtacactttcacaaggtccccaggtgattcctgtacacatagcagtttgaaaaacactgctgtaatagcattaaagcatgttccaaagagtagccaaatgatctgcagtggttttagtggatcacatcaggcttgtttctgtcaataaagaagaggagaattcaaggaagagttggcttagttttatgagagtcttttgactcttcctaagccgttttaactaaagctagcagaagacagaaggcactggtagcaagtcaactaaatgagtcagtttttaaccagtctgtttccccagtcatccttcatgagtcttttgtccactgattgtccatcccttgaccatggtgaactgtagaacccaaggacccatttcttttttctttcttgttttttttttttttttgagatggaatctcgctctgttgcccaggctggtgtacagtggcgcaatctcggctcgctgcaacctctgcctcctgggttcaagcgattctcctgcttcagcctcctgagtagctgggattacaggtgtgcaccaacacacttgactaattttgttgttgttgtatttttagtagagacacggtttcaccatgttggtcaggctggtctcaaactcctgacctcgtgatccgcccgcctcggcctcccaaagtgctgggattacaggcacgagccatcgtgtccggccccaaggacccatttctatatcgaactcactgcattaatcatgtttacctcattaggcatttactcacagattgccttgacatatgtaggccctaattcattctggagctattataccacagcatttcttaaaataggtagcactctgctctatacaaagtaggtacccaataaattaatgattcgatgacaggttttcaggaagtggttttactcttcaacattttttaatcctcttttgtcttgaggaacttatttgtctgatgctcagtgaagacccaataaatttctcttgaattgctcaacatttgttttagacttttctgagagtgccactgtaggctttttcattgatttgctcctttattttaatatcataaggcagctttttgtgacttagttacttttgtcttccagaattatgggtccctgtcagttattaatgctcttaattaacagtagccacaataaccagtccttacaagcagtttctgatgtttccaaataattttattttctgacttttttttctttgcctttgacatctgaactatacttggcaagaaaaaaaaacataaaaactttccattgcaactcatatctcatggtgattcctgttgcatcaaatcttaagttatccatcagaaaagttacgcaaaatctataaccatttggttttatttttgcccttgaattatgctaccgtaacacaaacctgaactcttatatttgtcatctgtaaaaatcacctaattggtctctgcttatggacaccctttgttctttctctgtcaataacacaggcattgccctcagttaaatctccccccagatggcattttgaatagctggcctctgttagaaagccttccatggattttatgaatcctagatcatcacatggccttccctttctctttgagcatgggggctgcctcagtgtcccttggctcctaagagagtgccttgtgctgatgggacacaggaccagtttgatgactacgtgcacagatgaagccaaacctcttgcccatcatctattccacccttcacatccctcatgccctggttccacttgaacccagctgcctcacacatcctttttgcttacaaatttcctagcttgtgaccattctccaccacctccccccaagttttaccattctctatttgtgccctacaacggctccaccctttgaaataacgcctggtctaaatgttactttttctagtgggccttccttgattatccatcccactgtgattccttttcctgcccatagcctctccgacaagccttgcattctcattcatatgaccttgtttgccaagctacctgtgctgtctctgtgtgttttaaactattttactagccaggcgtggtggcttatgcctgtaatcccagcactttgggaggccgaggcgggcggatcacgaagtcaggagatcgagaccatcctcgctaacacgatgaaaccctgtctctactaaaagtacaaaaaattagctgggcgtggtggcgggtgcctgtagtcccagctactcgggaggctgaggcaggagaatggcgtgaacctgggaggcggagtttgcagtgagccgagatcgcgccactgcactccagcctaggcgacagagtgagactctgtctcaaaacaaacaaaacaaaacaaaactcttactagaatgaaaactctttgagggagaaacttctgtctgattttgccatagctcttagcacagattctcactaattctgtttatgtgttttgtttgttgctgtttggaattcattgcttttaaaggccgaggaaacttgcttttagatccaaggcggggagtgctatttttttttctcccagatggcttttcaccaccaagtgtaaatgtcaatggcttaaagccacctgtagtattgtttgacagaaccataggcttatggaaaatctcgtatgatctgctttgtgtaaattgttctttacagtggagacttgctctgtctgcagtctttagtttctgtgaattttggggagctgtggtgtgtgggtgttaaggttaattttccatccatcactggctctgcctttgattcatttattctctcatgtgtgaatcttttgcagaaggctcaatgcattatgactatagagaccaggcaaagtcataaagtaaatcacaccatctcacgcaggacaattttttgtcactcctgccttttctctttatgagtcatagatgatttcagtcattgggattgctggaatagggatggctgaaggggtcttggtgcaatgaagagtgcctgaagatactcttctacctacctgagggtaaataatcccatattgcaaaggtgacccctggttgtactttttggaaagccctgttaaaatgatacatgctaaggagacttaaatatgaggcctttcttacctgggtgcttaataggagtgggtttctaaggatggtcttgaatttggccttcagccttctcgtccaccatagtccccatccatcctgaataaacatgcagtctaggtaccacaagtagtgttctcttgtgcaagcacagcttccagctgtgttgcctgcctccctttcagccagatcatcacccatgtagccactcctctatgggaattctggagctaccactgacatcacattacatagatttggactggtagtgccctacctgctctatctatagaggaaaaggagatgaaataagaattttaatattctttttttttttttttttttgagacagagttttgttcttctcacccaggctggagtacaatggcacgacctcagctcactgcaacctctgcctcctgggttcaagttattctcctgcctcagcctcccgagtagctgggattgtaggtgcccactaccacacctggctaatttttgtatttttagtagagacagggttttgccatgttggccatgctgctcttgaacttctgacctcaggcaatccaccctcctcggcttcccaaagtgctgggattacaggcatgggccactgcacctgaccagaattttaatattcttaagtcttaatattctgtggcacttattggaaatggttgaaatataatgcttttaatttagcatgtcattggttcactctcaaaactactgaaaagcacttatctttcaagattttaatgatgatgttggtgaggacgtttgtggtaagtagataatcacttacattattcagcactttacaaagcattttcacaaactcttgagtattggttgttatcagtttattactgagatgcctgtggtgtcttcaggggacaggagagaatatgttaacttcttgaataactgctgcagccgtagttagccccctatgagccaagcctattggctttgttactcccaaggtataacttatttcatatatataagcaacttgactaagtattagatgtctgtgtaagccattttctgtgagtcaaaacaattttgttcttccttatgtctttcttcagaggtacatctttaataagttctgggaagggaagtgaaaaacaatgcttgacctctgatacaatgtactgttttgattatgatcagcactttaataaaatttatcatcaagaaagtctttggagtgagcccctgaaaagcttgggaaagtgattgatatggtgtcacttttcttaaattaccttcccatgttgctttagatgaccagggaggctaacttcactcttgtgctctctaaattgaactgtcctgaagttttaagaaaatgaaatgatcagactcagcagttcaagattgtgttggttgatagcagccacttagacctcagttcactatgggtttctgtgtactttattggtggtcaccaagatgcaatgaaaggtcctgattttgtgaacatttctgcccacacccttctttggtacataccttttgagaatatgtaaaatgtctttcattgttaaaatagctgttaaataatattaaaggcaaaaaaaaaagtcatgaaaatagtcatttgcgtacttcttcaggcagatagaaaactagtaccagccagtgcaatggctcaggcctgtaatcccagcactttgggaggccgaggcaggcggatcacgaggtcaggagtttgagaccagcctgaccaacatggtgaaaccctgtctttactaaaaatacaaaaattagctaggagtggtgggacacgcctataatcccagctactcaggaagctgagccaggagaatcacttgaacccaggagacagtggttgcagtgatccgatatcgcaccactgcactccagcctgggcaacagagcgagactttgtctcaaaaaaaaaaaaaaaaaaaaaaaaaaagagaaaggaaaaagaaaaagaaaaagagaaactagtaccaggaaaacagaaaaaagaagtgatttgaataatttcagtatgattgagacatatgggtgaaagatcaccagagggaaaaatgtctagtctgataactttgaagaaaacatattgaccatgtctagttataataatcttttaataatctcacagtaatagaaagcttcattattttcaaaacagtttcactttcctgtcatctgtaattttaaaaacagctctctgagatggatataattatcctgttttacagatgtggaaatggaggcccagaaagatgaaatcatctgccccagctgtaataggactgcccatccactgagacatagtaaagtatcattaattaatcttttcatcatttttctatttttagtcatgctccctcactgcttaatttgtaagtaaatctaagataaaaatctatagtctcctcgtattttcatattttcatagctaaattgttaaagaggcgatggcagtgtactcatcaggagacttgttcttgcctcgaacattaaaagcccaatttaagactggagaatttcttctttgagggttttgtccacccatcataagagatttcaaactatgtaatgagtcattttacttttccccttttcttatggggacagcttctctttaatacaccgtgtggtctgccctcttggaggttgtgtcaccattatcagtagacaaatgctgccatgtgtaaaaggctatgccagtttctgcagtcctgtagttttgcccctcactagaacttcaagttgcttaacctaatcaggaatacgggcatctttacataggaagtgcacttcttcatcatatagacatagaggtcaggtattattatctttggcttcctttctcagaaattcttaaacatgaatgtctgaataaacatacagagaagaggttgggcgctgtggctcatgcctgtaatcccagcactttgtgaggccaaggtaggtggatcacctgaggtcaagagttcaagaccagcctgaccaacatggtgaaaccctatctctactaaaaaatacaaaaattagctgggcatggtggcgggcgcctgtaatcacagctactcgggaggctgaggcaggagaatcgcttgaacccaggaggtggaggttgcagtgagccgagatcatgccattgcactccagcctgggcaacagaccaagattccatctcaaaaaacaaacaaataaacaaaatatagagaagaacagaacaagaagtgttttgagtagcagaacacgactcacacagacatctaatatttagtcaaattgcttttatataaaagaaggtatacattgaagagcaacagagcctacctctatgactgacattttcaaagaaaatggctaagaatcactttgatggccaggcacggtggctcacacctgtaatcccggatctttgggaggccgaggagggcagatcacgaggttaagagattgagaccatcctggccaacatggtgaaaccccgtctctactaaaaatacaaaaattaactgggcgtggtggcacgtgcctctagtcccagctattcgggaggctgaggcaagggaatcacttgaacctgggaggcggaggttgcagtgagctgagatcgtgccactgcactccagcctggcgacagagcaagactccgtctcaaaggaaaaaaaaaaaagaatcactttgattagcagaaactatttcacttgccatcatagaaagctaagctatacttctgcttttctactactagctttatataaatgttatttttcttgcaacataaaagaaaaattgagtcatattgttttatttaatttttcttgaagaacacattaaattagctctcacactgtggtgtggacttctttctgttttccaccagtgttcttcagggtgatttttccagtgggcttgattaggactgtgtggatcattgtgatgctttgttctcagtggggattttccagcaaagatgagcttcattaaacaatgactgggttcatggatttataattggagtgattttcttcaaactgtaataaatttcagtgttacctttttctgaacgccctttttaaaagggattccatagcaagtcttctggaataataccttttatataattctttaaaaactgtaatttttacatactgattcctgttaaggcagatgttattgtatcaagaaaagactcaaattttgaacatattaaaaatagtgtttcttcagatctggtggataggtgatgctcaatatatatttgtttaatggaataaaaaaagaaaaatattaaagatcctaggaagagaaattaagttgcagggatatattgcttgtgtaacgtctgtttagcattgcaattttctgaagggaaggctatccacaactgttaattctgatctaaggaactatttcccttcttaacttctttgctaggttatctaaagggagatatgctttctcacatttgtttccttgaacttacttttaatgttgccttgtagggtcaaaactttagaaatacagctttctcaggaaacttggtcctcagatctttcagacattatcttcctttaagcttattgtcctcttgggaattggcaaaggattcccaccctttaaaaagataggaaattgtaaaatccacacttaaaaattaatctaaaattatttttcaggaagaatttatacaatggcaactaaatgccctgcagccaattatgtttatgattcctgcctcatctccaaatggtactagagtttgagtcatatgagaaaattaattgggttgggcttgattgtacatgtatatgtatataataatgttctggttataatgcagtttgcagtttttctagttacagctcaaggcaaagatgagaagcaacacctatgggcctgactgcctctgtccagtactaccatgccccatctctaactactacattttttcctattgaattctccagtccatgtagcataagtcccttcctgaactcagtttatttttctaaccctggctgcacgttaggatcacctgcgaacttctaaaagaattccaaagcctgagccaagcacctagaagttctgactcattgccctggggtaggactttggcatcattattgttttaaaagatccccagatgattccgatgtggaaccatgttgagaaacactaatctagcctaacccagtgaggttacaaatgaagaatttcaccagagaggtcaaagtacttgatttcccacagcaaagaaattccatttactgggttgaaaactcccatctgttgactttaaatccagcataacaaatatgagcaaggttttagaaggttttggaaactcatctgcagaacagagcaaatacaggcctatctaaaagcatacctcacagtaaagatggttaaaaaccaaaaccggaggaggcagagtactcttggtggggctggtagtggggggaatggatgattttccaaaagagaaaacacttgacctgggtctgaaaggctgggtatgatttaaggcaggcactattgttcacttgttagccccagggccatgctactccacttccttcaaggaaacagagggaagccggcaagtggctgcctggggtgtgtgtccacacaccatatagaggcagttcttcagctctgtcagccatggccaaagcaggcagtatttgaaccaccttggaccactcctgaggggcagcatcagacaccaggcatcctttcagacaccattcttggagtctcttccctccatcacgtaaacctcacagccaacagtgaaggcactgaactccttccaggggctgagcaggctgccttgggcatgctcttcttgaccttaaaatccacctgatagatctggtagggaggtagaaattttggtggtaggaaagccagcaattatcaggtcaaagggtttctgataaaaggagttattcagcagaaaggtaatcagattatgggagccttaagtgccagtttgggctaaattctctgagtcactggcagattgtaagtaggggaatgacgtaataaaaccactgcaaagccaggagtttgtgatgggaagataggaaatccctttctttttttcccacatgggaaataaaaatctaaagatgtgtggggaagctccttagagtgccaggactttcagtatcccccaatttatcattaggttctgtccagacctcgttccgcacacagtagcctagagacacctctggaataaggtgtgacaaaaaacaaggaaataaatttattaattttggaaaatgccttctttttcctaggcctccctcatagacattttcctgacaagtccccacttcaggtttcagaaagagatgcaccatcgtttggaattctgaagaaactcaagtttcaattgagctgagtctcagtggcatgtattttattacatctaatgccattttaatgtacttgaaactggggagatgagggcaattggtacacatgtgtaaaccactacaaaaagttcacctgagtgtagaaggtagccagtagcctaaaaaccctgtattttggaggctgttacttcataatctctattatgaaattgggaaaaattatgtaattatctctctaagatggtcttagatccactgttcaatagaactttctgcagagatgaaaatatcttatacctgggctgtgttaaggtttaaggacagcactggtataagatattttcacctttgcaggaagttctattgaacagtgggtctgagaccatcttagatgatacatgtggcttgaaacgtagcaggtgcaaataaggaactgaatttcaaatatagatatatttttatttcagttaacttgaatttaaatagccacaggtggctcttgggtatcataatgaatagggcagttatggagcatcattaaagtccccattcttctcaagtcccaaagaggtccgttcaggtaatttcttagcacctataatcacagtgggacagattaaattacttgtacttttccattcctgtgctttggaattataggctgtttctttgtcctggaaaccagatagtctaatgtttgtggaaatactacttagtagtgcactgcaattataatactttattgtaggaggatgcagccaggccttttttttttttttttaatcatctgtgtttttagttttaatcttaaaaggattataaaaatagtactgccttgtgggagaaaaatatgcttaaagtctatgagcatggagtggtagggattataaaccgttacaaacttctcctggaaattctggggaaagggaagttaaagcggccaatagaaatctcctaggagaaaacttgccctgaagggatgcttttaattgggttcagtatttatcagaagaaccctgcaaaagtggtttccctgaaggcatttggattttcccctgtgaataaatttcacccaccttggtcacctctgtgctgtattctcctagaaactcacctttatttggcatgctgtgacttaaatcctccaaaaaaaaaaaaaagcctttgaaaaagcctgtgggtttttttttttttttttttttttttctctaaaatgttaatttcctttctttaggcttgtgtgggctttgactggaaacttaatctgtgtgcctgggctctgcattaggtttcagtcattgaaatggggcttaataagaattacttgataccttaggagtcagacgagccttacatttatcttgggctcagggatttgcattttgagaggttgtgccagctgacatgagcctttacaggtttcagcttgttgcaaacctagttgggtccatttctctcacttctgagaccttttgctgctgccactcatagctaacgtgttttccatggaacactactccttgtccctaattgtcttctctccctacctcagcagtgacactacagacagccagtcatttaatacgagactcattccttaagaagttgggatagaactttaattacacaaggcatccaagccagcagtcagggccctttccaatgcgattacttttcaagctctgccctgcttctccttccatttccctctgggccttcgttttcagatctcctcagaagccgaggaacgcaggtccttttgaatttctttagatcagtgttgtcctataggactttctgcaatgatgaaagtatcctgtctattcctggccacatgtggctattaagcacttgaaaatggctggtctgacttggaactgaatgtatgatttcatttaactttagttaatttaaatttataaatccatgtgtcctcatggctactgtgtagctctatctagattatgcccttgacttttgaacaatgtgtcttgggagagttctcttggctctggccctccactttcatgaaccagctcctcccagtggggaaagaagaactctctttgacttcagaactgacttccttttattgctaagttagacaggctaggccttgagcttaaaactcttcaccaactgtttataccctccatacctggcctcaacatgtccttttttctctgtgactatatccttattctttatccagcaacagcaaatatgcattaattttctgcagataaggtttcctttggaacttaaggaagaggtatgaaacttggctttggaggacttagggataggaaagccatcaccaagtgtttatagagtaccaaccaccgtgtgccagccaatgtttgagatttggggaatacagagtgaattaaagtccatgtgtacaagctaataaacaagattctatcaacatgtcagcagataagtacagcgcgagggtctgagaacaatggtagatgcttgtaattttagaagcggttgtcaagaatggcatctttgataatgtgatatttgagcagtaattggtatgaaatcgggatgaagaaggcagatctctgggttaagcgcattctagttggagggaacagcaagtacagtgtcctaaaaacagactgtgcttgtcatttcctcccctcctcccccatggtttctcatttttgcttctctttctaagagttacatttataggcatacatttttacactggacatcacaagaaattgagcgagttcacaactccactggtgctggtaaaaagattatgctaagatggataaaagactatgaaacatagtcaaaatgcacttctcagtcacctctggccatacgattttacacatctgggttctcaccccagaatgagataggtttaatagataagattcagtgtggggcaaatctaaggtgccaaagttaggtacatactagaacttccataaagagttgtcttaagaaatagaaagcattataatttgactttgtagccaaaggtcattcaaaacatttcaaagtttagatcacttattccagttttatctctagtactaaatgttatttcagcacacaaatgtggtcattccccatggatggaaggagccagctgtgttccagaactatgttggaagattgcaccttgaagactgtgtgcatggttctcattttccatcttaaaatcactgctggaatctatcttgacttttccacagcccattgacaactgtcattatgtaaatactgtccttttttctcaccaactactgtggctgatgtctcccctccaaaatttatgttgaaacttaatccccattgtggtggtatcaagagacggagatttgggggaagtgattaagtcatgagtggattagtcccacataaaagggctggaggtaaccagcctggatccttttgcccttccattttctgctatgtgatgacacagtactggtcctctctagaggacacagcaacaaagcaccatcttggaagcaggaaagggggctcttacgagacatcagaactgccagtgccttgattttggacttgtcagcctctagaactgtgaaaaatttctgtcctttataaatcacccagtctcacatattttgtatggcagccaaacagactaagttaccaaccttagtgggattgctaggacttggaaaggagtagccttttttttttttttttttttttaaatacagagtcttgctctgtcgtaaggctggaatgtagtggcacagtcttggccatctgcaacctctgtctcctgggttcaagtgattctcctgcctcagcctcctgagtagctgggactacaggcacgcaccatcaagccctagctaatttttgtatttttagtagagacggggtttcgccatattggccaggatggtcttgatttcttgacctcgtgattcacccacctcggcctaccagagtgctgggattacaggcgtgagccaccgtgccaggccgggagtagatattttaatcacaggaggtagcatcagaaaagttgcagctactcaccacaagagagacctttatgatgtttactgcaaattgcatcaaggtcatgacagcaatgagtaatgcccaggaaaggcgaagatcaaccttacactttttcatctaactgcactgtgagaaaacaagcaaaattgcccagtttaagggcagattctcagattttgtttcaaatttcctgccctttgttgtcctttctagaagccttaacaatacttgcaacttctttcttttttttttttttttttttttacttcctctgcttgaaaaacatgaagggggaagtttcaaagtgtttggtgttatcttagaaaccaaagtgaatctgaatgtgtctttctgtcctttttgtgtcatttttcaaaatgaaagggacctttaagttcatcatgtccaacccatttgtttgactggttggagaacaggcacagagagtggttgggtaattgcccttgaactcaaagccccctcatggtcgattcagagccttctccactgcaacctgctgccattcccagcatggtgaattctcctccagtagaagtcatatagcaatgttttataattaacttttacgtgagcaaatgagctccaggagagaagattaaggaatattgctttccatatatctggatggcccagaacactttttaactaggtacttaaaaatctactacaattgttgttgcccatattcttctgtaattctttcatcagctgtgaatgaaagtacagcagttttatttccttgaaaagtaagccaaacatgattttatttcaatattttagaattccacaatcttaagacacatcattgccttcccatctctgcatgtcaaacttactaattttattagcatgttgcgaaataacacactaagtgtctcaaagccaaagtagatcagctctcgcctgataaatgtgcaggagtaagcagaggatttgaaaattgaactggattctcaagttactgcctgtttgccagacctatgctggttatgaacaatatttcaaaaccagattatttggttctagatcctaaacactcttggcaactttattgtaacgatgattgattccattgtatatttgaaagcatcagggcacagtggtaacaaaaaattattatatttcaatttgtctattcattcaaatttcctgaaaggttttttagaagtcatcaaactgctacattctattgatgagtaggaatagatttaccaaactcatacttatcttgtcatttgtttcctgcaattttctttggtgtgagagagcattgcatggaatgttacctttctagcaagtgaatgcttgtgtggcattttttactgtctagaggattttcacaggtacttcaagcatgtttgctcttcatcatgatcctacatgggacgatttcataaatcaggaaatggaggtttcaagaagttaagtggcccacagctaatacatgtaagagcctgaattcacactcaagtttttaccttaaaactcttgggcttcaccaagctgaccttattatatatgtctcctaaaataagtgaagtaattacaaagaaccaaagcttttgtctaagaaacttattgcttccccaccccttgtatactttcttcaactcctagtagtcacacctgtgtctttgccttgtactggaatgtgtgtaaagttctactcttaaactttttgatggaatatctatttcattgtggagtatcaggaaggatgagggcttgtgtgtcaccattggctttgtcttttatttgctttctctcattgatatgatatgataagttatttcatctctttgacccttaatttctccatctataaaatgttaatgacaaaattgcatggtggttgtgataagtaaatgaaataatcatcacagtacttaatactggactaagcatttggtctgcattcgataaatcatgatcatggtaataataattattaacatcacatagatctgatttctaaagtagatgtcctctggccttgaactgaaatgtgattatacacattagagaattacatgcatgttaaaaatattcatattagagagttaaatcatgactttttgcattctagttaaaccctaatattagaagagagaattgaatgtgcaggtgaaataatcattaattgtaaacattcaggtggccacaggggcctggcaggggagtaggtgacatgaaggagtgtcagggaggaggcaaatttgaggacacagagactttctcaagaggagcatctcagctcacagtcagctgactgttgtcttgggatggtgtgggcccactgtttccaagtcttttttatttctttaagtggaattagaaaaccagttttgcatgtgaaatctctgaattttaaaacttggtttatattttaaaaagaaaagagttcaggccaaacagaacacatctgtgctctgtgtccagctcttgtacccactgtagcaatttctgctttagcttctcagtctgtgcccaagttatttggttgttagaaaccaagcgccttggacctcgttatattactttttaaagggatgcctttcccaaatatggtagtactctggcccttttccagagaaaatatggaaatcatctgttttgaccaatattttcacatgtttaataaaactgtaattgaaaaacctttcaggtaccaggcatgcacaagaaccccgcagcatattttgaaaaactgaagcaaaagcctccacggagaaatttatcagtgaaaattctgctctcacagaacattgatattcggaccaaatcccatgcttagttgaggcaaatggttcatttcaggggctgatttttcagattctctaatagtcactatcttttaaaaatctgttcttaccagattttgtgttagtttctgcattttccattaagctgcctcagtactttgagataaagaattgtttaaatcctaaatgaataacttaattaaaaagcacatcttcatttagaccatccttatttccaaagctcttttgatgaaaatcatttcgtgcatttttaaaaattccctagaagaacttaaagatcttgaggaaaggaccatgtcttatcctgtcccccttccctcaagggtttaaatatgagggctgtcagaaagcagcacattttcgtttaggttgactaattttgctggtaagtaacaaattactttagttgaattggaatgttgtaaaactccgtcagtcgtgtatcattatcttgcctctatcagtctgtgccatttaccaatgttttgaccatcaccaagagagttatttaatcatcttttattttcaataataaattatttccttgttgctacagcactccaagtcctgtcaactgagggagaattgttttctcagttgctgtcactttaggtaaagtaccaactttaaagcacttctcagcagaggcataaagttattattttgagagttcatgaaatagtgctccattctactctttcacttgatctaatataccatttgcatttatatggcttaacttttttaactggcttcctgttcttctcagccccaaaccctacattctggtttttgactcatctcatagtccctgcagtcagtctttgccagataaaggcactgttaaagtgagctttatcaatgaaaaacttaagaatttcatgtattgatgacagtatttactataaactgcttgcttctccccagctttcagaaatttgttttattcactgggtcctattagagctgaaagagcatgattgagaaagttacaattgtttcagctttttgaatatggcacaagtgctagaattctgaaatactgcctttggcaacaatgtgtagatatttccacctgcaagagtcattttaaatgtttagattttgtctcctgttatgtggcctgtatctcagagaggtcccctgccactaaaaacaaaaacaaacaaaaaacagaaaaataaatgaaaattcagcaagcgttggggggactcaaattgtacttcattcttcaatgatacaagaaagcaagaaaaccaagtatgcatttttaggatttatttggggtcattggggctggtaagtgttaaataggaaaggatgcaattgaaattccagctcagttattttatgtttgtcactggagaaagccaattatttttccgttcagctacagcttgtttcattccgtagaagactaaaaaaacttccttgtaaattgcatttaaaaaaatttgagtttaaaggtacagccaagatttcaatttaaagtacctcattggatgaattcatttgagacacaagtaatcattccttaatcccttaatttgtttggtaaatacaaatttatgtttatgcagttttcttaaagcaatcatagcaaactactaaattcatgagccaaaatgctagtgaaactcaaacctacaaagctaaattccctcagttgaacaagtccaaatgaggaaatcacacacataaatgcataaacacacacactcacacacacacttcccgtatcagctctgtctccatttctgacctcatgtttgcatttaaaggcaagtaactgattcacatgaggttgccgttgttaatgttgcctctcaaactagaatataagccataggagggtagggaccaacctggtgtttgttttagatgtcttgttgtgtggagagtatcccagacatttgatatccttaattgttggccagatggtaggtagtttcagtgtgaaaatatatatgtatgtgtgtgtgtgtgtgtgtgtgtgtgtgtgtgtgtgtgtgtgtgtatagtactgggattacaggcgtgagccaccgcacccggcccgtactaggtattttactagaattatttcctgctctaagagattttagagtattgattatgtcattcttgacaggttttaaaaactatattagtattacaaaaacatgtgcatgaaaaggaaaattgatgcttttgagcttatctctttattttctgcccacatggtggtctccctattaggtattgtttctccacttctgatcctggtgcccagaggctatgtggggctgtcacttgaatgaaagctgcatgcatctgccatgacagaatctgccttgcatttgctcatttataatgaaaacattttttaagtacagaaaaataatagaaaattcaaaagtaacagaagggtatgaaataaaaagttgcttctcaacctcagttttctacctatttattttccttttacagggccaaataatgtttgattctcatgtccttgcatctactcccagagaccgtctaaatatataagcatgcatgtgtgtgcacgtgtgtgtgtgtgtgtgtgtgtgtgtattccctttaaaaagcagtaacaggccaggcgtggtggctcaagcctgtaatcccagcactttgggaggccaaggtgggcagatcacgaggtcaggagatcgagaccatcctggctaacacggtgaaaccccgtctctactaaaaatacaaaaaattagccaagcgtggtgttgggcacctgtagtcccagctgctcgggaggctgaggcaggagaatggcgtgaacctgggaggcagagcttatagtgagccgagatcgcgccactgcactccagcctgggtgacagagcaagactctgtctgaaaaaaaaaaaaaaaagcaataaaagcaataacaacaaaacagaaatggtggtgtgtcaaccagggttccagttgcaagcagatggcaccctcaaattagggagatttaaggagagtttagtaaaacaagtacttacaaaggtatggatagagtcaagggaaaccaccacaaaatgggagaaaccatagtgcagatacttaggactagtaattgctatgttgacttgctaggcccaaagtggcaaggagagggaagaagtaaatcttggaaatgacctcctgaagagaacctgtgacctccaagtgagggacttggccagctggaaaagattccacagagggagccagaacacagataccttaaatgtgctcctcattgcttcccttagataccgctgggtcaccccattggccaaacttactggaagcttgagggcaagagagccggttgatgtagtccataaagatgagcctcctggggcagacagtctggtgaccaagggtggagaactgatctctaagggcaatagaagacacccagcccaagtaactctatacattggtctctaccttgcttattttcttgaatgctatagcctgggcttcaacacttataaagatagccacatggagctgccctctgctttttagtcgttgcgttgtgttccttgtttggatttgtctaatttattttactagtcttctcttgatgagtggttaaaaaaaaaacctgtttgtccttacaaacaacactgcagcgaatttatcaatgaatatcataaatttttagaagcgaaagtgcgaggcaaaaggctatttgcgtttgcagtgttgattgatatcaataacatgtactcctgagatgttatacctgtttacaacacagcattatgagaatgtttgtttccccatactttacccagctcactgtgttatctgacttattgatctttttcaaaatgagttaggtgaaatatggtatgcatttttaatctgcatttcacttgttagcaatgaggttgacatgcttcgcttttagagcttattctctggtgatatgatcaggaagtaatatttaaagtagcgtttttttaacacaatatagagaactcatatgatttgttatttgtttccaataagcattgataatgattttaaatggcattaattcttctggcacttgtagaatacttactatttaaaagcaagaattataaggcattgtcatttcacagagattttagagtattcactttgtcatctctgaaaggttttaaagtattattactacaaaaatatttgcataagaaggagaattgatgccttcaggtcacttgtctctgttttcttcctgcacacgccatagtctccctgttagctaaatgatggtatctctagtattgaccttggtaccccagagaccatgtggactgtcagttgaaggaaagcccgatacctctcttctctcaaggtataattagataaagcattagggttcaaacacatttttaaaaactaaaaagaaggtattgtattagaagttccaattagagtgtgcaatagatgttcagcaaaaagaactattcctaaaatgttcctatctttggtttaatcacaaggtgtttgtttggttggttggttggttgtagtaattggccaaggtatctgattggcttggggatgtctttcctgaagaattatacagggaatcctctcagattgcttgactttcttctttgttctgggtgggaggaagtgtgtgactagccaatagccttgtcccaccttgtctcaagggtcggagctgctgttgctagcatcacaggccacagcggctttctgccagatggctgcctcagtatctgactcggaaatgctgcaggcaattaaaaacctcctttcagagaacatgtctttcaattctgggcccatatggtgatcagggcctctgggtttgcaatcatttaagaggtcaggctcaagagaaaagcatatggaaagaactggaagatgagaaatgcctgtaaaaaggtgaagaataggtatttaatttcactaactccaaaatgactggagaaagggaaacaattattaaaaactgggttctccacagccttcccactcaacatatagtgggctggcatcacccagggcagcagctcccttcctatctgtaaggtcagtttcgtgtgtacttggctaggttctggtgcccactaatctcattgttgctgtgaaggtatgttgtagatgtgattaacagctaaaatcatttgactttaagtaaaagaaatcattctctataatgtgagtgggcctcatccaatcaactgaacagccttaagagcaaaagctgaggtttctgagagaaaaaatactgcctcaaaactgcagcattgatttctgcctgagttcccaggctgccagtctgccctataaatttcagacttgccagcccccacaataccactatgctacacctgcaggttaaaaatattcccaaagtacttgtgtattaatatttgagaagcagtactctaaaacagtaaattctatccaccagtttccatggattattctttgagatgttatttaattgtgtcaatttcagtggtcttactatgaatatataacactaatcaagacatccacaggtatttgtagaacaaataaatttctgagtttccccccacaaaaaacactccagaaaacaacagtcggtagatacatgaattcaatgatacacgaatgcatgaattcagtgatacatgaatgcatttctgacaagtgtttatggttattgttaaaccttgagattttacctaatggttcagctaataatagacactatttcaaagatttggactaaggtcatattcagaatttctaatatttatctgaaataagtctaaatcttattaggctgctcatctgaccctcaaagacaatagtacagttccagaaatagacacagctaagcagtcaattcatattctcaagacctggaacctctgtctgtaggcagtgagtgtggggaaaatgtgagataaaatggggaaggtggtatgacctagagtgaaggttttgatattactcatgggcttatttgaagagaagtgaaatattatgggccatgtgatactatcatatgctgagagatgctacccatgttcacttcctttagtggatggctttctaggtgacagatattcttattggaacttctttctggagaactttatgaataacgaatttgcctattaggggtagaaaattctctaaagatggttagctgctcacagagagtctataggaatcgaagtacagtcatctcttggtacccatgggggattggttccaagactcctcgaggagaccaaaatctacagatgtttaactcccttatataaaattgtgtaatatttacatataacctacacacatcctcccatatcctttaaatcatctctagattacttatacataatacaatgtaaattctatgtaaatagttgttatactgtgttgcttagggaataatgacaagaaaaaagtctgtacataattcagtacagccacaatcatcaatttttttaaaaaaatattttgcatccacggttgatggaaaccgcagatgtggaacccacagatacagaaggctgactatatactgccttaatataagaatatcttaactagagagacttagactaatataacaatctggattaaaagtaatgttgaagttgggttagggtttgctatagggttaattaggtgggttttgtatcgttgtttagaggaatatctttattcctagctatgcacatgtatgcacttactttccttcccattcctttggctttttaaacattatgtattaaacgtaaggagatgttgtttgatatctgaggtcgtggctggtaacatcttttcctgtggtttggagtgcacagatgcaatgtcccatacagcaaatgactgttacccttccctcccactggccctcatcccactctgaccagcagtataccacttagcatgttattagtgactcttgaggattccggggttggcttgggatgccttaactggatcttacgggcctcagagaatctgcaaaccttctcagatgatctacaaattttgtatttgtttcttttccccaactccaaagtgtgttcataaggcttttatcaaacttaggtgactccagcaaaggtttagagtagctttgccctctgaacttaactacctattccaccagtacatatggtatgcataaaaggacctgaggacctatatcatatagaggaaaagaatactggtttaaaacaaaggttggaatgtatatgacctcaagggctacctggaattgttaaggtggggagtctcctagggtcaactaatagggagtcgatggctggtgctgaacatgtcctgcatacaggcttttgaaaaaaaattctggttaagctcttgcagtggtagcttctgctgtaacaaggagaaaaatgtggcatccctggctgggttcttgtgaagtaatatgctgtatcttaggcaactttcctcatatacagtgggtgctcagcatgtgcaaattcttattgtacactgcccttcccaccatatgcctgtgtctatatgcagtacagttgcttgtttggcttttcttcaacattcaatggaaaggctttctcttgttgggtctacccatcaagtaacatgtattatatctcgccaggggccccgttacagtggtgctcctggagctgtgcaaattggtggaccttctctctctttctctctcctccccctccctccttgtttcccttcctcccttccttcctctctctctccctacatccttcttccctttctctccctttctttcttctaatggtccttttttcttttccctgttgattgtgttctgcaagcatcggacttaaaccacttgcatttgtcaatacatctgtggccaccactgctcccagcacccatctcatctgttttcatttctgtcttatctatcgctgctcactcctgtcactattctcacgtttctaaggttttgctagaaaaggactggccagcacggagaagaatttctatctgaggtgtgaaagagctaatcacctctccttaggtgcatgtttttcacaagggaactaattccagctatatccaggtgctgtcccctcagcagcataagttgtatatgtgtttgtggtggtggggtgggagtgggggggttgctgttttgttttctgtttattgtgttttttccaactaactataggtctgggttctcaaccttggttccacattagaatcatctgggcagcttctaaaaatcctgatgcctcagttaccttccagaaaaattaaatcagactatctgggagtgggaccccttcagtattttttaaatttcctcaggtgatggatttcaacatgctctccaagttgataaccaccaatctaagctaaaatcctaagatgttggaagactgaatttcaagtaatggaaatttggttttatatttacaaacaacaaaccttcctaatcagcaaatagatgcttgtccaaaacatactctatacaaaaaatacgtatgtatgaaataaacaaaacgtggtttcactttttttttgctttaaacaatgttaaagaaacctaaagtgttattagttgtttcaaaaattgatccaagtataaccatgttagaaaaaaatacatattaattgttgtgtttctcccaaatttcacacagttcagagagtatttctgcctatatttttagctaagcatagagctcttggtctgggagacactgagaatttcaaaatagcttgttacctaaaaataaacttcctgaaatgaacttgaggcccgagagggatgaatggctttatttttttcttctatatttactgttaccacaagaaagcaaatcttaaatttatatacgtttatatttttagagacccaggaaacaggtgctatgcccaagctacaaagacagttgcagggcaaagtatctatgacagaatcctaaaattcacaggacagagagtgactgtggaaaggcattgaaagtgttcctctctaggcaagagcggagggaacatgaggcttttcttaggcctctctaagggttatgccttggaaaagtacctcacaactttctgtggcccagcaactgttccagcaccccatgcggtctaagtgcttaatgtttcttagtctagcatgtaagtattaattcatgtttgctggttgagtgcctagtagccttgtcatacttcactgactgtccaaactcatgtcttaaacatcatcaccatctcattgaggaagaaaatggggaatggggtgttacacctttatttgaactgcccctagtttgcagcctgtattttgcaaagaatagtctgtcttccatattttattgaataaatgtgaatgaatatcacatttataatcacattcctctctaatctgagtgaagaagttctgtatcctatcctacatggcatcaagggccaaacatggactccttgtattcatcctgtgttcactcatttatccaataaacatttttgtatgcctgctatgtgaaaggttctcttcctggcactggagatatagtaggtaagtgaggtggagaaagtttcatggagcttacatttttgtggatagattattagcaagtatgcgatgcagatagtttgtgcagacaataaataaaacagagttgctataggatgaagaggtggcatttgatcagagatcagaaaagtgacaggaagctaaacaaaggtaatagcaagtgaaaggcctgaggagggaatgaacttggcttcttcccagaagggggcaggagattggtgatggtggtgataagggagaggtacagaaggcagatcctgaggtggattcagcttttatttgctgcgatcataactccaatgcctcaccaatgcttgggattgtgtctaggaggcactcagtaagtgttagttaatcaattgatttgcctcaaacacagagagagatcagtagaactagtcccttgaaaagaagacccttatagctctttcaggagtaggtcaggaaaatggcggcaaaatcttgtgcctccagcaacggttcctcctttggtgtggcacttcatgactctgtgaggttatagcctccctgcccagctgagcggtgatgctcgcctggctcccacatcctctgtgctgccctctattttgggtcaccctgacttggtctgtttcctgtcttattcaccagctaaactataatttccttaagggtacttttatttgtgggcccagcactccgtactatgcagtgggcccatctaggtttctttattgaatgataagatttttgtagaaagtggaccttatgacaaccattgacaaaagcaaatggctactcaaccaccccaacccctcaccacccctcaccacggtacaatggattttattacaaattgcatacaccagataattctaatctgatgtgaaggaattattttgcctttcttcagattcattctcatgacatcaagttcatttgaaattgcataacatcttcaggaattcattggcaggctgcctggcagttggataatcatttaatatatctttctctctcctcagttaataacgacatgatagtcactgacaacaacggtgcagtcaagtttccacaactgtgtaaattttgtgatgtgagattttccacctgtgacaaccagaaatcctgcatgagcaactgcagcatcacctccatctgtgagaagccacaggaagtctgtgtggctgtatggtaagcaagccttttaagaagttattctttcttttcccctttttacataatgtattctcatagtacacacagtcagtgtatctctgtctcctaaatgtaaacacctgttccatttccctttcctttagaccatctctctttcgattattaaatgtagtttctaggggtgttctctgcatgtatgtgtacgtttatgtgggtatataaacgtatcatgattataaaatgatcatgataaatgtaaagatcataaaatgatctttaatataataaatctggaaactctttcttgtatcaagaagagggatttgccgcttagtagtcatttaaccgacacctcctcagcaccccatagtgagaccaggagctttgttctcttgaggcaatctcaggtctggaagaagaggtgatgaaaggttggctgttggaagagaaaactaccagccaaaaatggggaatctacttggagaaccacaaaaacaacctgtttttttagtcagaaattctggttatattattcatataaccattgggatagatatgacttctttctctcagctcagaactacatatttcttttttttttttgagatggagtcttgctctgtcattcaggctagagtgccatggcacaatcttggctcaccgcaacctccacctcccaggttcaagcgtttctcttgtctcagcctttcgagtagctgggattacaggtgcccactaccacacctggctaagttttgtatttttagtagagacggggtttcaccatgttggccaggctggtctcgaactcccgacctcaggtgatccactcgcctctgcctcccaaagtgctggaattacaggcatgagccaccatgcccgaccagaactatatatttttatcggatcacattttctcctctctctctctctctctctctcattccctccaactcatacatacatctcaaataataattatacatacacagtggatactcatgaatcatttgattaattcatggttatagattgtgagcatgaacaagaaataaccttgatctttagaagagttgtaattttacaaaagtacataaattcattaatgagatatgacattttgcagacttattctgatgtttttaatttattggccattttaaaaaaagtaacttatgtgtctcctggctagttgacaaacaagaatataaacccaaatatctctcccccttttttgggaatgagtcatttgagacccctagaccatgtaaagctagccttgatgatagatctggaaaccttgcaaacttctgtacataccacgggatgaactggtttcttaagaactgaaggaatgttaacagcaaagacttgtcatgacatacttgccaatatgatatgatacctgtccatgtccacttctaggtaacgctttcaaagaaaggatttggacaaagaatgtgttcagaggagagggaccagtgtggttagaggcctagaaatcatgctgtctgaggaatggcctgggcaattagacatggttagtacagtgaagagagatcgtgggttctgctgatgaaattgaaaggctctcaggtagaaaatataataaacatattctgcataactctgaagggtagagggaggatccataacatttgcaaggcaggcagacttgtgctcagcataagtttagacattttcacaatcatggtttcccaacagcagaacaggcttccttttctgtaagcaccaagtgaagttcaggagaggctggatgaccatatgtcaaatagaatgcaggaaagattgagacaccagactagatggcctcaaagcttccttccgtggtttcttaaatatctacggtggtgtgagcacttgcttttgcaacccaaaaaggctcttttaattaagatttttgttttcctgaccagtaatacaagcccaaatcattaaatgtgaatcaagtctctctagaatagaggctttgctagcctcaaaaaaatgtgagcatgtcgaagagaggaggcctccctgtcttttctgtgtcccagctataaagggtaaatacaatgaacattattttgacctgtgctggccaaagaaaattctcccgtgaagccaggggtgttgataatgagaaggggaagtatagggtacgctatagtgccctccttgatcctccttcatgaccaaggcactcattccctgggagtgttggctgttgaaggatcactgctgagccttccctccagtgatgggagctgcctcattcacgttggacacttttcatgggtagccatcatcccatggctagttgatgcagagaaacaaattcctggttattttgccataatgtggtacatctttgaaggacatcccattttcagagtttccaaggcattcactgaggcctttgctgcaacctgcattatagtttagctttttccttctgtgcaatactgttgcctttagtcgcttacagatgcatctccaaaaacctcctgcacagaactctcacagcctcaaggtctgtttccaggaaacctaaactaagacaggaggctattgtaaaaatagccagtgtggaaactgaaaggctctactatgattgtagatttcagtgttgttgtttttttaatcagttttagtgttttttcattcattcattcattcattcattcatttaactaatgtcagttgtgtgcccattccatataaaatgcttaagctgcctccaaggatagaaatattttataaccaaaattattattattattatttttaaattgagagggagtctcccactgttgcccaggctggagtgcaatggcgtgatctgggctcactgcaacctctgcctcccgggttcgtgcgattctcctgcttcagcttcctgagtagctgtgattacaggtgcacaccaccatcacgtggctaattttttgtatttttagtagagatggggtttcactgtgttggccaggctggtctcgaactcctgaccttgtgatccgcctgcctcggcctctgaaagtgcttagattacaggcatgagccaccgtgcccagcctccaaaattaattttatcatgttggttcttctttcagtggaaattgacaacctcttcagtggctcagagcaaatgttgcaggacaaaaaaagaagtccgtatttacttctttgtatttacctttcctatgctcagctatatccaaaaagagtttgaaaagttagctgtgcctggctgttacaggagtgagtggagaaagcagttaagggctttaccaggtctcaagtattacagttgttttctctctgtgatgttagttctctcagtagctaagaggtagaaaaccggaggctctggaagagctgcccaataattatagagcagctttctttcatggctcacagttccttcttaggcctctataagcgtcacaaggaaaagagaccatgcctttctgtgggcacagcataccttcgttttattacccaaaccaaaaacaacctacacacacacacacacacacacacacacacacacacacacacaaaactgtgggggcagggaggaaggtgttcttgttccatgactacagctgatttgaagactgccaagtagctttggggttaaagatgggtagatttccaaattatacatcatttgttgtatgatcatgccaactttcatttagtttcatttggtgtcctgatagccaccctcaaccaattattctgcttgtcactcttcctgtcacagcagggaccaacttagcaaagccttgctcctcttgtgtctttcggaattctagtttaagaacccttgagccccttcacaagcagacacatgtacctccactggagtcaactctgggctgcatggatgttgacactggcaccattcctgcctggattgtcctaacccatacccttgcccttatccctttgtcaacatattgtcctttaatgtccttgacttaagcactaaaaaagtggtattggtcaaagttgctctttctctcatggggatggccccgcatcttttataggtgcaagctgtgtcttagctgcttcttgcttctagcctgccttccgttttccttgctgtgagcagtgagcctttgtgcatggggcagggaggattaggggaaaattggtgagtgagtacatgcatgcattggctcatgtgtgcactcagaatcttcatagaagattactctagcaaaactgactggaccagattagcccttccttccgctccctctctagacagagagaatgcgattcaagacaacaggtattttgcatctaaaaaggacagaggtgaaagggtggatgtcagactagccttgttggacagtcatccaagatagtatgttcatgagggagcagagggaggtagatagagaggtgatacccttttccaagagagccaaaatgttcttttgttcaattataatagtgggcattaatcatgttgtttaaaaatctaatgtacactgacggccaattgagcatttcctagggcccaaggaaaatgctatgtgagaaattctctgagccctgggctaaattagtcttcaaatatgtgctatgaagtgatactgtcaaagtagttagtttatgacagcataaaatatttcattgaactgtaaatgaagaacaccctgacatccctttccatttcttttatttatttgttttttttgtttgtttgttttttctgaattgctcctttctgtaatttgggaaagactgcagttctttatctgcgatgtttcttcccgtttttctcagcagaaccagctgttgacaaggagtataccctttacacgcaatgctctggggcccagcaaacaaaaaaaagaggaactgtgactatttccccaggcatgctctttgaaaacagtatagctagacaggacagattttgccacttaaactaggggtgtgatgtgaggtttgcattacattcaggatggaagatttaaaattatcctgagtacctaggaatgttctttttttccatgtcttcccctttaatgatttaattaagacttaaatatgtaaagttctccaccaggactgccccgtggaacgctgtctgctccaggtgatgtttataatcacaaatgggttccaagaataaacaaaggaaaaacagaaaagagtagaaaagcataggagactataggacagcctgcgaatgctggagaacaggaaccagctgccgttgttaggaacaacttcatgaaggaaaagtattccagattgcctttctgtctggaggccatattattcatttattctctttctctctctccctctcccctcgcttccaatgaatctcttcactctaggagaaagaatgacgagaacataacactagagacagtttgccatgaccccaagctcccctaccatgactttattctggaagatgctgcttctccaaagtgcattatgaaggaaaaaaaaaagcctggtgagactttcttcatgtgttcctgtagctctgatgagtgcaatgacaacatcatcttctcagaaggtgagttttcttctcttaagggtgtgggacctgagatctgtgccaattttttgtatccttggtctgcagtgtcatagagcacattcctcctgtggtggattgcatacagtggattaggagctcattcagctggtggaaagaggggcttggggagtagcagggtttgttctggttctcatcaaatatggttgactggggcaaacattattatttgtctttgacaaatagtttctttcacctagagcagtgtttctcaaagtgcggcctcttgagcagccagcatcagtatcacctgggaacctgttataaatgcagattctcaggccccactaaatgagaaacatagagggtgaaccccagctatctgtattttaacaagccctcccagtaattctgtgcagctaaaatttggtaactattgttctaaagatttggatggggttgtttaatcttggaggaggactttctttataactgatgttgtttcttgtacatagtcccaggatttgtctttagggtacttgtcatcgatcccatttgagagaaacattgcaatacagagaggaaataataagccaaagtttacccctagagccaggagaagagtagattagatactagcctccatctttgaagttcagcgtttactcagcttgaaaggaaggcatacactattccctcaatttttaataagaagagaattcagtggtttttaattacaaaagtagtatatgctcgtcatcaaaaatttcaaacaatccaacagtgtgtgaaaattaaaaatgaaagtacattttcgtcctcccctcactcccaatgcaacagatcatctgtattgacaatgtattagatgcacacacgtctctatcattcattcatattatctcccactccatcctctctcccaatctctccctgtcttcctttctctttccctcctttcatccatctgtccatccttccatccactcatccatctttcagtacaactatctgatcatactataaatattattttgcaacacttttttatacccaaccacttttacaattccttctaaacaagatagaacacatagatatactgtacatcttttaatttagtctcgaatttcatattatctcccacgatggatcttatcatgtccctgttgatggattgtcttcagtttttccacttaatgctacattgaatatctttgtaaaaatatctcatgcatttgtgctaatatttctgcaaggcagattgccagaagtgaaatttctagattagaaatatgtgtattttaaatttgaataagcactactaaactattctcctcctgaaaaggatgtaagcatatggatttccgtgtaccttctccaacactgggaatggataagtcttttaattttaccagcgtggtagtgtaaatgttagtttagtcaacaataggtctgatttaattaaaaaatctttttgaaatacaaatgctggctctacaccctatctctgcggccatgtgcattccacctgcgagaagctatgtgtcctcgtgtttcgtgtttggtgctcagtagcactgcagatccagcttgttctcttcctgtgtccttcacctactgccattctccctatcttcctgtccaacatcccccaggccaacttctcagtgaactgaaggcaggcatgcacatcttgtcagggcaacgctttccagattactcttccttcctatgttctcatcctcatcctgtaaatggtccatttctctcgttttcttttctggttgttttttttttttttttttttttgacggagtctcactctgtcgcccaggctggagtgcaatggcacgatcttggctcactgcaacctctgcctcccaggttcaagtgatcctcctgcctcagcctcctgagtaggtgggactgcaggagtgtgccaccatacccagctaatctttgtatttttagtagagacgagtttcaccatgttcgtcagtctggtctcgaactcctgacctcaggtgaataacctgccttggcctcccaaagtgctagaattacaggcatgaaccactgtgcttggcctcatgttctttatgtgatttgagttaggagggaaatctaaatagtttaatcacatgaaacatggtaacacctgatattctgacttaccaggtcagctttcttcaagtagatcaccttttaaaagaaggcctaggctaagccaaaggaattaatctctgacagtagaatacccaggcatgtttactagcattgaagaaacttttctctccttctgtataccagcttgtctacagtagacaagtttatttcctccaaaaggacaaaagttgataaatggcctgcaagttggatctatattttatcattgaatatctttgtcaaaatatatcatgcattttatattttactatgagcctttcagatactaatgacttccattttcagagtctttcaactcaagtgatcatcatgggcatccctcatatttttcctcttatttattctcagactttcttatgaagtgagataataagcataaagacaatttctcactgtacagtacaggaagcctttcacagctgacgactcaaatgtctgggtgatttcagagtcttctaaaatgctccagaaggtagggggtgtttgctttttaagcatctcttttctgtgtggtgggatatttcttccacctaaaacagcagacattaggagcaacattttatattccatttctccccttattgccaccatctcttctttatcttgaggaatgaaaactttttttttttttttttttgagacagagtctcactctgtcacccgggctggagtgcaatggtgcagtctcggctcactgcaacctctgcctcctggattcaagcaattctcctgcctcagcctctcaagtagctgggattacaggcatctgccaccatgcccggctaatttttatgtttttagtagagacggggtttcaccatgttgatcaggctggtctcaaactcttgacctcagatgatccacctgcctcagcctcccaaagtgctaggattacaggcatgagccaccacacccggccagaatgaaaactcttaatgttgatttgtctactccaagtccaacaaggtggtgaacacaaaagctatgaagtgcattgtggctgtattattagtagtacagtactcttgttggcaagttcctgatctgcagctacacaatggatgataattatgtacatctaccttttttaatatgtaagaaaaaaaagttgagccacaagattttaagtatggatctttatttctagtgctactattaatgatagttaatattcagagaaaacatactgtcgctgtgcagggagctcagccctttccaagcatgacctcatttaatcttatagccaccccatgcgagtaggcactgttaggatccctgtttatgcatgagaaaaccaggcttagagaaatttaacactttgtctacaatcaaacaactagtgggtatcaaagctaggatttataatgggatatgtaaggcactaaaacctgtgaaggttttccttttttccttttttaattctttccttttttcctctttttatttccttctttctctttatatctctgtatgtttccaaagagataatatatgcatatgataaaaaattcaaatgctagacaaattcaaacatctagacaaaatggtgcagagatttaacatttgttccttttgttgttgttgtaaatgaggcttggttgtctgtagaggcagaggaacacggtaacatcttgacatcagacactggtgtcatagatgccctttcctcagaggactgagatcatggtttttagaatgaaagagttaaagaaaccttgctgtttttttctttgaaccgggtacctacccttaaccctggaatccctcagtggggcctagtgccagttcccctgcctccctacagtgaccaagggcaggcaggggtcaagaaacaactagaatggggctggggtctgcactgcacaactgttctctcacattcatgcttccctcccagtctctgaagattccctcctgccagaacattttgtgtagaattctaaggaaatcagagtctatccctgtactaaccaacatataaaattccaattagaagagaagttgtttggattggtcatgatggatggcctggtgacagctgtcagtcagacgagacctgatgggcaccaggactgaaggcagcagcacaggaggtaggagaggaaggaatcctgagcaaatagccatgctgtttacttgccaatgacatccccactttgcaaagacatgatatggttattgatctctcactgaacctgtaagaatcaaacacaacaactcagttttattcatttcataaatggtttccaagtgcagtcagacatttaatttgtggaacactgagcgaagaggtgatttctgctggtttaggtaagagagaaacggtctagtgtaatactcaagaatgagctagatctcctggatttaaggcttattctacagcttattagctctgctatgttgggccagtgacttgacatctccatgcttcagtctcttcatctgtaaaatggaaatacaaagcgggtgggaggtgttgtgaggattgagtagattaatgcatgtaaagtgcttgcaacgttgcctgacatgtcactgtctgttagctgttagcagtagttgggctttttatagagggctggtgacttgtgcttgtctgaatgcaggaaaccaggcctgtgtagccttcggtctgttctaacactgaagttttgtagttgagtgctgactgtggtgcataaactgagcatttggatacctacatatcacaccacaaggttttggaggggctcactttgctttaatccctgtttcatccagtttctctttttctccacatgccttcacagaggcaaggggagcatgctgagtctagaatttctaatcaaagctaaccacatccctgtcattgttggataatattacaaattagacacgttgttcctgttttgactcagaatcacagcaggaagcagctaaataaaactgaaacaacccacaagtgcctttcacataagtgattagggtaatcgcagttctgtacttgccaaagggattcattccctcttcattttttccatggaaagcttgctttgggccacaaggccttctctttgaatgactgcgccattattggccaagtagtgctgataaatggtacctgtgggttgttgtgggatttaaggagatgatgcttgggagcgcccagcacagtggctggcacacagtaggtgcatcctttcttacttcttcttcccctgattaacgagaacactctacaccaagacacatacctcttctgaacggtataaaccgttgctactgaaagtgtctagaccagcagcagcaggatcacccgggagcttattagaactgcacaaccttgggtcctctggggcctattgcattagcatctgcctgtaacaaggccttcagtgatttgtttgcacactgaagtgtgagaagcactggtgtgaactcaccaggtagggatggaaccagagatggaggtcttattaacttcatgctggtaactccctgagctaatgggcccatgaggaataaatttggtctaaagcctggtcatttggaaatgaactaaatatactttactcagtcagcttgtgtaacagagctctccagtggcatgtgggtctttttcagcagtgacaatagtttattttttaaatatactccacaaatgttgttctggtgtggatcttaatgtggagaaaatcagacaccttttcagtaagcatttcttttgtttctgtgatcatgttcatgttagtttattgtatttgtattagtttatctgtgggactatcccttaatatttcccaaaacaagaagacatttgcgaatgttttcaagatgcattgtacaagatactgttttgaactggatcaatgaaggagatgtttggtggccttggaaagccctggagagtaatagtgtggttctaagaagagttggcctgaatcagttcattcttgggttgtttgctaagattgtctgctgaaggtgggtacgtggaaaacaagatggtaagccaaggaggatgaagggaggcatgctgctggaccacttccagctcccaaatgactggatcttggccatcttgcttttcctgctaacttagaactgaactgcttattctagaaaatgagaggcactggggccatataggaaagggatagcattggacccaagtcctagactttcagtagtttgtttgcaggaccagggtcccaccccttttccaattgaaatgtaggcaaggtggtggcaagcccatggcctaggctgtgggaactcatagaacaactatagtgatgatcgctgccttggattgcagcctactctgaatgtgtgcacctgtgctaactactttcaggtgtgttgtcttgtttcatagactcattacatttttatgatgaagtgaaacccgtgaattggctcctccagacttctcattttaatgacaaaaaagtgggtctccagagaggagctgggattttccaagatctcatagtttgttcctcactttttgtccgtaggagaatcatagaagaaccagataatcttgtctcttatagaaggaatacccttacccttccacattcccgtggtggtggtgtgtttgcttttttatcagtcttaacccatgggaggctgcacaacttacataagaggctacctgttctgtttgccaaacggcagcccagacccatcactgagcatgtccttggcaagaggcacaacctcaggctgacactgtttccatgtccgtgagaaatgatgtgtataaacgatggccagtaagatgctcatctgttgggaagacaacagagggcagggctgagagcatggcttccctgctgattgcctgtgttcagatcccagctcagccgtgtgtaagctcttggttcttggggtaactacttgtttacctctctgaaaaatgggagtagaaataatgaatacttttaataggattattttgaggataaatgtatttatttatgtagagaacttggcacggcacctggcacagagtgagcacttaatgaattttgactgtaaatagttattactgttccactagattcaaatttcttatctttgcctttagctggatgagtgaggagatttgtaccaacgtcatgtattctcctcttccctgcaaattcctccacctgagtcctattgaggtgctccccattataaggagtcctgtgaatcaaagtggtatgtttactgtaaagaatgtggaggatgctgttcactgcattgtattgttatcttcatgaggaagccaggagacatttattttggctctctgttttagaaaggtgttctcctcatgacgacctgtttgcctctgatcttaaggacactttgaagcataccgagcaggggtctgcaaacttctttgataacaggcaagatagtaaatattttcagctttgcagggcagagtctctgtcacagctactcaactcttctgtggtagcagccacagacagtgtgtaagtgattggacgtggctgtgttccagtacaacttcatttacaaaaacagggctcaggccaacccctgatagagatattcatggtttttgtgtttctctctcaaatgctaactaccagaaaagcttagagtcaaatctgaatcatgcttctagcaaatatgtacctacacatttagcatactaatatcactcttgcttaccagtttttaccctgttttctcacatttatattccatttgtcataattatagctcctgtcttgactgtatcttctttcactgtgttttttgttgttgtcgttgttgttgtttttgggaatgggataggactgtaagtaaataaatcaattatatcttgctagcttagaaaccaggacttgagtaaccacttctgactcaaagttcaatctatgtggttaaatagggaagcagaccataagatgtatgcccagtggtgcacgttgctgactcgcaagctatgtgcaggctttagcatttagtgtggtgatgtgtgccctctaacctgagatgttgagagaggggcagagaagaagacttcttgtagccacaaagtttcattccttcctctctcattgttgtagcatttcttttaagtgaaaacagcctttttggtttgctagcctatctctggcaggaagacaaattatttttttacagtatcagacacgcggtttcctgtctatgtttaacttgctagcagaacatctcagccagctggttccctctggacccattgtgtccttaatgtcgttgctttacaccatccagcaaacccactctgtgtactgatcgcatgcattgagcattttgttgacttccgttgttttccgagtaagggaagtcttagaaatgctgccctctttctcccaaatctcattttatgtttgttcagctccaacaccagggagctggcttcttggggaaatgattagttcttgcatgtaagaaatgaaaagagtaaatggtgttttggtagctctgggggattttaggtatgctgccttggaactgtgcactcacgcctcaaaatagctggctttccagctgtgcatttttgtttcaaaagaaacaaaccagatttactttctggtctaaatgcagaagaaaaaataagtgtggaaatatggttgagaaaagttgttagaagaggaagaaaattatggattaaagttgctagtctcattcctgagaagagaaatcagttatttgaggtgatgactcagagctgaagcagctttttgttgtgaaccagccttggttagaaagcacacttggaattcatcaatatggccctatgtctggccaaggaaataataaagattttgcatgatagaggacactgtgactcagttgaaggaagcttagaatgtatttgaactgaattaaggcaaaagcaactcgcttttcaagatttttttttttcctaagtagcaaagtaaacaaagctgcactgaggccagatgtgctttctggttgtgaatatttgtactctagaacctcattctggtatgaatcagcagagtggaatctagtatggacacaggctgtctcaaattccatccactggatatgagtggccaagaaagcagtcggacccatactgctggtgctgtagcaaggttcgggtggttcctctgcagcctcaggtctctcccactgcggcctccatgtgttccataaactccacacccatgagtaatggcaagaagggtccactgagaccttttgctgctttgcgagtgtctcagtgtcccaccaggggaaaaaaaaggctcagggaggtggctaaccactgtgaaattgacttttatttccacccacgtatactccagaggctgtattcaccaccatttggacatctggatgacttgcctttggaaagtccttttgtattctaaatcgctcctgcatgttacctgttgtggaaaatatcaattttgccattacaaattatgcttttttttaaaaacatgttaacttttagagaaataatttatatttgcttatctacttttaaaaatatacatatatatgccttttgttgcctaattagaggatatagttggttccaatgtcaagaacaatttctctgaaatgtagtcattaaaattattcccatgtctttcattttccaggccccatcctattcgaaatacctgtttcttccaccaggctgatgtagttatgcttaggcttggctgcacattggaaacacctgagtagctttaaaaactactcattaactgggtcttactcctgcagtttctgacttaattggtctggggcctggtatcaggaattattttttaattcttcaagatattttaatatgcagcccacattgggaaccactggactcaagacagtttgttctgccaaatctttttatatttttcgtcacgttccccctgtagcctggaaagggacggtaacaattaaagaatggcagctaccacaggaaggagccaaaattatgccttcgaaggttagaggaggagaaaaaccaacacctgttttaccccatccttggaggaatagcaagacactttaagaggggatattattttgttttctacaacaatttacaagcaattgctttggaacaaggtcaacggcctcattgggaataggcatcttagcttttaaaactgattaaattatacgttaaaggaaagcacattttaaaccttaatgtgtccaaaaggttggatggcaaggtttgggtgctactgccttggcagagacaaggcagggaccagggaggctgtgtgcatgattttaggaggtgagaaactcaggtgggaaggaattgcagaagcctgtggttcacctggaaagccagggagagagagaggatgtattctggtgacctaacaggtattgtgaataatgaatatgcttttccaaagcgatctggtctccctgttggagagcatcctgaaataacttaagaaatgtaccttgctttcaggtttcctgagaacatgagggcccctagacagagtacaaggtgtaattcagacagccagccagaaaaagaattaaagaatcagggcaggtgtggggatcctaacaaaacctaagcttttagtagtcagaaaactgcaataacacagaaaagaaaatgaaaaaaaatcttgttccaaagaacatatatcaggtgtgaaactctctttgtgggaggacagatgtgtcatcatttcctggacaaagcctggtaccttgtaggcaccctcctaatgttggttgccctccttttaaagtcagagcaagagaagtagcaggaatctatatcctaaggaggaacataaagggtgaaaagcacagtggaagggatgcctaaaagagcaaaggctgaatcagggttttaatggcctgaaatgaccaattttctaaaacttgacaggtagatgtaaaatcagacatataggttcaaacaatcgattgcaaaggagcacttgtcaaaacactggctgggaatctgctcatgtgatgaagaccccagggtttagaggtgagttaaggtcattttgaaatcaggatgatctggctgaaagaatcaaaacaaaacagaaagaacaaaccatcaggagccttaaactccacttggtggaagaggaggtgagagtcctgctgtaatctttgctacacaagttatattccaagtattatatctgtgtctatcaaaacacatgatgaagaatcttaaatagcaagcgtggtttcagagaacagatcactttacccttagaaaaaaggtcctggcatttattgggcgctatatgctgggcaggctgattttagggtctgataaatctgtcagactttagagtctcatcaatgtatctcttgaaaagtaaccgaggaaaacatggctgttcaacctgaaaatgaaatgatctaggggttgtgagtttcatatccagcaggagtttaatagttctcatcccatagaaaacggattcattttgttactttttgctttagagaacagcagaaggaccaataatagaagcacacagaggctacatttgacttaatgtaaagaataattttaaacatatcccaatatttagactttatcccaatatatctgcagttagaaatattgtgatttgattatggaatgataacaaaggaatgatgtccttctaccataacattttcaggcagaggtttcacctctacctctcatgggtattctagaaagagattatcatactggattagaatacatgcaaggcttttccatctgggagagagataagaaggaaataatacaaaggagactgtgccatgggataggagaggtggcgaatagctttgttctgaaatatgtgcagttggaataaaacaaccacattgattggagagaagacttctttcatcatttgaggaaaaaatactctcaaaatatatccagaatgtcaaacagtgctatcaatagctagaagttaaattaaatccttcattgctagtgagcttactgtccttttgttgtttaattgaaatgactttttattgtttgcctaaattggtgtgctttttactaggatgatggatggggaagcatatctcattctacactcctccaccagttaattgactagaaaattatcatgggccattttctcattggctagtgctgaatacagctgtaccagagctttgcaaacaattccactaagaaattttttgtaggaggaaagcatctctatggcagagtaccaaagaacttaactttatttttgctaaactgtttagcaagaataaaatttacctctgaaacttgaatgtgtaaatgaatcactgagagaacttttaaatgtagattctgattcagttagttgaggacagcgctaagactctgcatttccagtaagttcccaggggatgctgatgactgctggtctgcgggcacacttagaataacgaggtgacaagttattctttatgtaacatgccaacaaaatttttaaaggtacagaaaatgatggcaagatctttgaactctgcaatatgaagcatatatgtgagtgcttagctttcactctctttctgtgtgtgtgtgtgtgtatacagatactaagacacagatacattcacatatatacatctaaatatatatacagtacagtccatattcagatttcttcaaggttaatgggtctattgtttaaattcggaatccagtcaaggacaacacattaaaattgattgttttgcctctacagtgtgtttttttggttttcatgacattgactttgatttgaataggtcagaccatttcatgtactttataaaggcactttgtagatttgtctgatgatttgattaattcagattaaacattttttaaagattctggtgtttttattgtaggaagtttttttaaaacagtaattctgcaaaaaagcaaggtttgccatttgtattcagtcatattagtagcaagacgactacagatgcatacttggatgataaaacaagtttaaaagctcaagaaaatgataactataaaagccaggaatagtgattactttttagaggaagggagggatctccgattgagttggggaacatgaacagacttctggggtggccagcaaaattatattttctgacctgaccagtggttacaagagtgttgatcttatagtaattcactaagccagacacttgttttatgcacttttctgtatctgtgttttattttggaatgaattctttttcacaagagagaaatcagagtaatttctctagttttgagggccatactgtgctcttgggccaagtatattattttaaatacccttaggagaaaggaaagaggaagagagggctaacttttttgggggggggagttgggggggcagggggagatgttctcgttctgttgcccaggctaaaatgcagtggcaccattatagctcactgcagtcttgaacttctgggctcgtgatcctcctgcctcagccttttaagtagctcagattacatgcccacaccaccacatccagctaatttttttttttttttatacagacagggtctcaatatattgcccaggctggtgtcaaactcctgggctcaagtgatcctcccacctcagcctcacgaagtgctgggattacaggtgtgaggcaccatatcttccccccatttttttttaatcatctgagtggcttcaaagcttttgttctttccataccaccaagctatctccttaacaatgaactgtgagatccatttaataattctgaaaatttccagtcacttctgtcactcatagaggccagacttagttgcaaataaggagccatttgcaaatgtcagagtcttgttacataaatatttttttaaagacaaatgtcaaattctttttttttctgtcttccaaagataaatgttagtatgccataaaaaaaaatacaaactggcagaaaacctcaaggggaaatcctgtggtatactttcctttggagtgattgaaaagtaaacaatttgtcttataacttgagtatgcatgtgcgcacacacatgcacacgcgcgtgcgcgcacacacacgttgctctcagcctcttttatgtcctttgttatgccgacaccagttcctaaaaggaacttaaaactgaacctccctaatccactattttaaataaaagtcacttggttaaaaaaataaaagcattaaattaaggccaacttggtaaataaaatcctatgtggatcagttaatgtgtcttgataaaaagcaaatcaacatagctgaatttgggagataggctcctactttaatatttgaagtagtttggcaattcctccactcggtaaaggagtttagggtgaacatttagtgggatactaatttatccgagcaatagaaagggacgtggatgacagtttttcgcacaccttggtgtattagtgcactaatgagcctcagatgccaagagagattcttgtgaagttggcagtgaagctctagccgcaaggatgttcacatgccagcatgttcacctaaagcgagagtatatatgcaactggctgagatccaaagaaggaaactgtgctaaagagagatagctgaggggaaggaagaacttcctgtctcaagtcatgttaattataacattaaaaggacagcattcatttattgagtacttactaggaacaacttttacttaacaagaatacttatttactaagtagacaaaaatgttgtagaagcaaccaaggttcagtatcctcctctgtaaaacgggggtaagagaatctaactcatacatagggttattggagaaataaagtagatcatgtttacaaaataaattgtccggtgcctaacccaacaaagcacatcgtatatgagttatctttcttattgttacaagatttcaaaggagggcttctcctcaaattctacactgcggagctcccttcccactccacagaagctccgacagcatccacagttgtccatgtgcagcacaacaaatcaagccaggcagatctcccattggcactagttaccaacttcctagagaaacccatcaatctcaaaattcctgctctagcaagtcctggaaaagagactagagcccaaatgccttcactctgccaagggagcttccctttttgtgtgtctgtgccatggacttcttgaagtagggaagcctgtggaccccttctcactgtgatgttttttaaatgcataaaatagaacatggagtatttcaaagaaaaccaattacattgaaatacaatgaccaaatattttaaaaatgaatttgtgttatagtaatatatgtttctataataatgctttaaataacaatagcagcagatctaaacaattgaaatgtctaaatggtgagcgtaagtcacatgctgagacgtctgcaacaacaaactcataggtacagctgatactaggaaatattaatttttaattaaaggttagagaaaataaaaaaagatgcaatttttgcccattcaaattcacagacccactgaactctatttatggaacccaggctaaaaatgtttactattatagcctcatttttttatgggccttggataaattccacccttatttttaatgcccttcagagctatatctggttcaatgttattactattcatggaaggtcccaatagtgcaacaattatgttttgagctctgctaagatctaggccatgagaataggctctgagaaaagaaaaagatttgggggttctccttcacataaaactttttatttcctggcaggaaaaagatgcatatttacagagacactactaaactgtggttcttagttcagaacaaaggaatataatccccatacccaaaatatactcctttagacacattatacaagaattgccaatgtcagtcggtggatggctgtaaaatcacttagtccaggctacactaaagaaaaacactttatcaaattgggagcttatataaagtcattcttcccctcccccgcaacccctacccccccatccccgcccgcacaaacacagggtcttgctctgttacccaggctggaatgcagtggcaggatcatagtgtgctgccgccttgaactcctgcctcaagtaaagtaatcctcctgcctcagccaccgtaatagctgggactacaggaagcaccacagtgtctggctaattttttttttttttaagtttgtgtagagacagtctcactatgttgcccaggctagtctcaaactcctaggctcaagtgattctcccgccaaagtgctaggatttcaggtgtgagccaccacacccagcctaaggtcattgccattcttagttggctctcaccaatatgaagtttagagatcaggtatggggttgagatcagaagtctctccaatcaggcaatgctcattgtaaataccagctttgctgttgcctaaatttatcatctgggaaaattacttaaactgtctgatctttagcttccctatctgtaaaatggggtttataataatagcagtttctacctcatagggtttttctatcaattaaatttaaatattctataaaatccttagcacacagccaggaacttagtaagtgttcagtttatgagtttctctgtaactggcggctgatgaaaagaagcatttcctgttggtcttcgactaaaggagatgctggcttgtacctacaccaacagctgttgggttttctagtagcaacccaagggttaatactgccagagggtgtgggtggctcctgtttagataaagccacatcccaaagcttccttccagccctggttgctattgttagagtttttcaccacctctttgaagtttcaagattgacagatgttattcaagaattcctccccctcaaattttttaagtgtaagtcttctaaagaaataacaggaaattttaggagaaagtaaaactttggtttctgacattgaactggggatttctagaatcttcttcagtcagtgccacacataaacttaaggggatttctgtttttgtgtttcctttaggctaaaaaggaattgaaattagcaaatacgactgtttttatagatatttaggaattgtaaaataaaattatccatgatgaatcaacatttcatctggacgttttagtgaattaaggacaaagctaagtaattatgcagttaatatttaaattttttcaaattgtatttctcatatgtgaaaaaaaattgactacatattcacatttggccaaagtgaagtctctccagattctgccaatgaggttattaaaataacacctctagaacaggggtcagcaaagtttttctgtgaagggccagatagtaaatattttaggctttctgggccagataagatctctgttgcatgaacctcttagttttattgttttttaaacaactctttaaaaatggggatggaaatcattcttaggtcataggactatacaaaagcaggccatggacttctgagccatagtttgtcaaaccttgctgtaaaatataaaaaatttgagaagtatcattccacgtaagtaatcattcagcttctaaaacaaacgtttgttgaataccataaattgccccattctgccccaggtgctgtgtatatcatgatgatcaaaacagacctggccactaccctgctttgtcaggagagaagcaatcagataatcaagtggatttctgattataagacattccatgtagttacagacacagagaccggagacaagtgggtacttcaagcaaacacattcattggataccacatataatagaggtggagtttcaggcagggagcattgtggaagtggtaagcctaagtggaaatgccgactgctggatcggctgttgtgtttgaatttgtgttgtgttcatctgcccccttaattttgtttgctgtacaacagggacagtccatacatctccacaagagcatcttttttttcttttgcattcaatcattctgtaattgctttgtcccaccccatttctgccctactcttgcctgttctttgtcccaatccaagcctcccagtgtaagaatttatgtttttaaggatcaatcaccaaattttctcactttccctatacttttaaaatgcattcatatatctttccaaaaaatggtgattttttttttccctcttggttgctggaattctgatatcttggggttacttctctggttactagacccaagattttcatctagaatatatagtcagtggaagttggcatttccactcagacttaccttaagaacaagtaatcatattacacataaaccttaaaaatggatatgtaccagcttcatttctcactgtttcgttagatgaaagtttcagatgctgggccaagcgcagtggctcacgcctgtaatcccagcacttttggaggccaaggcgggcagatcacaaggtcaggagttcaagaccagcctggccaacatggtgaaaccccgtctccactaaaaatacaaaaaaaaaaaaaaaaaaaaaaaaaaaaaaagctgggcatagaggctaaggcaggagaatggcttgaacccaggaggcaaggttgcagtgagcagagatcgtgccattgcactgctgcctgggtaacagagcaagactccatctcgagaaaaaaaaaagaaagtatcagatgctgaagtagctatgtagactggggtatataacctggggttcatcatcatgagccaggaaaatttaggatatgaacacacatgaggagtttaggagtggaggtttaataggcagaagagaagagaaagagaaacaattctctctgtagagaaaggagtctccaagcggaaaggacgggccagtggtgaatgtgctggattttatagtcccgtttgaagaggcggtgtctgatttacatagggctcacagattggttcaatcaggtatgacgtttacatagtgcatggggaagactggtcaccccaccctaatcttattatgcaaatgggctttccagttgatcagcaccatctggtctgttctttgttgtacacatggctgacaaagagaagggaagatggagctgccatcttgaacatgtccttagttcctgctggcattcacccgtgcaagctcccagcttgcctgtctatgtctgaagctcaactttacaggctgctctttgttagaaaatgatttggggctgcttttcattaaaaagaaacaccttaccgaggacttccatacccttactatctgcccaagtaatttcttcttaactcctttatcagtatcatttaggtaatgggttccccttgagagaatttggttatatcctcattctacctggactatattctcatcacttttttttttctctttaaacacctactgtaggtgaaaactgacaaatgaataatcaaaagatccttttctgacacggagtttggttccataccacctacccatttttttcctttctattccgcaggtgcagagtggtcagtatgggataattgctcttccttaagtagatcatatattctttctccttaacatagcactctttccactcatcactgacttttcccattcttcagagaccaacttaaaggcagttttttgctactgtgccttccatgtttctctaagcttttccacattccactaatatatagattacattgtacatttagcccctatcccagatgccatatattgcttacttgtatatatgccctaagtcctctactgggtactctctgagggcagtgccatgcccatcatagacactcagtagtgatatatttaatgaatgattctaggatctgagcatgaggcctgctcattaatgggtactttggagggcagatggatgacacataaagcaatagaattctgcatgtttgcccaatgaaagcagcccagcacaagctcccagtgaactagagctgccttttgctctctcctgtccactgtctgtttctattcatgtccttcttccaaaaaggaaaactatttcaccagagccaacaaggccagcacatgaaacaaagtttgaggcacaagatattatagttagatatctggtgctaaggactctccttgtcagcccacaggggcctgcttcagaattccaagtcaaaaaactgcagcatttccatttttaacttgttttacctttgcggccatgtttccattgttgctattaaatatttcagttccatgaaactacaattcgtatgcacactgaaaagaggaatgttgggtggatgtaagataactgtccaaagagatcctttccatggactcctctccctgtcacccatgggcccagggtagcctgaatgctgatcagagcagaacaagttggagtttgaaaaagagcaaagattttggtgcaaactgtggcacgctctgtgtttttaccagatgtcatacatgcagattttttgaaggcagaagctgtgtcattttttttcatgttcccaatgtcctgagcttagataacactcagtaaatggtttgtctttttatttggcaatattgaggacctgctgtgtgctaagtgcagtttacagtagtgaagaagacatggtaccttccagcatggagttccctgtccgtgggggatggcaagagtagggaaagacagatgtgaaatcaagaggtagagtcatagttcatttagtttaagttgtactgaattgttacctaggaaaagtataaggtgctatgaaaatgtataaaataagacagttttccaagtttttctaggcctctcttaagcagtgacatttaagctgaagtttgaaggaagagcaggggatgacgaacagatggccagaggcagggaaggctgaacgagcatgcacttgcatccctgaaataaaaattaacaatatcgtatctacaaaaactatgcagatgctaaaatctatagatgctcaggcatgaacccacttcctgacagtacttacctaccacatccaactccttctctccttgttttgtttccccatcagaatataacaccagcaatcctgacttgttgctagtcatatttcaagtgacaggcatcagcctcctgccaccactgggagttgccatatctgtcatcatcatcttctactgctaccgcgttaaccggcagcagaagctgagttcaacctgggaaaccggcaagacgcggaagctcatggagttcagcgagcactgtgccatcatcctggaagatgaccgctctgacatcagctccacgtgtgccaacaacatcaaccacaacacagagctgctgcccattgagctggacaccctggtggggaaaggtcgctttgctgaggtctataaggccaagctgaagcagaacacttcagagcagtttgagacagtggcagtcaagatctttccctatgaggagtatgcctcttggaagacagagaaggacatcttctcagacatcaatctgaagcatgagaacatactccagttcctgacggctgaggagcggaagacggagttggggaaacaatactggctgatcaccgccttccacgccaagggcaacctacaggagtacctgacgcggcatgtcatcagctgggaggacctgcgcaagctgggcagctccctcgcccgggggattgctcacctccacagtgatcacactccatgtgggaggcccaagatgcccatcgtgcacagggacctcaagagctccaatatcctcgtgaagaacgacctaacctgctgcctgtgtgactttgggctttccctgcgtctggaccctactctgtctgtggatgacctggctaacagtgggcaggtaagttagagctagtgctagatcccctttaccttgagcctggcctcaccctacctcttgatccatatctcctggctcttatctcaaacagccctgtactctggacactggtctagggaatctagccaaagtatggagtctgccttgagcatactctgctctgtcctgcctgagcatttttgctaatggacagcatttctcctcctatcttcaaatccttcccagttcagcacattttttcctcctggatcaatcctcatttctcttccagcaaatgttttttctttgtttcaagcactgttagtactttacctctattttttccctctcttatggttgtactcagtcctttctgctctatactagctgtagttgtgttggtttctttgtattaaaagcatcgtggaaggcaatctccctgaagtccaaatctacatccacatggtcacccaagatatgtagcacaatgccttgaacattgaaagtaaaataagtacttgtcgactgagtgagcacttccactcttgaagcactctcacagattaaaatggaaatgtttttggctaagaaactattggaaggtgattggaaatcaccacaacatcccttataaatgatgagcccagtgttttcacacagtggagtccatggagagcagcactgtcttctttagccaggtggcaggacacactttgaagcactcggttactgctcagtcagccctgtgtccatggcagcgcacgcagtgttgaggtaaacatcgaaatatggacagactaatgtgccagagtaatgagccatgcaatgacctcttgagaagaaaaaaactctctaatacatgccaataagaaacattccttggaatgataatatcaactcacttggcttccctagatccttgggaaggtaggactttattgttatttagtcagtttatacatactacaacactaaatatttaagtgagccattctctggaatatttttttcctttttcatatggatccgacgtttgcatattatcagtcatagagattagcacaggcctaaaagtcaaaataaaactacatggcccacaagttaaaattataaagtgatccagatttggtcttttactgtgaaaatgcttttatacaatttaatttagtagagatgttatgcaattgtactatatcctttgcacactggaatgtgccatgggataaacaaagattaagactcagtcctaaagtgatcaaaactgatagcaattattatttttaccataagtcttggagtttcaggaataaaaaaaaattcaattttggaaagcaaaaataaacatttaaaatatcacaaatattgtctctcaggttatctgtaaggatgttattgaaaaatgtgatgacataagtcatggggttagataaggcagctctggggtttggcacttccttattttggcatgctttgtttatggtctttagagggttttcagggagagaacatctattttaaaaaataaccatctatctgtacctttctgtgcatttctcattctttaaaacagcactttgattttttaaaaaaatcctctgcacgtgtcaggggccaccatcagctatattgtgaaaataaaaaggcagctggaattaaatgatgggcctcactgtctgtttttgctataggtgggaactgcaagatacatggctccagaagtcctagaatccaggatgaatttggagaatgttgagtccttcaagcagaccgatgtctactccatggctctggtgctctgggaaatgacatctcgctgtaatgcagtgggaggtaggtgtggaccagcatcattgtgtagtggtaaacttgtcttcaaaataagatcatgtgttgcttcgagcattattccaggggttacaaagcagttattagagctagttgagatctgatattatacaaccatcccagaactatttggggttatgctaaacagcctaggtttttaaactgaaagccacatttggagcataaagctttgtatctccttttataaacctttgtataattactcttctcttgacacatctcttcacagttatttaaatatctggcaagagacgaatactaataaatgtataagaattatctctaatgatcatgtgggtaatattcagataagcatctgatttcttttactttgtgttttaagatttttcagaattatgtctgggaaaaagatttgattcaaaatttacttttatggacatgacattgttttattgggcaaaaaaaaaatcattgtttgagatatttgtttaggttttgaaaattctagtgaagaggttattgaggaaggccgtcttcttactgcttaagcctgcaagactgattaggagacctacttttctcctgaaaagctggcttgctctttttatccccaagttcagccacctactgttttttttttcttttaggatcatttttccctgaacacactgtcatagcctcccaggtgccctctgctatgtcttctctgcagttgtatgctgagtccttttcactgttagaggctgttactactattgaccatgagactgtagatagaatgggcaacaaacatctggggtgccagggtgaggctattgttctaggaagtattatcccttgttgtccagaaggcaagaacagttgaggtctacattactataccctttcctgactctcttctcagtaccttggaggacagatgcatgacacataaagcaatagaattctggcatgcttgtccaatgaaagcagcccaacgcaagctctcattgaactagaactgcctttcgctgtctcctgtccactatgtgtttctattcatgtccttcttatttcttaggtgagacagggtcttaggtctcacctgagaaatctgtgcacccaagttcatcctggttggctgccaaatgaagccaaactaactccaccctttttttttttttgagacagtctcgctctgtcacccaggctggagtgcaatggcgcaatctcggctgactgcaacctctgcctcccgggttcaagcaattctcctagctcagcctcttgagtagctgagattacagacatgcaccaccacgctcagctaatatttgtatttttagtagagacagggttacaccgtgttgatcaggctgatatcgaactcttgacctcatgatctgcccacctcggcctcccaaagtgctgggattacaggcgtgagccactgcacccagcctccattccatgtttaactttttgttttgtgataattttagacttagaaaatagttgtaaaaatagtggagtttctgtatactcttaactcaactttgcctgttgttaatatctaacctaaaccatagtatggctatcaaaaacagcaaattaacctggattcagtgttcttaattaatccatatacgtatttgtacttccaagtccccagtaatgttcttttctgaaacaggatccagtctaggatcccgcattgatctaatgtgcatgcctccttagtctccttgaccttgtgagagttcctcagtcgatttttgtcttttatgaccttgacacttgtaaaaagtttaagacagttatttagacggtctctcactttgggtttcactaatgttttctcatgattagattgagattacatattttgggcaaaattaccacagaaatgatagtgtgcctatcttcagtgcgtcatatcagggggaataagatgtccatgtgtctggttattaatgttaaatttggtcctttggttaaagtgggacctgctgctatttgtccatttgtaagtaatacatgcctttgacctgtttctaaagatactaaatacctgtttagcaaaggtactagaactttcttattcatcatttacccactaatttgatgatctatgactaattcctgcctataacaattattactataatgtttacttaaggaagattttctgtttttcttgttccttctatatttattaatatgcattctcctttaaaaaagatctgtctcttctgacaccatcccctgttctttgtttactaattatgtatttatatcagcaggggatttggggtatttgtttcattatatgagtatccagtattgtcattatttattttgttgctcaggttgccacagcttgggtcactggtccaaactacccaacattttgcccaaggcagattcagttggcaccactgctggctctgattcttcatcctgttcagaatatgcatagccaattctccagcgtgggtccgggtcaccccctcccatcctgcaccctgctgaacctcacatgttttcctgagacccccgcatggggatggcacttcctatctagctgacatagttattattatctagtttcttgactgagatttcttcccccaaaacacttccaaaagttaactttgtttttccttgcacagtgaaatttgtttaaccaagtttcagccactgagaataattttatgcttgaaagctttgacagttccaaaatgaatctttagccgggtatgagttgtatcagagacaatgctgttgtcactgtcagaataaatttacctagatttcagtatcattccctatcctttcaactctgttattctataaacatgagctggagattgtgtctctgtctttccctctgtcagtgcagccagcttattaaggccctaggtgagctcccagctttcattgttatcactgactaaaacccttgcctgttgatatttgctgagtgtggaagaatttaagctaatgaggaaggagttcaccaaattttacaaggtctaaaaacagttagaatataaacaagttttcccaaggaaggaacaggatatggtttattcagctagtctcaaaaaaccttttataaccttaggataagaagagacagccctggggaaccggaaagaggccatcccagttctcatttcgtttgatcttaagcccacagtcctatttctcccatctttgctcgggctgcagacaccaaggttatttatccatcctcacgttcgtcctgacacaaagccgttcacttgattaagcgtgtgaactcacgtagtaagctccttctcccaccttgacttcttcttttaaaagcattagtggtttttgtttgtttctttttggcatgtctcaaaaaccttaaagacagattttcagcctagtcttagtttcagaggcttttcttttacattcaaaaggtcctttggaaagtacacgaagcctgaagacagatggattccctccaactgcattcatcttgatgttgtccctgctgtagcttttgtagaaacacagatggaaggacaggttttgacctcaagaagcttgtagtctacaggaaacagttgtttgtttcctctcccttctttttaaaaaacttacacatgcagatatgtttcttatcttacaaattaaataatgaatccccctgtttgatgttagactttaattttaaggtataaggaagagggaaggatgtaaaaggtctttccttaagcttgaacttctgcagtttgcagtatagcagatgtaattaccatttttttaaaatcagcagtcttatttcaaaaaaggaaatgtggaatgtgcttacctttgtatgatgaatcatagatggacagtaaagggaaccagatctccagagtcatcttctctgtaggctctgagtctgtgtgcttgtgggatcatggatcagggccacttctgtgacatgaaaggcttatgatctgacccatcgagccagctaccaagcacctgcagagaagcctgctcaagaggtatggtcctgccgggcgcggtggctcacgcctgtaatcccaacactttgggaagccgaggcgggtggatcatgaggtcaggagatcgagaccatcctggctaacatggtgaaaccccgtctctactaaaaatacaaaaaaattagccgggcgtggcagcaggcgcctgtagtcccagctactcaggaggctgaggccagagaatggtgtgaacccgggaggcagagcttgcagtgagccaagatcatgccactgttctccagcctgggcgacagagcaagactgcgtctaaaaaaaaaaaaaaaaaaaaaagaggtatggtccacctcaactgtgtgcagaaggatgatgggatgcaagtctccagtgaaaacagctaatctacatgacaagtatagtggatctacccactgaaggagagtaagtgtggctgcttggatttctcgggatgactgccattggtaatatggatatagcaccccatcctgtactgagagagtccctagttgtattgatacttttttaagctatggaacattaacctctctgttcccagttgttaatgagctattgcagaggtgactatttgttttactttcttggatgttaacattacagtactcactacttgaagaaaaatgttctaagcagcagaaggtctaactgaatgaagtaggatacaaggattagggacagaagatttcacagaaaactgtgaagtcccacctagcctgcctttaagtgactcataaacatggatattaaggctccaagctcacctccacgccacattctcattctgtgttcatcacttcatcatgatggatgtcttttaggtcttacctccaggctttgtctcatgctatttactggcactggaacacttaactagtctgtttttaacaggcaagtgtggttcagttgtgataaatgcttaggaagggaaggcagtgagctcaaaggactgaatgcccaggttggctacagggagtgcagtgttatggtcagggaatgagacttaggtcagctcttaaaggaagaggaagactctggggcatccttctgagttacttctttactagccagtctcccctgaatgcaggggagcacagggaaaacagagaaagaacagcactacactggagaagcctcacttttatcaggtgagaaaacataaacagatgataatagagctcttcaaaagccaggtggtacagcttcatttcgcacaaaattccaccaggggcctcgggagatgtgttgcagttaggtgaagagagtggtcagagagaaaggcttcttattgaaagtacatttggtccagataaagaaagccataaaggaataattaccacttcttaagcacttgctccacacatcaactcatttaatctaccaaaactctttgaggcctgtactgttattaatcccattttacaataagagaactgaaggctcaggaagtgcgaaagttgtggagccaggaatcaaagccctgttgtctgactctgtagctcacaggccttagtattcctggtatactgctagcctggccaatggagaacgtatttaaaatagtagctatggccatgtacaggtacaggctcacgcctgtaatcccagcactttgggatgctgaggaaggcagatcatgaggtcaggagtttaagaccagcctggccaagatggtgaaatgccatctctactaaaaattaaaatattagccaggcatggtggcgggtgcctgtaatcgcagctactcaagaggctgaggcagagaattgcttgaacccgggaggcggaggttgcagtgagctgagatcgtgccactgcactctagcctgggcgacagagcgagactccatcccccccgccccccaaaaaaaatagtagctatgattcctatgatcagtatggatacgatagtcagagctactctgtgcatcctggcagtagatatgaagccttccagcagaagctgaggagacaatcacatgtttgaggaacattcagtgatggcctcacttctctgggtgaatccctgttaacagaatccaaggctgttaatttgtgtagcaggtcacagtattgataccttaaaatttgagataactgttttatctttatttccctaaagatatatttattcattcattcactcaaaaagtatttattgagtacctattgtgtcgcaggcattgtttaaaatgccagggatacagcagtttaaaaagcagtgtctttctttgagagacaggaagtctagtgaagagccagtattttagggacaggtaatgaacaaagagattatgtaatataatgttggagttgggtggggtgggtgggatgattttagaaagaaaaatagacttgggggatagataatgaaagaggctgtcatttcagacattttaatcctctgaaagaatacaaaagaaaaaaaaaagaaaacaaatctttcagaattgtttgaagtaagaacaagacaagaggaggtgattggtgtgttactgttctacgaaaaaggagaaaaagcttcatgaaatcgccattcagcaaggacagaactggagatggcttctcttttacaaagaaatctctgtcccaggctttcagtctgtttggtgttcatacaagtgtttgtgtgttgtgtggaaggcgggtgaaggcgggtgaaggcggtcctgttcagggccccctttggtgaacacagcaggcaaaatactctcgtcatccccagccaaactggcctgcaagcacactgacttccacatccctagcatttaggcctttgaatagaagctgacacgtagcagccagctgaacaagtatttaatgaggagcaacacaactccaagaagggctccttagtgtattgtcaagttgctgcagccttgtgagatgaaaaaaaaaaaaaaaaaaaaagtgcaaatgaaccaaaaagaaagggaaggggctgggggaagaaagagacagaaaaaaaggaggcgttggagagacggctgaggagagaccaggattgaaacgcttcattttcctggatttcaagggagcacagtctggaaagcagatatgaaaactcgggggtactgctttggggaaaaccatcaacaactttgctgccctgttacattgggactacagtcaaaacagcagctgtgcaccagatgctgactttccgaggaataccattgctgtcccagagacctgccctctgagggttgtggaactgggaagagacaggcaagcgtagttttctcttaagagccttttgagacaaattaaaagaagctgcgagggccgggcggttgcgggtggcttccatcagtgaaaagactgcagagagaggtggcgggagggagatggaagtaagagaaagtcgttctcaagcagtgaaataaagaggttttttagaaaagatgccgtttgaggcactcagggaaattctgaggtgttcagccccgtctgtctggcttcagaaacagtctgagggtgagacaaagacttggtttgatgaactaattctgctgtgtaggcatatgtcttgggtggagtgcctccaaccctggaacaagaatttgagtactagtagtttatttgggaagagattgcaggaaatgccagtaagagaatgaggaaatgagtcaggaaagggaaggaaaccagtaaaggatatcttatcaagtgggttaccaccatgggcaactggagtataactacgagcagaacacacacctcagtgtcataccacctgactcaaaggaagctgggtgttttatctttccaattcccatcagtttgctggagggctgctccaggccgagctgggagggttcactccagcccttctgcctgttcctcctggagttgggccagcctaaccggaagagccagtgcaatggggttgggaggtggcggtgcagctggccctgcagcatcacactgaataattgtagggggcatatgtgactattcttattttgtggatataggaagtgaggcacaaactcttggcatctcttttctaagtcctcatatctactttttaaaggagtcagggcaaaaacaacaaataatacttacaatgcatattgttagctcttccacttttgaagtgctaaactcagtcatactctctaagccttcgctttttctcttagaggcaattccaattttttttaaaaaggtggttcttgttataggttagccaggtgtaacattttctctggactcagcccacacactcctgaacttgctttttatgcagttcttcacaagagagaggcccaaggtcaagcatcatttgatcaaatgtgcaaagaggaactgcattaattctattgccaactatgccccaatctgatgcctgtagctaaaatgagattctcatccttacctcacctccaccaccagtcacatctacttccctaaacccagaaaggacaagtgtttgggtttaatgtgggtaaataataccagctaaggagagggctgctctttgtaattgtttttttgcatagctggcttagaaattacaaataacaaccacccagcagatcccataaggttccccttctcaaggttgtatgctgaggagggccccatcaaggcagggagggacacacttgtcacatttgggaagggcatgttcataccagggactgccccagctgtacttgctctggttaggggagaaatctctgcaatgcttggcagagatgagcaagcatgaaagcttcctaaaaaggcaaaggcaaatttcttcagagtaacagtaataaagtgcacaattctaaatgctcttcctggaatccagtgtactatttgggcctcagttttctcaactgtaaaatgaggatgttggatcccgtctctgaagaccttttcaatattctttgtctgactcatttgaaacccttaaaatatgtttaataacttgtgctcttttttcctgtgtcaaaatgcatctcacattccttaagaagcatttagggcaatgttgctccaagtgtggtctttggcaggtgctggtcctcaaactctctgttacagatttgcaatataaggacagaaaccaagatgtgttttgtgcctttaatagcagtttgatgttgccacaacactcaagtgggattcatttttcttgtaattcatttctactgtattttaccaaagcctttattcccaatgaattgagggcaaaacatctgggcttttataaaaaattgattgagaagtgctcatttgcaagtaataagggaaaaattttaatcacttttaatctcactattccacctaagccacttttgtgaaagaaacagtggttaggagttggggagagatttacatttctttatacatatttgtttagtcatttcatagttttaatcacatgcattttccaaaataaaaatattttaagcaccatcatgaaaaataaataagatacacagtttggacccaaagattttgccaaagtggattaaacatcccagtctccagctgcctgaaaccctggggaaaaagttgggagtgtcaaaggtctcaggccatcaacttgttgccaatcaccagctctgtccagttccccaggactgcctgggctctgttacatgaggtctcatcctaggaacgaccattggtacccacctggctggcagagggctttctgctttctaacctcctctcgcagggttcaggctatctctggccacgatcttcccttcttctgctgagtcaaagcaaatatctgaggcattctgagggacacttagaactgaggagcaattaagaaatgccctccaggagggactggcctccatgttacatggtcatcctacaagtcctaatggaggccctgagaatggcattgccttaatggccatagtaggaaaaatgagcaatgttgcctgatcgctgcaattgaatatcaaagatgttaactgagaggcacatgtatacacactgccaaacattaaaccatcttcctacacattgcagggcatgagaaaaaaaaaaatggaggttgggagtaggatgtccaaaatgagagagaagggtaaagaaagaagaattgcaaaaatccataattagaaagaaaaaagcaaacatgcatttagctgttttggaaaatctatgttacataaataggacatttttcagaagttaaagaaaggtcagcctaaatcatgcacacactgcagatccccatccgtactcctaatctgaaaaactaatattaaaggattagagtatgacagtttaggtcaaatgatgatcctccctccccagacttgtctattttaagcttaggaggaggcagaagagtcataaattctcccagtggggcacaaggagccagtccttttgccagcacctttcagactacccgtgacctcccttccttgtgaaattacccataagtcgaagatgggaagcaggccttgtatcccttgggaatattagggagtctcacaactttccaagattttaggaaaagtaggaagtaacctatttataagtctgtttgttttgggaagggattattgcctttgtcttcctttctaaaatagcattcattaatttttctttaagtaaaaatatgcccaatgccatcttctctcattccccatggaaacttgctttgatccacagagtacctataaaaaaaattacaataaattgtgtagtgtttgtaactaggaagattaggacttggaatgaattggctctgcgtttatagtctcaaggacaaagactttgtctttgttctcaaggactatcagccatgagattgacagctggggtttattctgatcccaacattttcctcctctgatgttggtcatgtcctcctctgtcacttctgaccatgagtatagggattgttgttgatagtcagaggagaaagaactctctgaaatgcttggtagaaaggaaaaagcatgaaagctttctagaaaggtaaaggagtttcatcagagtaacggtaatacaatgtgagattcagaatgttcttcctggtttagtaatttcaccttcacaagaaggggctacatcaaggcttccccagggtagctttgcagctacagtcagattgtgcagattcactgagacaaaggcctagggagagaggagaaagcacttccttggcggctgtgttgggccagctttactagaagtggagtctgacacacttttgtgcaatgatttattgaggataagctctcatgagaaggaagtaagagaagcaggaagaggcatggaaggagttaagtgaacttgtatttcaagagaggtctaacctcagcttgatctcactggaagctctggagagtgtgaattgcaccatagttacccaccaagagccaagagaattggactgttaaacttcaacattaatttgtcatcggctatacgctgcctctgagagtaaggcggtcatgtccacgaatctctaggataggcaactcccattggccaaggacaatcccccagaaaagggtgaaggtgtgagcccttatgagccaacacctgtggcagctgtaggctgctggccctagcttggtcaaggggaccttggcaggcaccaactgcagctgctacataagccaaaacaattgaagatggaaggtctgtggactgtaccttatctaaggaacaatttatatcatatacaaatcctatcctttactattatatggtagtacatatatctcaaggtatggtaccaagggggcatcatatttgattagattggattacaagataaatctgaagaggaacatggaggtagctcagttcagtatattcattttatagaagagaagaagtacatgagagtaaacacttactgggaaccagatctgattctcagttttctcttttgcttgaattcaaccgaactcatatttattaaattcttactacgtataaggcacgattttaggcactgagcagataagtgaaagacaccaaattcagccactgccttgtgccttaggcatttacagtctggttgaagataaggaatgaaagaaaaaaataagagtataaatgctatgcaaatcacaattcagatctcacccaagagcaatgtggattaaatgcttgggtcctttgaggcaaaaagcatgacacacaggaggatagtttgtggtttgtcttaatgtgatgggaggccttcatcccaaattcccctgtatttaaaactataaaaaagaaaatatcctggcagctctactatttggtgaagctgaaaaagataaatattcaagtagagttctggaaaaggggaaaaaagcaaatgaacaaagaacaaaaacaagccgtcccttttcaaaatgtcatcttgccatgaaagcttcttcaattcgttacctagaagtgcaaatgtattgaaagttttactcattaaataagattattttgaagctaaaggccaaagatcctacttactttggagaacagtgttgaatccagcccaatctctcctttcagcccaggcatgttttagtactgggatgttttctatctttttaagtgtcctgtgctctgtttacactatattaatctgctcatttaaattggtgttttgttttaatgtttggccagagtttatgcactgccactttggagagaatctaagattcattcattcattcattcattcactcactcaacaaagcatttgttgacagcctgttggcatgggagacccttgcaattggcaccaagaatacaagaatgagaaagggactcaacttgcacccaaatgctcacagtccagttaggtgagaaaaataagcaggtgaatatattaaataaaatatggtatatgcacgaatagagccctgcccaggatatctaaccaagattgaccctaaggatgttcaaggaagtttttataaagaatttgaccttagttgaagcctgaggccccggtgaagggttacctcctcctttatcattttctttattgaatataccatcagaggaaaattatcgttttaaaattttgttgatgttgttaatctgtcccctctgtcttcccactaaaacagcatttctcaaccttttttaaaatcagtgatatcgtaaggagcctttttaaacaactttttttgtttgcttgttttgttttttattttgtatagatagaggatctcgctatgttgcccaggttggtctcaaactcccggagtcaagatatcctccttcagcctcctaaagtgctgggattacacacatgagccacagcacctggcctgtagacaactttttttctaaacactactctccatgatgtttttctgtagcaaaataggcataatataaaatgtaccatcttaaccatttttaagtgtacagtttactggcattaagtaccttcgcagtgctctacaaccatcaccattattcatttttctgtactgaaatttgctcaactgaaattctttaccccttaaaggataacttttcgtaccctttcctcccaggttgccccctggacaaccaccattatactgtctctgaatatacctgtacaaggtacttcatacaagtggaatgatacaatatttgtccttttgtgtctggcttatttcacttagcataatgtcttcaagattcatccatgttgtagcatgtgccagagtttcattcctttttatgcctcaatacctacatgaaatttaataccacattttaaatctctttgtatactctgggcctttggaggctcacaaaccattgtaatacataagatttttccacttcccaagaaccagtttcacccttttgctgcaatatccccctgtagaaaatgcctgtgttaaaacctaagctccgtgaccctctctatcttgttgtccactgtgtcccccagcgtaacacctagcacattttaagtactcaacaatcatttattgaatacttctctagcccttccccaaccactccttccttcttatcttagccattattattaaaatttgctcttagagtaattacgtatgtatttgttacttagtgcttcatgctccccagccaggcatctcaccatgctcatttcctttggctgcacatgccattctcagtgaccctgtgtttgctggctttcttcacagaagtaaaagattatgagcctccatttggttccaaggtgcgggagcacccctgtgtcgaaagcatgaaggacaacgtgttgagagatcgagggcgaccagaaattcccagcttctggctcaaccaccaggtaaggagtgagtgtttacaaaggtcagtaagattcaaccaagttgcctcttaggtggcagagaattctggaatattgagcttaaatctgagggaaggtcccattgtgttctatggccctgttaaattttgtttataaagcaaatttcaatacagtggataacccaattattataggctccaaccagctgatatgtactctgagagttcacaaatagccattcggaggacatttgccacattttccaagcccccttggtcctgggttaaaacattttgtttgcagcctctgctacttactcctgggccttcacgtcaggagtttatatttgattccctctggattccaaatgttttcttctgggaatcttcagctccataaggaaatacttagcagatgcaaaacaagcagggtttgtcaggcagctgtagtgagaagtgactgtggcatgcagaaggctgtgtacaggtgtttgcaggctgtgctcacagacttgggagaggcctgagtgagcacgcgtgggaaagaggagaccgactcctcactctggaattaaggaaagcaaagaagaggagaatgccctggaaggaacgagaaatctgtctgttgggaacatcctaatggcctcttatttttccttgttaagaaatgctagctaaggctgtccatagcagggcagtcattctggactcataaagaggctgatccaaattgtttgtttgggggcactttgatgagggcaatggtcagagaaaaaagaaaacgataggttgtgagtgagtcagaaccagctatatgtctgacacacccaggaaggagcccttagtgaagaatgagagagaacagtgtggccctatctcactgagaagactgttctttctactgactaaaaccttttattgcctcttttggatgaattccctcaaccatgaaggccgaggctaagttgttggtttccctaagggcaaggcaaattcagataagaaacagaaacaacaaatcaggcacaatcgggaagacaaatggagcaggaagtctggtctgtgccagtcctggcccagagccacttcagcagacagaccttaataaagtccgaggaggttggcgagggggaaccaggctgtggtgggtcacaggcttctctggagttttgagcaaatcctctttgacactaaaactgtaagaatattttgcataaattctgaaatcagaatgtgctggagtgttatgtttctttcaaactctgttgcctcctctgctgtatagttctcgtaatgatgccattattcatgatgataaaattctgaaaagaatttgcataatacattttttctcataatgagatttgttgccctattgatttcaagttaatgcttaatatttaatttaatttactgcctgtaattacagtgccagaataaaataaatgttacttgtgtaccaacaatagcactctactcttaacagggccatctgtcaatactgtcaattaggtgaattatgcaattaatttaacatcatgaactcatcgggtggggagggagagataggctcctaggtgtgtttggaaagttgttggtattagaaaacaagtagaaaaagtgccagctctcccaggtagttttgagatttatccatcccactcccagccacctgtgtgagggatcccattagcaatgttgatcttacaattgggaggagcacactctatttccacctatcagaccatttacttaactcctgcctgctttatttccaaaaaggatttgaaatgataacaaaaatatttgcaatgcaaaataaaaattaagccagtgagagaaaactcttgccaccttcctgggcaggatctcctggatggtctccttggatgggagcttgattcggttagggtgaaccctaggaaatggcatagagttaagcatgcctgacccacataggcagctgtttcacagggttcaacccaatgttgttggagaggaatggagcatcccagaggtcatccttggcagctcgtagaagctgctactgaatcactctacaaaatgtgtggcctatagaaaatgaaaccatgctaatgcctgcatacaattctgacgggggtaatcagccctgttaaaatagaacagtgtatatgacccaactatatgacactctggaaaaggcaaaaactacagagacagtacaaaatcagtggctgccagaaatttaggggaatggagggagggatgaataagtggaatgcagggaatttgaggggcagagaaactattccgcatgatactataatggtagatacatgtcattatacatttgtcaaaacccctggaatatacaacaccaagagtgaaccctaatgtaaactatgaatttgattgataatgatacgtcagtgttagttcatcagttataacaaatgtacctcatagatgcatgcatgatgtcaaggtggagaaggctgtgcctttatggggaaggggttttgtgaaaactctctgtactttccactcaattttgctgtgaagcgagaacttctctaaatagaaaggtgttgaaatgatattaagggccactacatggggaattttcaggtgttgggagtgttagtgtaccccagaagcccagcagaggatcattgtgctgtcaggacctattgtgatcagatagcaccagagccaaaaagtatggtaggttttgagcacagctgccaccagcacaaaccccccaccaccctttccacatggaactggctggcctgcagcagcaggcactcagtcagcacatgttaaatgcacaggcacttttggaccctgcttgcactcactatagcaacaaggtcagcaggccaccttgccttccgcggagcccaccaactcatggtgccctttggatctctttcccgctacagggcatccagatggtgtgtgagacgttgactgagtgctgggaccacgacccagaggcccgtctcacagcccagtgtgtggcagaacgcttcagtgagctggagcatctggacaggctctcggggaggagctgctcggaggagaagattcctgaagacggctccctaaacactaccaaatagctcttctggggcaggctgggccatgtccaaagaggctgcccctctcaccaaagaacagaggcagcaggaagctgcccctgaactgatgcttcctggaaaaccaagggggtcactcccctccctgtaagctgtggggataagcagaaacaacagcagcagggagtgggtgacatagagcattctatgcctttgacattgtcataggataagctgtgttagcacttcctcaggaaatgagattgatttttacaatagccaataacatttgcactttattaatgcctgtatataaatatgaatagctatgttttatatatatatatatatatctatatatgtctatagctctatatatatagccataccttgaaaagagacaaggaaaaacatcaaatattcccaggaaattggttttattggagaactccagaaccaagcagagaaggaagggacccatgacagcattagcatttgacaatcacacatgcagtggttctctgactgtaaaacagtgaactttgcatgaggaaagaggctccatgtctcacagccagctatgaccacattgcacttgcttttgcaaaataatcattccctgcctagcacttctcttctggccatggaactaagtacagtggcactgtttgaggaccagtgttcccggggttcctgtgtgcccttatttctcctggacttttcatttaagctccaagccccaaatctggggggctagtttagaaactctccctcaacctagtttagaaactctaccccatctttaataccttgaatgttttgaaccccactttttaccttcatgggttgcagaaaaatcagaacagatgtccccatccatgcgattgccccaccatctactaatgaaaaattgttctttttttcatctttcccctgcacttatgttactattctctgctcccagccttcatccttttctaaaaaggagcaaattctcactctaggctttatcgtgtttactttttcattacacttgacttgattttctagttttctatacaaacaccaatgggttccatctttctgggctcctgattgctcaagcacagtttggcctgatgaagaggatttcaactacacaatactatcattgtcaggactatgacctcaggcactctaaacatatgttttgtttggtcagcacagcgtttcaaaaagtgaagccactttataaatatttggagattttgcaggaaaatctggatccccaggtaaggatagcagatggttttcagttatctccagtccacgttcacaaaatgtgaaggtgtggagacacttacaaagctgcctcacttctcactgtaaacattagctctttccactgcctacctggaccccagtctaggaattaaatctgcacctaaccaaggtcccttgtaagaaatgtccattcaagcagtcattctctgggtatataatatgattttgactaccttatctggtgttaagatttgaagttggccttttattggactaaaggggaactcctttaagggtctcagttagcccaagtttcttttgcttatatgttaatagttttaccctctgcattggagagaggagtgctttactccaagaagctttcctcatggttaccgttctctccatcatgccagccttctcaacctttgcagaaattactagagaggatttgaatgtgggacacaaaggtcccatttgcagttagaaaatttgtgtccacaaggacaagaacaaagtatgagctttaaaactccataggaaacttgttaatcaacaaagaagtgttaatgctgcaagtaatctcttttttaaaactttttgaagctacttattttcagccaaataggaatattagagagggactggtagtgagaatatcagctctgtttggatggtggaaggtctcattttattgagatttttaagatacatgcaaaggtttggaaatagaacctctaggcaccctcctcagtgtgggtgggctgagagttaaagacagtgtggctgcagtagcatagaggcgcctagaaattccacttgcaccgtagggcatgctgataccatcccaatagctgttgcccattgacctctagtggtgagtttctagaatactggtccattcatgagatattcaagattcaagagtattctcacttctgggttatcagcataaactggaatgtagtgtcagaggatactgtggcttgttttgtttatgtttttttttcttattcaagaaaaaagaccaaggaataacattctgtagttcctaaaaatactgacttttttcactactatacataaagggaaagttttattcttttatggaacacttcagctgtactcatgtattaaaataggaatgtgaatgctatatactctttttatatcaaaagtctcaagcacttatttttattctatgcattgtttgtcttttacataaataaaatgtttattagattgaataaagcaaaatactcaggtgagcatcctgcctcctgttcccattcctagtagctaaa

SEQ ID NO: 28 - DNA, 45375 bp, Homo sapiens
cgctgctgggctgcggcggcggcggcggcggcggtggttactatggcggagtcggccggagcctcctccttcttcccccttgttgtcctcctgctcgccggcagcggcgggtccgggccccggggggtccagggtgagtcctgggacggggggcgggggccgggatggagagggcccggcaagggcgaggcctcgagccgcggccgctggactacagcgcgccccctccccacgagcacaatatggccgggtggggggcgcagaggagtcggggtgacccccagtcagcttccccgatctccgaggcgcagccgcccggcggcgacggagctcacgccgggcccctggggacccgagccctgttccaggcggaactggattcgggcagttctcaggggtcgcgctcccagcgccctcgtgttccagagaggggagtctgagcctccagctccaagatttggaggtccgtggtttctgcccttcaccgtgtccaggggcggggggctttcttccctccctccaggtgctcctggggggcgtctttctcccgccaagactgtggggttcgggcggtggggtcttagcctctccgagggaacctgatgttgagagtccgcgcacctcagactgtaggggaaggggtctctaacctttccttcaggtcctgcacttggcgtgtttcttcccctccctccactgcctccctaatgttctgggaaagggagtcacatttccccttcactcaatcccttgagttcagtggggcaatcccccctccgccctccggcactcatgccccgtggaggctatttggaggaagtgggacgaacaggcccctaaacctttttggagcctggctttggaatccctaaccctatggaaccgagttccccaagggttgatgtgaatctaggtgtatttgctttcctcctcgcctcccccaccctaccccggggggcccattcagttaatcactttgtggatgcctttcaggtgaaatcctggaacctgtctccaaacccccaagattatttaaagatcccaccactggactgtattcccggcccttggtcagtacttatttaccttcctacacgatgcctcttcccagcccgcccaccctcacacaccccttacctcccaatccccacagtctgcggctcgccttataccacccccccactctcctctctgtagaagcgggtacctttttgcgggacacttcgctggctgtgttgtttttgaggctttgggggctgagaagagcagatgaaaccctaaaatatttcatttaagagagtcttggcgaatgtgttttggccttggggtagcagatgaaggttatatttggcagttatattgaagcgattattgacccacagatggatctgggagagatgatcaggattgtattcgctcctgacgtacaaagcctgatgctttgacttctcagcagcccctaaccttccagcaatgggagataaagtgtgttctgtggctctcttctcttacactaaaaataatgattctcaggtgggttcagtcgtctttaataaaccagacagtcaagaaaagacaccatgccactttggaatctcaaaaacaagttcattatctccggctttgatatttgttcccagtggtggagcctgtgcagcggggtctttgttcacgggctaatgcttctcctaagcacctcgtgtgtgttcttcggcctcactgctctgtggcttaggtatctgtgctgtggggtttgagaaacatggtgaaggtgtatgaacagagcttgacatttgtggtgagataatgatttgcatgaataaggatgttcgtcgggccttattaagggccatgtttttggaatgtgtaacataatgttctctactgggtagtaaaaaaaaaaaaaaagggagattgaacctctaggtttgtcattttatgtgtgtatgtataaatctttaaatcctcatataggaatttttatcctgcccctaatatatccaggatttttaacagtcatttccctgctgatttgatgtagtgtttgtggggtttttctggttgtgagcctagttaagaatgtttgataatccaagtggttctgaatggggcagagttcatttttttgtaaccttcctaaaatggatgtttgtgggggttaaggtgggtgagtaaaatagggagttcgtttctttttttggtaaattggaaattaggttgtgtgtccagcaaacattctccagggcctttaaacttcttggccagacactacagttttttccaggacacgtctagttgccaatagtgtatgctatggagaccactgctgcaaagggcttaaagtaaaacgtcagttctgggaaaatagaggctgtgggataacaagaagttgatttttttcccctcccctgcatttcctatatagtgctcccctacgtgggctggaggagtgacagagccagacagctctgatgcctgatacttggacttgatgtgaggggcagtaagggataggtgtttctattaattaatgaattaactaggacttagtaaaaggccagtgataaggagaatgagtttcagttagaaatagcatccgtttgataggtgtacatgttttaaggcctggctttggaattttcacatttaaaaatgtaaaattgagttagtagcaggagaacatgacattcatttctcaagacaaaagcaacaagagagatatttgacattctcataggaacattttgaaattttgtgagcggactaaaaatctaatttcaagccaagccttgtaattttgttgagtggacatggattttaagtacagtggaagtgcagtcttgtagagacctctgattagttttgtttaaacagctcctggaacagatgtgataaaacatattaaaatggctactctggttaaaggttaaagccagatggagggaggaggctggttttcagccctagaacttagctgccttacaagttgtccttgaacaagtaacttaacctttctgtgactgcctcagttttccctctgtaaaaataaggaaatattttgtgtcactcttattgggacatttgtgagactgacttactgatagccagttggcggggaggtatttttagacacagtttctgacttcagtgaataagcaatgctgggttacttttttatcttaaggagcagaaaaacatactctgtgattgatagacgtacagcatgtcacagtgtggttttctttttgtgcttttttgtagacccctttcagatttcctcaagttaatttctgtctctggcaggctcttacatcgtcgactaggcagcatacctgtgctaatcaaagacagtctggagggagtgacctgctttaggctttattggtttggcaacgttttaattcttacgcaactctgggtatgtttatggcactatgtaaatgttacataagaacatggaggctgagaagtggccagaatggtgactgtgaacacaggaaggttagactgaggactttatccaaaaggaccttgggaatctgcaatcagtacaggaagaacctgcacttattttcctctaagaacctttttagatgattatgtctttcaggtggactgctgtgttataaataggtttattctccaccggtgagctaattgtaaccttgctaccaaaatatgaatcagtaaacgatgagacgtgctgcttcttccagcatgtcctgttgaagctgcttgttgcattttggaacatgagttgaattgggttgcagtctgttctcataatagctgaggagcacagggtgttgaggtggaatggaattatcagttcgtggtgctttaggtcatcttaatttttgaaggttaaattagaatactgaagtggctctttataattttgaaatctctattgtttactgttcaatttttgctcagagtagcagtgaacattaattctgggatctcgcctgtttgtcttcagttcttgtgttagctgttgttgtaggagttggtgtaagagggtcttaatctcattttcctctctgtattcataaaaagggaatcctagagtcctttctcaccagtgcttctgatgctggacataactgcaggcagccacagcccatcagttccacttggactgggaatgcgggaaccttttaagtccaacttacatttctctcactctgcaggcactgcctcatggccaggttcagatacctgctctgagtttctgttctcagtttttcactctcatgcaggtttaacttgagctttggcttcagaggcaccatttctgtccatgtctgctctctctcctctgttatggagaaatggtgtgctaagcaaaaatatgatttcagagagtatctttctttcctttactctgtagagttgccatactttggtttagctgtgaagtttccatcccaggcaatctttatctgctctctagggttcagagacagtgccactttaggcaactctgggctttttggttttctttagtgtccacccagtcttaagcctgcatttgtctccctaaatattttgaatttagcataatgaaagtaactgcctttccctttaaaccataacatcacacctaatatttacacagttaacatataggagatttctttattcattggattgggtatgtgcctggaacagtttttggcatggggaaataacagagaacaagatgaacaaaagtccctaaatctctattatggaacttataattgcaatggcttagactgaaaataaataagtaaacacaattatcagtccatgagtgctgtgaagaaaataaaacaggatgctgtgccatagtgtgcctggagctgccacttcacctctctatcagcttcattgttttatctgtaaaatggggctaatacagtcttgttatttgtggtagttccataaagttgaattgtagaactgaattaccaaatcttcaaccattgctcctaggggaaatacagggctaggttcctgcgagcctctggtcactttttcaacctgtcaatacataaccttattttatgtgtttctttttttttctttttttgagacagggtcttgctctgttgcccaggttagagtccagtgacatgatctcactcactgcagtttctgcctcccaggctcaagcaatcctcccacctcagcctcctgagtagctgagacctcaggtgtacaccaccacacctggctaatttttgtatttatttactttttggtagagacagggtttcgacatgttgcccaggctggtcttgaactcctgggctcaagcaatccactcacctgggcttcacctgctgagattacgggtatgagccactgaacctggcctgtttcatgtgtttctgtttatttttatttttaatttttatttttttgagacagtgtcctgctctgtcacccaggctgtatagtacgagagtgtatcataggccaggcacagtggctcacgcctgtaatgccagcactttgggaggccgaggcaggtggatcatgaggtcaggagttcgagaccagcctgacaaacatgctgaaaccccgtctctattaaaaatacaaaaattagccaggtgtggtggtgtgcctgtaatcccagctactcaggaggctgaggcaggagaatcacttgaacctgggaggcagaggttgcagtgagcggagactgcgccactgcactccagcctaggcaacggagtgagactccgtcaaaaaaaaaaaaaaaaaaagccaaaaacatcatagctcactgcagcctgaaactcctgggctcaaggaatcctcctttgtcagcctcccaagtggctaggatcacacgcacatgccaccatacccggctaatgtttaaattttttgtagagatggggtctcacttgttgcccaggctggtctcaaattcctgggctcaaattatcctcctgccttggcctcccaaagggctgggattacaggcctgagctaccatgcctggctttgtttctgtttaaagacaccttatttaatatatattgttggttcattaacattgaactttactgacagcagcactattaactcatgcctgaactaagcttctctaacatgtattttctctgtgaggcatatcactatcttcttgcacttaggaactctagacagcacttcagcactacttgtgggggaccattttatacagcaaaatcatcaatgaaaagcatgacactaaatatactgcagaaaggataacttgtttacagtatgccagctgaaacaagaaggcagggtgttgccttgtttgacctcagttgggaatgcatgtggtgggtgtttcagatgtttcactattctgtgcatggctgtcagtgagcaggaaggtaccatgaatgttgatattggggttacaaataaatttgcattaaccatattttgttagaactgtatacaaaagtggtagaaataaaattgtagaatttcactaaaccagaattttaatacatgtagttagaagtcccatttccagactgcaaactaaacatatgcatgttgagtacctaccatggtgatctagggcagtggtccccaatctttttgacatcagggactggtttcgtggaagataattttcccacaggggaagtaggggagatatgattttgggatgaaactgttccacctcagatcatcaagcacatcaggccgaggtgggtggatcacctgaggttgggagttcaagaccagcctggccaacatggtgaaaccccatctctactgaaaataaaaaattagccgggcatggtagtggcagcgcatgcctgtaatctcagctactcaggaggctgaggcaggagaatagcttgaatccgggaggcggaggttgcagtcagccgagatcacgccactgcactccagcctggggaacagagtgagactcctcaaaaaaaaaaaaaaagaaaagaaagatcatcaggcacatcaagcatgttagattctcataaggtgcatgcaagctagatgcctcgcatgcgcggttcaccgtaggtttcccactcctatgagaatctaatgccgccgctgatgtgacaggaggcagagctcaggtacccgcctgccacttacctcctgctgtgtggcctggttcctaacaggccgtggaccagtaccggtctgtggccccaggggttggggacccctgatccaaagggtcccttgacacatatttattgagcacctgtcatatactaggcattgttgcaggtgttagggatacagtagtaaacgaaaggagacaaaattgccttctctcagaaagcttaccttctgccaggtgaggtggacaataaacaaaagtataaaatgtaaagcagttgtgcctactacagtccaccttctgctcctcacttccccaagattccccatgtttggtgtacacacacctgcttcaggtattcagtcaaatgctagtctttgtagatagaattaaggtctcaatcagttgacctttagccatctaaaggaggttatcatggtgggtctgtcttgattgaactagccctttcaaagcagagagatttctcagctgattgcacaagaggaaatcagatgttccagctggcttggaagcaagcagacgtccatgttgtgaactgccgatcccaacagccacatggcaaggaactgcaggcaaactctaggagctgagagtggttcccagctgacagctaggaggaacatggggacctcagtccttcatctgcaaggcagtggatcttgtcaacaaccagtaagcttggaggaggacccaatcctagatgagaaggcagccctaactggcactgtcggtgctgtgcctggacttctgacctgtaggaactgtgaaatagtaactaggtggtggtttaaaaaatgtatgcattgggtgggggtgagtcaaatggtgatggtgaaaataggtaaagcaagagaggggaataatgagaaataccccaagataggcatgagggtacttgagacctggtgcccagccatcccatcactcacatataaaaataaatcctttgaccacatgtggctttcatctgactataacttttttctagatatttgtgagtggaggggagaggggattgtggatgctttggaaataagttttttaggtgcttgggatgtttgagttgaggaatctgggaattgaagtattttctgggttttttttttttttgtggtagaggactcaccttgccccacatccttgtatattgctttggtatatgtttgcatattaccttttatacctgtagaagataagattgaattgtaatcagtcagtgttcatttctgatatccaggatgtgcctagcaccaagctgaatgctgagagggatcctgaggaaagagtctgtccttgccctttggaagtttacacacagagaccggccacagtggctcatgcctgtaatcccaacactttggagaatgaggtacaggggatcgcttcagtccaggagtttgagactagcctgggcaatatagtgagacctcgtctctacaaaacatttttaaaaattacaagggcttggtggcgtgtgcctgtggtcccagctacttgggaggctgaggtgggaggatagcttgagaccaggagattgaggctacagcaaaccatgattgcaccactgcactccaccctgggtgacagagtgagatcctgtctcaaaaaaaaaagtttacacacaaatggactttttttctgcttgttggaactaccacaaactatgaggagttcaggtgacaattgtaataaaagcatctgatttgctgaatgtttactatatactaaagtattatgctaagcacctgtgttgtatcatttactctatgtagttattctttgaggggctaggggctcttattcccattttacagatgagaaaactagggcatagagaagttaagcagtgggtccaaagtctatccaagtccaaaacatgtgctctaaatattgtactgtgctataaactgtgagtactgtaaaagtgaccttctaaccaggctctctgccttcaatctcccatttgttttccatcctacggctagatctaactttggaaatgcaccctgtttgtctgacctagaggttgtgtggcttctaggatcaactctagaccccttagcttagcattgcaatcagtttcatctggtcttagtctccctgactcttcttgcctttggctggaaccttggcattgttcgaactgtcaatttactctgaacccagtgtagctaatattttttcacagccctttgctttcccttttccttttctctggaatgcttctccccacttctcttcctagccaaacccagcgtcctccagtgtggaccttcgtcctcttgtgttctcccggtcagtgattccatcctctctgcttttcccctcagcctgtattggtagttggagttgcactgtttatagttgtcttctcccactctccatgcccaaagaattggtgcggggagctggcttatttgttatatggcttcggcctgcacagagccttgcatgtttcaagtacttaataagtttgtttaattgaattaattcatttcttttccatcctctcagtaaaatcctaggtaaataattccaattctgttttgctctaatgttattataatcttgtatatatagtattttaaacctactcaaaaaatgccgcaaacatttgtgagttacttggaacatcataatctctctttctacctcacctctttcatctctgtttatcctaccacctacccattttattccagccaaatgaacttgatctctcaacctcattagttttattctcagtttggctgatttcttttttccttttccattgtcccagttgcctgaaacaatcattcctatccctcttctcactcaaaactgtgacatacacggtctcctctccattcgtccatactataataaataggtcaggaagaaaataccagggataaatatccttccctgctctattgagccagaagtatgtttattcagactcaacaaagaaaacagtggttttacatgttcatcataaactgatatcaaaggagaaatgcaatttcctgattgtctaaatatgacagctgagtctgcacacataggtcccaggaacattggacacactccctcataatgaggcccactcatttcagtcttaccttgacattctcttgggcagcaggtgggcccttgctagatgttcaggtatttacagtcagccataaattaagttgcaatgacaggtctccttagcataaacatcaaacgtctcttctgagtgagaacaaagctttcattctctaactgagacttaaggttgaacttgtttaaacagctctctagggctgggtttgtctccaagtagaatgtcagaaaggcagtttgtagaatggatatagtgtggagctggctttccaaacacctttctcttatgcaaaccccattccaagaccttttcccagattggaattaaataccaagcttatcaagtgtcttattgttaaatctgtgtttctccccaccccccaccatacaaatagcttcctttattaagtcagttatattttttttcataagtactttttaccagtacatttgttgttgttgttgttgtttttctgtataccaccattggcacctgtaaaatttgactttattatggcttgtgggtacttgaaagctttttgttttaatgtatttttaaaatctaattttgatgattgtaaaaggtgaaaatgtaacttgggtctttttttcttttaaccaaatagcatgtgattgctttactgctgcaagatttttctatttaggctagttagaactttgctagtacagtatcagttcctagttattgccttcctgccccccaagaaagccacacattgcctctattttgtgaacagtttagtgccagacattttttaacctgattcagattttcataaacattttggcagttgtctagatcagtagctattaacaattgtctttctttttaagacagtggaactcttaaaaatgaaaatgtagaaatgtatataaagtgagtaaaagctgagcaactctggcagaggcccctctgcccctgaaattattaggctgagatctgttgagtgaggtttattgagcacagtgctatttgccaggtgctgtactagataccagtgagaaactgttgaaaaggacactggtttcctctttgtgagttcagagattcccggacacggtggagagtctagagattcaggaagaagatagtttgaaaaacactgtagtttttttttgtttttgttattgagatcatattgtatatgttgtttggcaaatagggatttatggtagtaattttaaattgtagcaaaatacgtataacataaaatgtactattttaattgtacaatttagtagtgtttaagtaccttcataatgtgcaaaccatcaccactattttttaattttaattttatttatttattttttatgtatttattttttttttgagacaaagtcttgctccgtcacccaggctggagtgccatagcatgatctcggctcattgcaacctctgcctcccaggttcaagcgattctcctgtctcaaccttctgagtagctgggattacaggcatgcgccaccgcgcccagttaatgttttgtatttttagtagagacggggtttcaccgtgttggccaggctggtttcgactgtaagtgatccacccacctcggcctcccaaagtgctgggattataggcatgagccaccacgcctggccgacatttcatatacatagaatcttaatgtgtggcttctttcatgtaatataatgtttttgagtttcatctatattatagcacgtatcaatagtttcttttcagggctgaataatattccatcataaatataccacattttgttcattcatcatttgatggacatttgggtggtttccaccttttggctattgtgaatagtactgttgagaatattcatgtacaagtctgtgtttaaacatttgtttcagttattttgtgtatatgccttggagtagaactgctgggttatagggtaattctagatttaacttattaaggaaccatcaagcttttttccacagcagttgtacccttttatgtcccagcaatgcaccaagggttccagtttctctaaatcttcaccaacacttattaaatttctttttcatattgttatggccttcctagtggatataaagtagtatctcattatggttttgatttgcatttgaatttgcaatacattagagatgatgttgaacatcttttcatgtgtttgcaggccatttgtatatcttcggagaaatgtctgttcaggtctttttccagttttgttggttttttaaaaattatgttttttagagaagggttcttgctctgtcacccaggctggagtgcagtggtgtattcttagctcatcgcagccttgaactcctgggcttaagagatcttcttgcctcagactcctgaatagttgggaccgcaggcatgcaccaccttgcgtggctcctgttcagtttttaattgggttgttgttgagtttgaaaagttttttatatattctggattctagaccattttcagatgtatgatttgcgtatattttctcctgttcattgtcttttcattcttttgatattgccctttgatacacaaaggtttttaattttgatgaagtccagtttatccattttacttttgttgcttgtgctttggtgtcatatctgacagaccattgccaaatccaagttcatgaagttttacccctcttctgagagttttagaagtttaagttttagttgatatatttaggtctttgatctattttgagttaatttttgcacatggtgttaggtaagggtctgacttcattctttcgcatgtggttatccatttgttcatcaccatattttgaagagacttttcctcccccctgtatgttctaagcactcttgttgaaaatcagttaatcatagatgtatgggtttatttctggattctcaattcggttctgttggtttgtatgtctatacttagcaccattctgtttgataactgtagctttgttgtaagcttaaatcaagaagtatgagtcctccaactttattttttttttctcccaagattgtttggactattcagggtcacttgcaattccatatgaattttgggatcggctttttcatttctggaaaaaaacaaaaaaaaggccactgagattctgatagggattgtattgactctcatctgatgtatataatttacatatatgatcatatgtttactctatgtgtaatttatgttggtggacaagttcggttctcagtttttcagtatcaatttgcaaaaagaattccttttgaaaaatagtatgcctaagaaaccctggaggaatatacatcaaacatgtagtagtaattatctctggggcaggaattagaggggctctcaacctctacattatatatttctgtggtgattgaagttctttttaaacgaggaaacatggattaatttggtaagcaggggaaaaaaagctagtaaagataaagtatatttaaaaaaaccctgatatatgatactcataatagcacaactaacatttatagttttggacccccccaccaagtagaattcctcaaaatgaaatattagaattgaaatgcttagtagcaagtaagaactttgatgtatttgattcaatgtcagcagctgggtgggaggacaaccagtaggttggagatattagagtacagacctgtggggaggatgcggctgcatcaaagcacaatgggaggtagaagctttactagataaagacagtaccatgtgagatcgttcagcgaggtcctttccttatatggatggtatagttgggctaggataggtatgatgcagaccatctgactgggataatgagcttggagaagccacagaattaggccggacgtcagtgattagagactgattatccaaacacgaacaagagaggaatgtagcagttttggttaagaacccatccttaggatacgcagtcttagaactacttaaggaaatacactgaatttgatcttgcatgttggatgaaatcgattacagactaaatttcaagtagtctggaagagggaatacttagtcttttctagactaaagatgtgtgtgtgccagaatctgtgtagctaatggtgttgggttgaggaggggagtgtggagatagagggaatacctacacaggacctggaaaagtagaagaggaaaatactactaaaaaaaaaagaaagaaagaaaaaagaattaacatcacaaaaagagacaactggaagttctgtgccttgtgagggatggtagggatggtattcatcacttgttagtattctagccagaaatttgagcctgaatcacatcaaacctctaactctagctaatagcttatagaaaatacagaggagagaggaacatgttaaatgacaccttggagagtcaacccaaaaaatccagaatgtgggaagctgcaggacaaatggcctagattcttcaacagataacttgcaaggaaaaataacagtgcaagcgggaacctatagattgaaaaaggttttaggagatctcttagctgagtgcaatggaagaacctcatttagatctggattttcattttattttatttttgaggcagagtctagctctgtcacccaggctggagtgcagtgatggagtcacagctcacttcagcttcagtctcctgggctcaagcaatccttccacctcagcctcctgaagagctgggacgacaggcatgtgccaccacacctagctgatatgtttactttttgtagagacagggtctcactgtgttgcccaggctgatctcaaactcctgagctcaagagatcctcccacctcagcctcccaaagtgctgggattacaggtgtgagccaccgtgcccttcttggatctgggtttgagccagttgttaattttttcaaggtaataaaggatttttgaacactgactggatatttgattatattaaggctattattgtcagttattttaggtatgataatgatattgtgggaaactgcaatttaaaatataacttgcggaagattgcaatatcaatgacaaaaaattaaaggcacttaaaaacattaaaggtaggccgggcgcagtggctcatgcctgtaatcccagcactttgggaggccgagacgggtggatcacaaggtcaggagatcgagaccatcctggctaacatggtgaaaccccgtctctactacaaatacaaaaaattagccggacgtggtggcaggcgcctgtagtcccagctactcggaaggctgaggcaggagaatggcatgaacccaggaggcagagtttgcagtgagcagagattgtgccactgcactccagcctgggcgacagcgcgagactccgtctcaaaaaaaaaccaaacaaacaaacaaataaaaacattaaaggtggtgcggtggctcacacctgtaatcccagcactttgggaggccgaggctggtgggtcacctgaggtcaggagttcgagaccagcctggccaacgtggtgaaaccccgtctctactaaaaatacaaaaattagttgggtgtggtggcgggcgcctgtaatcccagctgctcaggaggctgaggcaggagaatcgcttgaacccaggaggcaatggttgcagtgagccgaaatcgtgccattgtactccagcctgggtgacaagagcaagactccgtcttaaaaacaaaaacaaacaaacaaaaatattaaaggttgggggaaacctgctagagaatcggtggctggtactagtgggaatgtctggcatttaattgtacacttagctgtataggcacttggctaagagctttatatactgattatcttattcttcagagccaccctatgaagttgattctcttagttttctgcattttctaattgggcagcccgagtcctgtgagcccaagaaacttgcctagtgttgctaagctaacaagtgatggaaccaggatttaagcttaggctgtctgacctcagagcccaggctgttaatcactatgtaattatatctccctaaaggtgctctcagtgatagaggaggtagcagagaaactaaaagaattatttctggctgggcgcggtggctcatgcctgtaagcccagcactttgggaggctgaggcgggtggatcacctgaggtcaggagttcgagaccagcctggccaacatggcgaaacccggtctctactgaaaatacaaaaaactagccagacgtggtagcaggtgcctgtaatcccagcaacttgggaggctgaggcagaattgcttgaacctaggaggcaaaggttgcagtgagctgagattgcaccatggcattccagcctgggcaacaagagcaaaactgcatctcaaaaaaaaagaattatttcttcactcgtattgagaagcgtgctatggaaacatacaagtccaaattatttcgaagtgaacaagttgtagatgttagatacctcttgaggtaaaggtttaaaaccaatcttatattaatagttggcttgtaataaatgttattttattctaaatttaagtagtgataaatatatgggacgttttagacctaaagaagtgggtctttgtggcaaattgtatttcctaaatgactgcaactatatttcccatcccacatgtttttcttacaatgtgactttgacactctttccaataggcagggtctacccatgtcccttccttgaatttgggtggaggcttgacagctttgatctatggtatatggtggatgtgatgctttctggtatctaaggctaggctgctagaaggatacagtttctgccaggttcgtttccttttgggttcttgctctggagaagggcagctgtcatgctatgaggagcctaagctaacctaagctaacccacacaaagggactacaggttgaacatccctaatccaaaatgctgcaaaatccaaaatttttttagcaccaacgtgctcaaaggaaatgctcattggagcatcttgatttcagattttcagattagggttgcccagtcagatatatatgaaaatattctaaaatcccccaaaatcagaaatctgcaatgctttctggtccgaacattttggataaagaatgcttatcctgtagttggagaggaccgcatcaagaagaacgaaggtccccagccaacagccagcatcatgcgccaaatgtaagcgtgagtaagccttcagatgattccagccccagccttggagtcttccacctgaagccccagatgttgtggagtagagataagctgtccctgctgccctgcccaagttcctggctcatagaatccatgcatagattaaatggttgttctatgccacaagtttttggagtaatttgttatatggccatagtaactgggacaatgttatttttcttcccatctcaaaggactttaatgttgtcgtcgtaaatggccatttttgagcagatgtttagtgtggacctactagaattcagccctggagatgcaaaggtgaatggaacacagtctatttctttaaatggcaccacagccagaagactgttaaattgacctgttactcctatatgtgtaaagagatttccagaaagaccctggttgctatgctgatgagacctataataaaagtgggctactgaatctaagaaaacattatactacccactcgagagaaggtggcagtatggtttctctaaagcccaggcaggctaattggaattttttatagaggtaagtatgcatgtgaataaagagaaagacttgatctggactttgaaagaccctaataaagtctgtacaggtagttattttaaagtcacaaagggattaaaggaatttacactgtgtataaagaactatcttagccagcgtggtggggtatacttgtagtcctaactactgaggaggctgaggcagaagggatcgtgtgtggccatgaatttgaggctgcagtgagctatgactgcacctgtaaatagccactgcactccagcctgggcaacatagcaagaccctgtctctaagaaaattttttaaaaagtcttaaaaaataaagtagggataaagcaccacttccataatattggtagagtcaccaatatgaagtaaggaattcatggtgaaaccttgaggtttccagtggcattgttatcccaggctgtaacacactaaatccctggagatgaactgcaggaagacatggtgtggctctttggtcagaaaaccaatagcgcatttgatacggggagggtaagaatgtgttgagagtgatgtgaatgatatttgcagggtgctgaatctgatcacatgaaggtgttcctagtgtggccgtggccctgctggctctgtgtgccaagtgttgtcagaaagagcgtggtagaatgctgtgtggtgttgtggggaaaagatcgaacttagaccctggagacctgagttggagatgtgctccatcgttttactggtttaccgcttgtgagccccttaacttctccgaggctttactatccataaagtgagacagctatacctgcctcagctcgtgagttcctgtggggatcacaggagaggatgaaagtgaaaactcttgatacaataacacagcgtagctctgcacggtgttttcttatgggaaacaaactgaaaacatcctacctgaatataaaactgatgtctctgatcctgcaatcacagttgtgtagagttatggtctttgttctatccgtactggagagggttgggataagggccagggaagaataattaaaataatcatggttgtattaggctattcttatcacttggggctgtttggtgaatttctcatctggaaagagtgctgagaagcagtttatgatcaagtcataaaatcacgaagagtaagggcagaactagaaggttgcccggtgaaatttgaaaatctctagcgtacctaaacaggacagtgctccacaatcagtactaaatttatgaaatttattattcccaagtagtaattaagttaaaattcataattactatagcttcaaaaaagttttaggtgcgctcctggaccttcatctgttaggacaaacttagacgttgtgtgctgtgcctcttccctttcacagggggcgccatcatgctgcacactcccacacccctcctggtgagggtctgaggcgggatgttaggctaaatggccatgaatctgactgtgtgtggcggtttttgagaattcttagctgggccatggtgtcactgagtggcctgtcttttctgagttccagctgtgttaggcgcctctataacacggagctagacagtctgcccaggttggaacttgtcagccttactcaaaacacagcctgtctcatgaatcaaatttgcatttacatcctaccacaaaccaccttccaatcatactttggaaccgtgttcaaaccctgccaaggtggttttgtctttagtttaaatttgactaacttgttaatgacaaaagtctatgcaagtagggcttttgttctgaccacttcctaacttgtttatgtgtagagtgattttgttactcctgtgatttggttttccgagttgtgttatttctactacgtaattcttccgccttggaataaggagagttttaggtatgtttatatacacggtgtgtaaaatttttaacctgatgagtcactatgaaacagattctaaggggctgttatcattagtccagatttattttttcagagagaattgaatttagtgtgcgtgatttaatgaactaagatttacagtaaatttagatgtttttataatttatcacttttgtttcagtggaaaatgaatgttaacagaaggctagccaaaatgtctgtctttaaaagatgtttaggaaaaggcatataaaacagagcagaattgtccagtgttgggtcagtgatcaaacagtgtgaacttaaaaacaaaactagattcaaacatagctggaaaggattttagaggtcatatagttcaatcccttctttctggttaatcatgagaaaaatgaggttcaaagaggttaaatgacttgcccaaagccatgcaactagttcctgatagagctgaaacttgaacagcagtttcttactgaaacttgccacttcctaattagtggttaaggagacacatttttacttgggtggtggctttttgttttgtttttaggttttacattgagggggggattaatatttattgaatatctactagttgttaagtactttaaaaaatatattagctgggcgtggtggcacatgcttgtagttccagctactcaggaagctgaggctggaggatcccttgagcccaggaattcgagtccagcttgggcaacataacaaaaccctgtctctaaaaaatagatatatatttcttcatgtaattcttacatagccctgtgaaatacagtcacgtgccgtataacagcattttggtcagtgagggaccacactgttacatgatggtagtcccataagattataatgctgtatttttacttcaccttttctatgttagatacagatgattcttgtgttacagttgcctacagtattcagtacagttacatactgtacaggtttctagcctaggagcaagaggctacaccacttagactatgccatctaagtttgtgtaagtacacgctgtgaggttcacacagcaacaaaattgcctaacgctgcacattaacagccccactttacagattaggaaacgggtgcgagaaggttaataccttgctcaaggtcatgtggttaatattaaagctggcatttgagcctttctgacctgtcctgctatgatccccactgtggctactagtgatggtaattctgaccttttcaggggtatgggcagcggtggtagttatctttaaaatatatctttttcagacttctcactctgtaaaatatgtaattagacatagatatgtgtagagtggcctttctcagaggacccgcagctcttagcagttgcttggctaatcttcataccatctctgtaagataaacggtgttttctggttgggtagttgaggcccagataggctcagggactcacccagcgccttatcacaaacccacacggcccagcccccagttccgttcttcgtcctgtctagcatagatttcaccacttttgttctttcctgtcttacaccaagattgtttaagtacttcccaaaaataatgagccacgtgtgggtgtgttcgttctccagaatgaatcactgtgaaagaggttgtgaactaacgaaataagcataagtatctggaagcagaggctcctgactattcagtccctctaattggtgggctctggagtgagcgcttttctgaaaggcaactgtgggtttgggcttgtgtctcactgtgctcagaatagtcctctcttgaagttgttacttttcccttcttgcttcccaaaatagaaccaatgttgttctctttgctggacatcacaacacaaatattgagaggtatgctttccatagagaaccccttttaaagtgcctgaatgtccccactgccacaaaggggaatgggagttagctttcttaagattccagtgtgagtaaaagagctttggatcaagtattctgtgagtttcagaagtaaatgtaaaagcagaaagaataagagagggagcaaacaaaggtatttggaagggaaaatgaagcgattccttagtcttttttgtgtctaaatgggttagaataaaaattcaggagaaatttacttttaaaaatcccttttatgatttggatcctagtctaataggcacctactttaaatgttctgcctttaagaaataacactacccaaactctgaagcaagaggctgcatgttttggaatttctcccagaagaaagggatctgatgaaacgtgaaaaaatacaacaggccataagtgaagatctgcactgtctacactgtctatccacctgccagggctgcctccttggtttcctcgggtgggactagcaaggaatcggctcatttatagaaagcctaaggaaggaggggttgggcactgagatatttagaatctgtctttggatttgaaaagccaagagatgcctttcagaatattggaggaagagacgaagatagactgtgtacagcctaaattggtgagttatgacagggtggcttttcatgggactgcccataagtgtctcatctccagggtccatagtgtgaatgcattcccacttgttatccagatagtatttacttagtgtgtgatctgggactcagttgggcccccaccacctccacccgccaatgtgtgagtgcttccttcagcacttccgagccccagcctcagtgttctagtgggcaaagcaacactcctgcccatgccaagaggtcagagctaggttagtctcatgggagacagtgttggggagaaccaactgctgctgtctgtgctattcttgttagttgaataaataaaggatttcagattccagggctgctgaagaggctttcagaggcgccaaattcatttgcagtaatttcctgtcaaatgggacacacttatgtatgatagttacccagcaaaactcattaatcccagaggtgattgtgtacactgcctgtttgaaaaaaattcgtgtgtgtgtgtgtgcgcgcgcacactcatgcgtgaatgcatgtgcatgctatccaggggcctttcaggatgggttaaatgtattgtgcacttttaatgcattatctcacttaattctcacaataacttcatgagggaggctctcaagttctctttggaggatatcatttttgcccctcgtgaatgagaggggcacctgacttggacttctaaaggcaggaggacaataatggagtggtcagggaaagcttttcaaaagaagtgacatttgagttgaattttgaaggatatgtaagaagtaggcaggaaaaaagcattgcagcaaaagaatgtgtgagagcatgcatgctgcaggaagccgtgggtgtgcttggttcctgctgggggagatagggctggtgatagctccaggaaccctaggtggctctgcatgaagtggggggcagccccacattctccaaaaggaagatgctttcctcttgtcaggcatctcaatttgaagaaaaggtagttcctctgtctctcacaggcataaagtagagcacttagaggataatagtggagcttcaaaagccttgtttgtgagctaaataaacaggtgaagttgtgctcagttaaggatatctttttggccccatctctataaaaactgttttggaacatcaagtatgctaagggattatattctaagtttggaaaaggacctgcaaaagatctcaccattgatgtcaatgtctgctccccaatttcctgcagctctgctgtgtgcgtgcaccagctgcctccaggccaactacacgtgtgagacagatggggcctgcatggtttccattttcaatctggatgggatggagcaccatgtgcgcacctgcatccccaaagtggagctggtccctgccgggaagcccttctactgcctgagctcggaggacctgcgcaacacccactgctgctacactgactactgcaacaggatcgacttgagggtgcccagtggtgagtgcatgcccttgttgggctagtggctcagcttggagatagggtaccccgtcatttcatttttttctactcttgcccactcacttggtttgacgataaagatgccttttggatgttcccgaaggtgacaaaggctggggtttctcagcagttgcttttgtagattagagggtgaggaagcagattttcaagttagtcccagaggtgcccgcagtgtttagagtagtggcttagcagccataggcagcggtgaggagtggaagaaccaggcagggattcccacgggaggatgtgggactgatccagaaagagatggccccagagccgagcaaaggtgactcctcaagggaggatgatggttagatgtgaggagggaccagaataggaaaaggccagtgaccaaagccgagaaacaccacataccatccttttgcaagcctaccattcaggaggcattactgtggagcccacaggaaaaggagagaaactaaagcagagcttagaggagctgtgggaagttaaagggcagaaacaggcatctgtgtaggggcctgaggcggggatagtaccacgaaatgcgtgaggtgacaaagtgggttgtgggtttgactgtggaaagaggtgccttaactaaagaagttgggcatttgagagcatctaggcagcaagactagcccagaagattagagagatcaagggagcctgaacacatcgacagggaaaggggtctttttcactcttcactttgaggggggtgtttttactctttcccttgtttttacttctcattctttccctctcctctctcacttgactcaggtcacctcaaggagcctgagcacccgtccatgtggggcccggtggagctggtaggcatcatcgccggcccggtgttcctcctgttcctcatcatcatcattgttttccttgtcattaactatcatcagcgtgtctatcacaaccgccagagactggacatggaagatccctcatgtgagatgtgtctctccaaagacaagacgctccaggatcttgtctacgatctctccacctcagggtctggctcaggtaccaagttcttcagggcatcatgtctgtggttggctttcatcagtttcccagcaggatagagtgcttgtagagaaggctggaggccctgcatttgtttctaccagcattgagtcatttggtttcctagttccccttcttttggagtctgacgtgtaataagataagataatgggttcacagaaaatctctcattccgtgggattcccaaggtctagtacacaattatccactacagaagtcctgcctctctaagctttgcaactgtacgtacatctattaaaattcagctggtcccacctgagcagtggagtgctcaatttcagggccccttttgagaaacaggagtgtgccagattcctgtgaggtggtgacagctaatcattgatctctgagcaaccacaaggggagtttaaggacatccagtaaagcttagagttgggatttggtgaatcattgacttgtaccagttgcccaagggtttttggtgggggtgaaaataaaggcagtgtgggcctccagcatagcatcagcactatttcctgtactgccttttgttgaccaagtctttctcagatgagggaaatgaaccaaacactggaccttggcataagacgagaatttaagataaaggagctcggggttgtttaggtctcagggtatagctcagctagctattaaatgtgaacatgaatgcaaaagaatttttttacttacttatttatgtatttatttatttagaaacagagtcttgctctgtttcccaggcaggagtgcagtggcgcaatttccgctctctgaaacctccacctgcctggttcaagtgattctcctgcctcagcctcctgagtagctgggattacaggaatgcgccaccacagcgactaatttttgtatttttagtagagacaaggtttcgccacatcagtcaggctggtcttgtgttcttgacctcaagtgatccgcctgcctcgtaaagaatttttttaatgaagataaaccattatttttgtgacaatggtattgcattcctttttttttttttttttttttgttttaagatatggtctcgctctgttgttgcccaggctgcagtgccattgtgcaatcacagctgactgcagccttaacctcctgggctcaagagatcctccaccttagtctcctgagtagctgagatgtcaggcatgtgccaccaagcctggcaatttttttttttttttttttttttgtggaaggtttcactttgttgcccaggctggtctcaaattcttggcttcaagtccattcttaaaaaagaaaaaaaacatccacaaagatcactgttgccattctagctaaaacgcagaggatcttatttgtgagaactttgcgtgtttttatgtatgtttccttgacgtgggacaagactgttgttctgtggggaaattatgccatcagtcatgcccagacattctgcttgacacgggagtactttgagctgtgacatctcctgaatttcagtggctttgcttttattaagctctgcagtagagagcaccaaaatgatggatatatttaaaagctgcatatttttagaaacagcaaaaatctagggcttgttccttgttgaaagaggtagggcagtggttagaacctcctggctgactgtgggaattgatttgctgctagaggagggtagattgggttttccaaagtctttttaagacccagaccagctgaaacaagggaagggccatggtagttgtttagtcgtctgtggtaaaatggttaataactatttccctctgagtggtttagtatattcttcattcagaatatgcagagcttccaaggtgttaggtttctaataatgtggtttttaaagtagtaagtccatgctgctcatatgactttcaattcatttaaataagtatatactgaataccttctgggtgatatggttttaaacagattagaaagagcctgacccggccaggcgcggtggctcacgcctgtaatcccagcactttgggaggctgaggtgggtggatcatgaggtcagaggagatccagaccatcctggctaacatggtgaaaccctgtctctactaaaaatacaaaaaattagccgggcgtggtggcggcgcctgtagtcccaggtactcaagaggctgaggcaggagaatggtgtgaacctgggaggcggagcttgcagtgagccgagatcacgccactgcactccagcctgggcaacagagcgagactccgtctcaaaaaaaaaaaaaaaaaaaaggctgacccaggattggatcagagagacaggaattgttgggaagagtctcacagaggagggcacatttaaaggagtcttgaggccgggcagatcacatgaggtcaaaagtttgagaccagcctgactaacatggtgaaacctcgtctctactaaatacaaaaaattagccgggtgtagtggcacacgcctataattccagctacttgggaagctgaggcaggagaattgcttgaacccgggaggcagaggttgcagtgagcccagatcatgccattgcactccagcctgggcagcaagagcaaagctccgtctcaaaaaaaaaaaaaaaaaaaaggccaggcacggtggctcacacctgtaatcccagcactttgggaggccgaggcgggtagatcacctcaggtcaggagttcgagaccagcctgaccaacatgatgaaacccccatctctactaaaaatacaaaaattatctgggtgtggtggcgggcacctgtaatcccagctactcagaaggctgaggcaggagaatcacatgaacctaggaggtggaggttgcagtgagccgaaatcataccattgcattccagcctgggtgacagagcgagacaccatctcaaaaaaaaaaaaaaaaaggagtcttgaagaatgagttggaatttttaagagaggcgagagggcaaagaacattccaggccaatgaaaataccttgagtaaaaagacaaaggcatgaaggtccactgtatgtttaaagaacttttatgatgaggagaccagcatgatgtgcttgtgctggggaagcagggggacgtcaggctgccccaggtgtacaggatcttgagggctgacctttatcttctaggtaaggggcttctactgaaagtttccatgtgggaaatgaatgttcattttttcctttggaaggaattctggcagtggtgtggaggatgaattcattcactaccagccttctgttgggaagggtggggtgaggcggggtgtgtgtgggtgcacagggcaagagcaggctgagatgggaggcaaaagacctgttggaagtcttttagagaaggtccaaaagtaggacaggcggacggagatggagaggcgggggctaatttgagaaacattttggtggttctatactgttgtcattaaaagcatagattatagagtcagacagtcctagattttaagccctgctttgccacttactgcttgtatgaatttgaatattacataacctcctctttgagccttagttttcttgtttataaaatggggatgataacagcgccttaccttccaggtggtttggggaagtgagataatttatgtaaagcccttagcatggagcctaatacatagtaagcatgcagtaaatggtagttcccatctaccagacctagggattaataatgtattaattatttgattgggggtgggagtaagacagttaagagtcacttgtgatggtaagggtgattggatatatagagatacattgaatgagtcaaatgaagcaatgttgagttttataaagacagtaaagttaatcttagactaaacatagatggtcctccattctacatctggagttcgcttgtgagcagagcattgctctctttggagatgggaacccatgggccgcacagcactgccctctagtggctaataagcagaacagccagaaggtggcccccagcacatgagcccacactttcatgttctctgccctctttccttcctccaccaaaataaagcagatgtgggtggatcggcccacaggtggctggctgaagagttggtaaatctggtcaaacatttacattcaaatctatcatccgtgcttactgagaggagaaattgcctagataaggagtagctaatcatacacgtttcctgtttgtgttcactctttccccatctctccgcctggctcagccctctggtagattacctagaaatgtgtatgggcagcagcagctctccatggttaatggacagcgtaggatgaagacaccatgttaagggtgtttccgttgtgccaattagtgtgggagttggaaaatttgtcaaatttgcaatgtcaggtttcttcctattctttggttcacagggttacccctctttgtccagcgcacagtggcccgaaccatcgttttacaagagattattggcaagggtcggtttggggaagtatggcggggccgctggaggggtggtgatgtggctgtgaaaatattctcttctcgtgaagaacggtcttggttcagggaagcagagatataccagacggtcatgctgcgccatgaaaacatccttggatttattgctgctgacaataaaggtaagggctgggcttggatacagcattcccagatagaggatgctagagaaagtgcatagctatggggtgcacagctctgtttgccttcatcattgtaacccgtagaaagaaaacttgagtaaggtcaaggtttccatgctttccttaaagtgtggagccttttattccatgaaaaggttatacaaaaatccaggttatcaagcaaataaacaagcagttcttactcagataaacaagatacaccccctcaccctacctgctcaatttctctttctccactcccccaaacccacctccattgtagttcctgcagggggtcccgtaagcttattttgaaaatcactaggatgggctgggcgcggtggctcacgcatgtaatgccagcactttgggaggccgaggcaggcagatcacttgaggtcaggagtttgtgaccagcctggccaacatggcaaaaccccatctctactaaaaatacaaaaatgagctggccacggtgacacctacctgtaatcccagctattcaggaggctgaggcaggagaattgcttgaacccaggaggcggaggttgcagtgagctggaggttgcagtgagctgaggtcgcgccactgcactccagcctgggcgacagagcgagactccgtctcaaaaaaaaaaaaagaaaaaaaaaatccctaggatgaggaattgcggcctcaaccctggcaaggaggataacgacagaaaagcctgtagtccacgaagtgtcgccttcggactctgctcttggtcagtcctgtccctgaggattctttccttcttcctctcccttttattgctttagtttttgaatctcttatgtgccaggcacctccctatgtttgaggacctcattgactagcaaaggatgacgagtaagggtgattagaggaggtaaacacgagttgttctgttgagcacaaattggggctgactcgcacctgagcccagttgagacaaaggtggcaagaactggtcaggaagaaaaatcttccttgcagggaagagcactgcagacatgtgcaaaggtgaggtttggggcccagcaagtaacttggatggctgtgggtggagagggaggcagaggccagattatgaggggcctttttgagaggattgtattccattctgaagatagtgggtagtaattaaaatttcattcattaattctataacatttattgactgctgtgggccagacctctgctggctgcttggaccatcacacataagagcaagacacagtccctcccctcacagagctcccaggaagaaggggacagacacgtggacaggtagtggcacccggagcacagagaggatgctgtgagtggctggttcacattgtggaagggtctctctagcagttgtgacatgacttgctcctgtggcatggtgcaatttagaagttagtgtctacaaagcctacagaagatgctatttgtttttcattcctgaaacaacagcagactgctcattcctcacattgccatgggaagttgtaatggtctctgctgcccccaagctgaggagccttagactccaatacaagggaggaaggggaagagcaagatttttattcccactgagtaagctattcctttttaaaactatcaccttttgataaaatttaaatcttatatgttttaaaaggatcaaatcatgtcttctctttgaacttgttagcagggtcctcaggactttggggctggttagagtgcgagaagcagtgtgttgggtgggccccttgtttgtgataagagaagccaagatgtgtgtgtttccaggatccatccctttattgattctggcagcttgtgtgagtagggatctggctttcaaaacccaccttaaggccagggaagggaaacaatcagactccctcgttcttgcctttttaacatggggtatatatagtatggtgccctggaatcagcgccagcctggaattttggagatttcaactcaatttccagtcttccaattgacaacggcatggcttaattcgattcctggctttggtgtttctttttctccctcctcctgctctcctccttcctgctgtccctagtgtaaaagagaaaataaagtgtatgcactctaccttccattgctcctctgaaggatgagatgcctttctgggaatacttggaagtggtctattcatgcactgaaaagcattttttggcctggaatccaataatccataaaggagatctttcctactcacagagatatcatagcctggtaagaacaacagactgaaaagaaacattacagatgagacaggtgctgtgtttgggctgtgttcagagggtcgctgggacacaggaggccctccaaggctttcctgtttggtggtggtagatccagctcattgtggttctcccgtgcagatgagcaagtcttggtcaggatcaaagcagtgctgcacacaaagctggtgatagctgttaccttccccaggcatatgcctcctctttcctgagtacctcacatttcaaatttgacataatgttcagaatcctacagttcacctaaaggaaatcaggagcagtcctaagaaagaaatggtgttcccctgtccttactgaggtcccaaactggtagaccactataaatgaaaggatgctagatggggcttcagggggcatggaggtgggaaatgtgaattcaggagtctaacctgattttgtgttgtatacactcatccttaccaaccttcactgttttgctgatagttacactttttctgggactcatctgtggttctctgcagataatggcacctggacacagctgtggcttgtttctgactatcatgagcacgggtccctgtttgattatctgaaccggtacacagtgacaattgaggggatgattaagctggccttgtctgctgctagtgggctggcacacctgcacatggagatcgtgggcacccaaggtgagtggactagcgcaggagcggcgaagtggtgtaggcatgaaaggtccgcagtgtcctgatttagttcctagaattcctttttactgaggaagttggggctggacctcaggaactctagtttaatttaaaggaaaggaggtttgagcttcacttaagtgaggtatctacagggtgttcccttcacctctgtcttgatagaactccctcaggaaccctataatatcaatattcagctacttgtcaatcagtggcttgacatagtcatttgttacgaaggagtaatcatcttagaatcccacaatagacatgagaaaaaatggaactaaaaagataaaccagtgtactgggaacatcagtttagtgatttccatgttcattgatggggacagctggcttaaaggccacttggtggattagattctgggccttactaatctgggaaggttttcctggaggaagaagacctgaagctctgctacttgttgattatcatgtcggctctttgggagatcctggatcttgtcacaatggcaggtgtgatccctgatgcctggttgaccagggccacaatggaaaatcacccgtgaaagttggatcctattcctatagcctgtgcggtgccagttctcatcatcgggcctgtttccttctgagaactaggcattgcagcaacttcccttcagtccctcagcacttctgtacctgagcatatttgctcagggaaggcgagtagtagtagtaaatattaatacaaatattagctaaatacacatgtccttctatggtcgtaacttagctacatgaatgcatttaatcctcacaacagtcccatgaaataagtagtcattctgattttatggatgagaagactgaggtacagagggctaaagtcacttttccagggtcactggattagcaggaggcaaagccaggactcaaacctatacagtctggctgcatagtctatgcttttaacatttatatcatctctttgtaaagatccctgtttttttctctgccagggaagcctggaattgctcatcgagacttaaagtcaaagaacattctggtgaagaaaaatggcatgtgtgccatagcagacctgggcctggctgtccgtcatgatgcagtcactgacaccattgacattgccccgaatcagagggtggggaccaaacggtaggagggcctgggactctgcccttgctaagcagcttctactgagtatcccatctgtgccgtttcccatatgcgcaggagaaggaggtgttgaaaaaggaggcgaggaccttgctctcagcccactgaaagttgaattgaacatgcactccccacaatggaaagttgcatcactgcatctaacagatacaagtgctgagagcacagctccataaactgtatgcacattggtgttggtggtattaaggtcggagggtagagaaggacaatctagagcaggatttagaaggatagcaggcaacaggtgtggctcgggaaagagggaaaacactgtcatctcctgtgcagagagctgtgaaggaggcagggagcatgtgcttagggactggagaccagatttgccaaactatagcaaaggtaacccaggatagagatttggggcacccttcaagattatgggcctgcttcccacttcatgcagaagtgaggtaagaagtaaggagctgtgattgcaaattgacttcatgagttggaaatgggactgccttttaatagagtggaagaggtggaaatctgctgaatctaaatgaatttaattaagattatcccctgatttattgtgggggctggggtggctggaatcatagtaattactcataattactactcagagtcattaagggtgccgctgaccacctctagaattaattttgacatatctatagtcaggtaagataacaaaagcagttcggaatgaaacttaagctcaacccatcactgtgactacattcaataaagtgaaggaccctggtgtcaaccaaatattaggtactgttactgcccctgtgacccacattacaagtacttctgccaagaagtcaaaacatgcttcaaataaacaaatctttactctctctttgtttttttgatatggagtttcgctcttgttgcccaagctggagtgcaatggcacagtcatggctcactgcagcctccgcctcccgggttcaagtgattctcctgcctcagcctcccgagtagctgggattacaggcgcctgccaccatgcctggctaattttttgtatttgtaatagagatggggtttcgcgatgttggccaggctggtctccaactcctgccctcaggtgatccgcccaccttggcctcccaaagtgctgggattacaggcgtgagccaccgcacctggccaaataaacaaatcttgatggttaaaaatagagatacacatcagagtagcctggtattgccaaatctgtgctgaagtatttagaatcaaatttaaaacatgggagtttgcaatgaagagatgtgtacacttcttctgccccaagggactttatcagggtgatactcttccacattcagagggctcctgaatcaatactttgatttaaagagagcagtcatcattttctgtgcgtgaccatgtttgttttgctattgcagatacatggcccctgaagtacttgatgaaaccattaatatgaaacactttgactcctttaaatgtgctgatatttatgccctcgggcttgtatattgggagattgctcgaagatgcaattctggaggtacctttcttttttgcctttgctcctacctcccattccaggatgctggatcacccaaagctgttttactgccccctttctttttacaacctgttggatgcctgttgccagagcctgaatcatcgtttaaggttgccatcaaaggtgtggaggtagctgtgcttagggtgcgtttattcttcagggatcagtttgttgaatagcgttgtgtgttatggtaaccattctgaaggctcgtttggctttataaacaaacaaacattgttttattagtccgtggcggggagtgccccggtgcgcatagcacgggattcatgcagtggtctccttcacatcagaagcagtatattctaacgcggtggctcccaagccacattcatgggaaaccctgctgtttcattgttaaaataatagtgctaatttctaaatttataaaagtgcatagatttttcttaaaagtgagttttttctcccatagttaaaaatcgttggcatttgcagctgcttattcatgacagaatccagtaagaaatagtatcagatttagcagaaacactttttattgtcaacttagtatatcagtattttatgataatttccatatattctgccacatgatcaagttccaggacctctagagccctactctcagccatttatctgtgatataagagattccagggcagtgaaagtgattgaaaaaaagaactggtggtgctcacttcgccagcacatatactaaaattggaacaatacagagaaggttagcatggcccctgcacaaggatgacatgcaaattcctgaagcgttccatattttttaaagacctagtatttgatagcaccacagggtgactatagtcaataatataattgtacattttaaaataactgaaagaatataattagattgtttgtaacacagtgtaaatgcttgaagggatggatatcccattttccctgatgtgattattatgcattgcatgcctgtatcaaaacatctcatgtaccccataagtatatacatctactgtgttcccacaaaaattaaaaattaaaaaaatctaatctacaaaaaatatgacaagtcttccagcagaactgttttgtatattaatacccttttccagcttccatttatgacatgtttggtaaaatccaaattatggaaatagtgcccaggtagtattcatggaattgtacctcttaaattttgatcagtatatgcagtaaaacagactaagaggccaggcgcagtggctcacgcttgtaatccccagcactttgggaggccaaggcaggcggatcacgaggtcaagagatcgagaccatcctggccaacatggtgaaaccctgtctctactaaaaatacaaaaattagcagggcatggtggtgcacgcctgtagtcccagctacttgggaggctgaggcaggagaacgcttgaaccctggaggcggagtttgcagtgagccaagatcgagccactgcattgcagccttgcgacagagcgagactccatctcaaagaaaaaacaaacaaactaagaaaaatctggtcacacaggtcttaaactgtgaataagtttatttcttcttatgacatccagaaattgaggctaaatatataataatgctaacatttattcaccacttgctatgtataagctcatttaatctttactactacaagtaaataataagtaggtgctattatcatcgccattttacaaatgaagaaaatgagtcacagagaagttaggaaatttgtctaaggtcacataactattttagtaaacaagggttcagactcggacaggctgaggccagggcttaagcctgtaactaccccttagataattaccaagtccaattctctatttaaaaatatttcccaggctgggcactgtgtcacacctgtaatcccagcactttgagaggccagggtgggctgattacctgaggccaggagtttgagaccagcttgggctacatggtgaaactctatctttacaaaaataaaaaaattagccagacataaaggccaggcatggtggctcacgcctgtaatcccagcactttgggaggccaaggtgggcggatcacctgggagttcgagaccagcctggccaatgtgaagccctatctctattaaaaatacaaaaattagccgggtgtagtggcgggcgcctgtaatctcagctactcaggaggttgaggtaggagagactccatctctacttaaaagaaaaaaaattgtctcattagctcaagacagcagggtttttttgttttgttttgtttttctttttctggaaaagggcttgagaaaaattaattggctttttatttttatttttttgagagagggtttctctttgtcacccaggctgtattgccatggcacaatcttagctcactgcaacctccgcctcctgggttcaagccagtctcctgcctcagcctcccgagtagctgggattacaggtgcccaccaccactgcgggctgatttttctgtttttagtagtgatggggcttcattgtgttggccaggctggtctcgaactcctgacctcaggtggtccacctgccttagcctcccaaagtgctaggattataagcgtgagccactgtgcctggcctaaattggctttttaaaactatctttttattatggaaaatctttctaagtttgtagttcttaaagatgaggacttaaaaaaatgcagtgctattaccacactttaaaaaatgaacattaggccgggcgcggtggctcatgcctgtaatctcagcacttttggaggccgaggtgggctgatcacaaggtcaggagtttgcaaccagtctggccaacatagtgaaaccccgtctgtactaaaaatacaaaaaaattgccaggtatggtagcgtacgcctgtagtcccagctacttgggaggctgaggaaggagaatcacgtgaaccaaggaagtggaagttgcagcaagccgagatcgtgccactgcactccagcctgggcaacagtggagactccgtctcaaaaaaggaaaaaaaaatgaacattaggggtcaggtgcggtggctcgcacctgtaatcccagcactttgggaggctgaggcgggcagatcacccgaggtcaggagttcaagaccagcttggccaacatggtgaaaccccgaatctactaaaaatacaaaaattagccgggcatggtggcaggcacctgtaatcccagctactcggaggctgaggcagaagaatcgcttgtacccggcaggtggaagttgcattaagctgagattgcgccattgcactccagcctgggtggcaagagtgaaactcacacacacacacacaaatttagtgcttttttttttttttttttttttgagacagagtctcactgtcacccaggctggagtgcagtggcgtgatcacagctcactgtagcctccacctctccaggctcaggggaacctttcactccagcctcctgagtagcttgggactacaggtgcaccaccatgccctactaatttttgtattttttgtggagacaagggttttgccatgttgcccaggctggtcttgaactcctgtgttcaagcaatccttccacctcggcctcccaaagtgctagaattagaggtgtgagccattgtgcctggcaaacattaatgtcacttaacatctagtcagtgttgagatttccccagtctcctaaatttttaaagcagtttgttcaaatcggggttccaataagttttatcccctgcagttgatgaatacacctcctacatttcttgtctacatgttccccctcattttttcttcccactctgttttttcggagaatccaggtcatttgtcctgtagaatttcccaggctagattttgcagattgcttaggtagagttcacatattctactcttcctggtatttcctatgaattggtagttagatctggcagctagaatcatttctgggggttcggggacacgtatccttcacaggggttcctctgtccttctgtgacaagttgcgtagcattggttctctatttttgtgtcgttaacgtgccgtggtgatattgtccaaaactaagcgaatgattacttcccctacatatgtatttggttcccatgatatatagttggaataggagaggcagaaaaaatacttgattctttccacttatttaccatttttcaaaataatgaggtggttctgtagcctcccacagaggtaggtgactgaaatttccttttttagactttaaaaatatttgtttccattgaagttatttgtcttattgttacttaaaagttcccatctttgctcagttgggagcttatcaagttggtgccttttgatgtgacccccagtagtctttgatagattccttgctttggctatgaaaaaaaatgttcctggctactcttttgtatttctttttgtttagttgttttgtttgagacagagtcttgcactcttgtccaggctggagtgcagtggcatgatctctgctcactgcaacctctgcctccagggttcaagctattctcctgcctcagcctccctagtagctgggactacaggtgtttgccaccatgcctggttaatttttgtatttttagtagagatggggttttaccgtgttggcggggctggtttcaaactactgatctcaggtgatccgcttgccttggcctcccaaagtgctgggattacaggcatgagccaccatgcccggccccttttgtgtatttcttgttccatacttagaattaactaactttctaaggaaccttagggggtagtggtatttacagagcacagtgtaggttttgtcaccggcttctgagtaatcttttcctgctgttgataactcaggtagatactttcttttctcccaggagtccatgaagaatatcagctgccatattacgacttagtgccctctgacccttccattgaggaaatgcgaaaggttgtatgtgatcagaagctgcgtcccaacatccccaactggtggcagagttatgaggtaagaagctggcctcctgcggctttcccatcagcctgatttctccaccttagaaaagggtttcttgacaatggggtcaggccccagaggagccccctgagagtgtcagttattatttactattacgtgctattttacatatcccaagccctttagggctacagtctcttgtcctggaccctgtagggtgccatttggagttcacagcctagaagaagaaaaggctttgggcctggtgtggtggcataggcctgtaatcgtagcgctttgagaggctgaggcaggaagatagcttgagctcagaagttcgagacaaacctgggcaatgtggggagaccccatctctacaagaaataaaaaattaggcttggtggcacaccacctgtagtcccaggtacttgggaggctgaggtgggaggattgcttgagcctaggaggtcaaggctgcagtgagccatgattgggccactgcgtttcagcctgggcaacagagcaagaccctgtctcataaaagaaaaaggacaaggctttgtctccaagacacagatgagggaggtggtcaacaagtgacaactgaacccagagctgttagacaccaaactaggaaagcagctctggagcccgagctgagctgagctccatggaagagtgaggaggaggtgtccataagagaagccctgagaccagacagaggaggaggacatgcctgtgaggaaagtggtctttccagaaactcagaagggaggaggtgatgtgtatgacagggctgggattgggatggagaatgtgaatttgggagagacggcagatgaaatcaggggtgtgggggaaacaacatttggtggaaagagttgacatgaggacatgtttgtgacatacgtactaataaacatggaattctagggtcttaagagtgttcaggggaacaggcttcgcctagctaagtgctcatgggcctccttttcacttgcggttctgcatttccttttacttatttttttcccaactctatcgaggtgtgattgacaaatgaaattgtaacaaaggtgtacaaagtgctgaattgatacatgtatgtattgtgacatgattaccacacaagttagtgaacacatctgtcacctcaccttgttgcttgtgtgtgtagtgagagcagttgagacctactgttagcacatttcaggtgtacagtattgttgactctagtcaccttgccgtccattagagccccagaacttacctagtcaagtagagaggttggctctgcctttaacgagtctaaccactagagggcatttctgcatttcagaacagaattgcatattagctgatgctttcgtgttgcatcatagagcagcacttctcaccgcactccttggaaccctcagggcagggtttgcttcagagggcaggtgagaccaaaagagctggccgttagctgcagcgtttgcctttcacttgtgtaagctgtcccttaaaaaggaagagccgcctggcgcggtggctcatgcctgtaatcccagcactttgggaggccgaggtgggcagatcacaaggtcgagagagcgagaccatcctggccaaccaatatggtaaaaccccatctctactaaaaatacaaaaatcagctgggcgtagtggtgtgtgcctgtagtcccagctactggggaggctgagacaggagaatcacttgaacccgggaggcggaggttgcggtgagccaagattgcgccactgcactccagcctgggtgacagagtgagactccttctaaaaaaaaaaaaaaaaaaaaaaaaaaaaaaaaaaaaaaaggaagagccagggaacaaagggagccttgcagagcatttccctaaggtcggccgccgggtggatgtggatctgccagactgcactgagcgggaggtggcagggaaatgagtgagagcctagggaccagaaaggcttctccagggcatgaccgagctgatggctcctgggtctctgcacaggcactgcgggtgatggggaagatgatgcgagagtgttggtatgccaacggcgcagcccgcctgacggccctgcgcatcaagaagaccctctcccagctcagcgtgcaggaagacgtgaagatctaactgctccctctctccacacggagctcctggcagcgagaactacgcacagctgccgcgttgagcgtacgatggaggcctacctctcgtttctgcccagccctctgtggccaggagccctggcccgcaagagggacagagcccgggagagactcgctcactcccatgttgggtttgagacagacaccttttctatttacctcctaatggcatggagactctgagagcgaattgtgtggagaactcagtgccacacctcgaactggttgtagtgggaagtcccgcgaaacccggtgcatctggcacgtggccaggagccatgacaggggcgcttgggaggggccggaggaaccgaggtgttgccagtgctaagctgccctgagggtttccttcggggaccagcccacagcacaccaaggtggcccggaagaaccagaagtgcagcccctctcacaggcagctctgagccgcgctttcccctcctccctgggatggacgctgccgggagactgccagtggagacggaatctgccgctttgtctgtccagccgtgtgtgcatgtgccgaggtgcgtcccccgttgtgcctggttcgtgccatgcccttacacgtgcgtgtgagtgtgtgtgtgtgtctgtaggtgcgcacttacctgcttgagctttctgtgcatgtgcaggtcgggggtgtggtcgtcatgctgtccgtgcttgctggtgcctcttttcagtagtgagcagcatctagtttccctggtgcccttccctggaggtctctccctcccccagagcccctcatgccacagtggtactctgtgtctggcaggctactctgcccaccccagcatcagcacagctctcctcctccatctcagactgtggaaccaaagctggcccagttgtccatgacaaaagaggcttttgggccaaaatgtgagggtggtgggtgggatgggcagggaaggaatcctggtggaagtcttgggtgttagtgtcagccatgggaaatgagccagcccaagggcatcatcctcagcagcatcgaggaagggccgaggaatgtgaagccagatctcgggactcagattggaatgttacatctgtctttcatctcccagatcctggaaacagcagtgtatatttttggtggtggtgggtttggggtggggaagggaagggcgggcaaggagtggggagggagtctggggtgggagggaggcatctgcatgggtcttcttttactggactgtctgatcagggtggagggaaggtgagaggtttgcatccacttcaggagccctactgaagggaacagcctgagccgaacatgttatttaacctgagtatagtatttaacgaagcctagaagcacggctgtgggtggtgatttggtcagcatatcttaggtatataataactttgaagccataacttttaactggagtggtttgatttctttttttaattttattgggagggtttggattttaactttttttaatgttgttaaatattaagtttttgtaaaaggaaaaccatctctgtgattacctctcaatctatttgtttttaaagaaatccctaaaaaaaaaaattatccaattgaacgcacatagctcaatcacactggaaatgtttgtccttgcacctgagcctgttcccactcagcagtgagagttcctctttgccctgaggctcagtctctctcgtattttgtccccacccccaattccttgagtggtttttgctctagggccctttcttgcactgtccagctggttgtaccctctccaggcatttattcaacaaatgtgggtgaagtgcctgctgggtgccaggtgctgggaatacatctgtggacaagacatgcttgggtcctactcctggagcactgtaaaaagagctgattcaagtaagtagatgcctgttttgagaccagaaggtttcataattggttctacgacccttttgagcctagaattattgttcttatataagatcactgaagaaagaggaacccccacaaccccctccacaaagagaccaggggcgggtgatgagacctggggtttagaaccccaggtgagacctcaaatcactgcattcattctgagcccccttcctgtccccaggggaggtgtattgtgtatgtagccttagagcatctctgcctccaacccagcagttctctgccaaagcttgtggaggagggagagccctgtccctgccctcaggctccccagtgctcctggcccttctatttatttgactgattattgcttctttccttgcattaaaggagatcttcccctaacctttgggccaatttactggccactaatttcgtttaaataccattgtgtcattggggggaccgtctttacccctgctgacctcccacctatccgccctgcagcagaaccttggcggtttataggtaatgatggaacttagactcctcttcccagagtcacaagtagcctctgggatctgccaacacacgtccactcccaagccactagcccactccccagttggcccttctgcccttaccccacacacagtccaactcttccacctctggggaagatggagcaggtctttgggaagctcccacacccacctctgccactcttaacactaagtgagagttggggagaaactgaagccgtgtttttggccccccgaggctaaccctgatccatagtgctacctgcacctctggattctggattcacagaccaagtccaagcccgttcttacgtcgccataaaggcccccgaacggcattctcggtacttctgtttgtttttgtacattttattagaaaggactgtaaaatagccacttagacactttacctcttcagtatgcaaatgtaaataaattgtaatataggaaatcttttgttttaatataagaatgagcctgtccaatttctgctgtacattattaaaagttttattcaca

SEQ ID NO: 29 - DNA, 85824 bp, Homo sapiens
tttttttttttttttttttttttttttggtctgggcttccgaatatgttttatgacggttgattttacaccaggaggtttgtctccgaggaagacccagggaactggatatctagcgagaacttcctccggattccccggcgcctcgggaaaatgggagctgctgcaaagttggcgtttgccgtctttcttatctcctgttcttcaggtaggtgcagggagcgcggcgcggtggggctgctcctgcggccgcggcggccgctgctgggggccgcggctggtgttgagtcggagagtccagtggagcctggggaggttgcccactccctgcgcccctcggctgccaccgccccccccccccgcccccaggtctgattgtgatctggaaacctccatgcatttttctctttttgagttgggtcggcgagctgataagagtgagtgctgtgttgttgtggaagtgagaaagtcatgttttgtggccataacactggatgacagcgctggttgggttgcaattaagccgcaaataccacaagtgacaatttatgcaaaggttgagatctgaaaggagtatttagtgtgggctcctccaaaacaagggttgctttttgtcatcgtttaattagtgcttcaccggtgaatatcacgacatagatcaagccagttgctgcttaattttggctgtgggaaacaatacatcctatcagcaatttaatctgggtctcccctcacgttttcttcaacttcagcgtccagcagtgttaaaaatagttgtagttgttgttggagtattaactataacccagtgcagaagaggtatgccgcttggtattggtaatgtgctggcgttcaaccaccatttgtgtgctcttttggggcatagattttgcttacctacggaatacttattttaaacgctttgtattgaagcattgttttcggtttagaacaacccatgtgaaattgtttttgttaaatatagtacactcataaaataggttttagctcaaggttgggggaataaacgggccattttatattggaaattttgattttgtgaggacgttctatggttgcaaccagtggttggaaaaactatctagtcttttgtatttgaaattctataaataaatacagcatctagctgaaaggtgtgcagatgtacataacaggagagttagttcaatagatgaaacattttaaataagtctcattggatctatttattgtaaaatttaatattcagttacaagcttgtggcatagaattacgggggactcttggaaacgggggcgaattgacaggtttcatggccatgtctttatctcgtttgccacaggaaaattaaagggtggtagtcttctttgtgtacctctgtggggtgtgtgtgtgtgtgtttgtgtgtttgtgtccgtcttccccacccccctttaaatataatcttttgtaatgtatagaattttgctgaatggtacatttccttgtggttaataaatggataaagtctagtcttatgtctgtagtggtattgatcagttccgggtgggctgaatgtgttgtgaaatggcgatcattgccagagattaaccaaaagaatcatgtctgtttaaatggaagaaggaacatgcttaaggcaggctgacagttctttttgtgcacggtttgggaaggaagctaaacaatggtgtgtctgaaatgaatgaaggccttgataacattaaacctcttgcttttgtgacatgacttaaccatgtagtttttatctttccagtagtactcttttttcctctgcttctatatgttgtggctggtgaactcctcttgttcaaatcccttgttctgatctcttgcccttgaggaggaggggcatcatggccactgaccaaggaattgtggacattattccctctcaaacccacctgagtcacactaattgatgaaggaggttattcttgagcagtctcaaggtattacttcttgaaaagcaggctgtcgctacagatcttacagcttcttctgcttggtttggtagtaaaaataattgagcattagtttcttgtgggattattttcattgggccaggattattttcagtgggccaggaggttaatagctataattttgaaataaagtgattttgttgctgtagggcatatagatattccacttatattaaactaatattatgttgttgcataggctttttaagatgaacattcccagttgaactaaaatatgtgattctgttgaagataattgaaataatcataaagaccttaatccatatttatacatgaacaatttgagtacttaaaatgtctgatttttaaaagccttttgttatggatcagatgcactctaaaaaaggattattatgtttctccaactaattgatttttctacaaaatgtgtgatctgacatgttggaagcatgaggtgactatttttatgagaattttaaaaattctcaggttgtcagtttttcatttctagatatttgattttttttaaaaatcaaaatgggaaacaatagtaaggaacagttttgttccaggtgtttaggagggatgtttactatttcgtggactctgatttttcagtttccatcccatggtatgtattctggagactgattatgcagactattcctgtaggatatggccaagtgtataatttcctcctctctctcattccaggggaaacattttaaattttgcccctatcctggagtgccttcagattacctttgattttgaattttttcattcctctcatactttctcagattctgtttcaaaacataaatcttagttttctttttatagcattgtggtttatttgtgtctttccccacagtttgttgaagtatgagaatgactttaatacttgctttagtacttagatttatcctatctagagttatgcagctattgtggtatttgagttgcatagaagtaagttgagaattcctttggattttgtgggagctggagcagtatggtcaatgtatttgatgaaagaggaaatggaaatatggtaattatgttttcttcagttcagctaggcagtactgtgtatgtgtgaatgtatgtgtggttggagggggagttagcattacagagaatcttttgggattcttttgaactttgattaacaagtgatggatgataaatactttgttttctaaaaggcagaatctcttataaatggtgtctgtggtcaaattcaaatataatacattgaaacatggagactagaaacaaaatgaaacaaaattctccctccattcattttctatttttttttcctgtttatgatctaagccaacagttctcaagctggggtgagtccccctccctacttccccagatccccatccatgggacatttggagacatttttggttgtcacaacaggggacggggtgtgctactggcatctagttgggtagagggcagggatgcttctaatcgtcctaaaatacatggtacagccttccacaacaaagagttagctggctcaatatgtcagtagtgtagaggtcaaaaaaccctgttctaagaaaaccaaataccacatgttcctataagtaggagcaaaatgatgagaaaacatgaaaacaaagaacagaacagcagacactggggtctactcaaggatggagggtgggaggaggtagatgagcagaaaagataactattgggtactggacttaatacctgggtaatgaagtaatctgcacagcaaaccccattatacgagtttacccatgtaacagaccttcacatgtacccccaaacctaaaatacaaattaaaaaaaaaggaaaaactcagttctaaactcttaaattttaaaagcagtagtttattagtaaaagggctctgctctcttccccctaaagttagtaatctaaattttacaagtacatggtattgatgatctccaggtaacgttgtattgaaagatttttatcttttcattatcttttaaattagaatatgattaaattagagaaacagactatagatacgcacattctttcatccttgatgaaatgcttgagaattcaccagtatagtataatattttatactataataaaatattccaatgacttatggataaactctcctatcaccgattttgatagagtgctcatgaagactgcatgttcctggacataatgaatgattggttaaggtatcaagtttaattatatttgctttagatccaggattttctttgccatgatatgatctttaaggatatttgcctttatttttactgacatcattgggctgccttatggcggtattcgtgtgtgtgtgtaacatgttgcctgaaatatgttcactattacatgttccctgaatagtttcaaggtagaaattctgtttttttaaaaaagatatttcttttgtctagctaactttaatttcaagaaacttttaacctaatctcttaattacataattatcttgagaatcactagctgggttttggttaccgttagactaattcatgatacagtaagtaatattttatgatctattgcagatcgtttccctttttaaggctaaatcttgaccataattaataaaatgcttaccttgttttgaactctggttttaagggagttaacctagccaaccaagataagaattacagtgaaactcttagcaaattaaggagcattataccatagagaggaaaattctgaagtcattcccacaaatggtgtccaaatgagcctcacagtgtctttgtaacacacctctccatacccttctctctgatactgacattttcgccttttgggtccaccagactcactgttcttaagagaagcacaactaaaccaaatgagattttagtaatctctaaattgtttctttagattccaagactttattttgttgcattttgactttttaaagtgctactatgattttctcatctttgatatttcatgagtccaatgatttaaatttgtgttttcatggtctgttaagttgccagttgccatgttgtctcagattataggtaaggttggcaacatttgatactaggggtcactggtatgccttagctttttgctcactgctctgtaactcattgttttttccattccctttcattattgttccctttccattttcctcccttctttgtctactcccttttcttcccctgacccttctgtacttccttatactgcttgcttgtggaacccagttgtggcttagcatcatgggtgactccagagggcttacccgtagttttaatgaaaacagattgaatttagaatgcttgagaattgaccagatagtcttttccactgttttttcatttactggtttctggactacctcgcacaccctcttgggaatagtgttactctcttagaatcaaatggcttgaactttagattgctcttattctcttttttaatattcaggttttccttaactctttgctgcttcagaaaaagtttcgctcatcttattattcatttatcatctctgtttaagccaaaatttgactagaaccaagagtatatttattgctgctgataggaccacattagacttcctctgtggtagatttaattctgttagattgtaaaatagtcatgtctagacagaacattgatttcaaattgactattgaacatgaaaattccaggaatagtgtatagaggaaggaggaggaggaggagaaatcaagaaggtaagaaaactactgtagatagcaagtgactttctgtcattctccacctagatttcttgttagtcacttttgtatacccagtgcatctagaggtcaggctttgttttaataaagggacttaaaggaaatatgtttttgtctctgagattggattttttgaactgttagagtggtggacctaagggaaagaattggaaacttcatatggatagtgatcaagaatgtggtcgtagaggttggtagacttgagctgtggtgtcagtgctgccagtatctagcttatgtatcattttctgttacttgattattgtagcacttttctagctaagattcaccagttccctatcactacttccttttctttctagtccatctgcatagctgctggagtgatcttattaaaaaataaatctgaatatgttacccttgcttaaaacctttcactgactgtgagtcacctttagcatagaatctaaagtcttagaatgtcataaaaggtccttcatcgtttggttcctgcctattttttctaacctcttggtattggttaagagtatagactctggatatagacctaattggtttaaatcttggtttcataacttaaccttggtcaagttacttcacctttgtgtgcctcagttttctcatctacacaatggggggatattaatagtgcctacctcagagagtggtttgaatattaaatgctagttattctgctgcagcttctcctcagcctgagtactatattccatccatacagacttgacttgcagtttcttaaatgtgtaatcctttattgtatatcagtatggtgcctttgtacatattactcttcctcttctacctggctaacccctttttggttttaagactgagaagtatcacctctttagaaacattttctctgtcactcaacccagattgagttagttgctttctgttcatctaacaccttgtaaatgaccttgatttcagtaataattgcaaatgtttacttgcctgtttccactttagactgtgcaaatgtttactttcctgtttctactctttgaagacatctttcctttatccacacacccattcctggaacctggtacacaataggtgctcagcaaatgtttattaaatgaatgaaatgaaattatttcacttctctgagccacggttgtcctcttaatgtattgaagtggtgaacttggattagatgatccctgattttttttcctactctgaaagctttatggttctataattttaaggttagagttcagtggtgacattttattaagaaaagatgattttgctcattgttttgatatctttaagttatgttcaaatttaaatttttttaaataattaaaattagaatttgaattatatagatttagaggggatcttaggtatcctcatgttccatggctttcatacttttttgactgtaatacacaataggaattacacattgcattatgacttagttcccatgtagtagtaggggtgtatgtatatatgtctgtgtgcatcagaaatgaaagtttcatgaactgtgtactcttaactatgtgcaggacacttatgtatttttatattacatttcatttaaaaaacattgatcgtgacccattaattgattcattgaccaactaatggattgtaaatccctaaaaccagtgacctagttcaacaatccttatttcctgtattcagtactctcttagtggaaaaggaagcttcatatgtaaatgtgtgcaatgaaaaatatatgcactgaaaaatatggtcattaattaatctacaatagagactgtgtgcctaggtatagaatatagggaaaactggtctcaagggagaacatggctcttccctgattaaggtcttctctcttttggactagtcgaataaattaagcacacacgaaggcgctgaaacaacattagattgtaattttggggagttgggattttttaatttaggaaagacttgctggacttagtactggaaaaaaagtcttagacggagattaggaaggatgttaatatgaaggaaaagacacaaaatagcatcaggaacacaatagccatttgagagtaaacttgaccatggatgaaggcaaggtgggatggagaaattttgactaaatctgaggaagagatttgtgtgatgaagagagttcacaattgcttgaagaagtaggacaatctcagggggttaacccttaaattcaaatgaaaagtaattaaaactgaggaggtaagagtggatgatacatatcctgatgtatgtcccaaataccccatatgtggatataggactgaaaagcaactcgaagactaaggtagaatggtagcactactaaataaaattggtaaggaagtaatgagccagaggaaaattgaaagtgccttcataactaaaaaagtttacagatagatatagttttagatgataagcatgaatagaaataaagacatgtatttggaaaaataagagtacataataaaacatgataacgtaatattctcttaaagaggcagacactgtatgatggatatgtcttcattgtgaagtctagttaaagaattctaaacattagtggctcaatatgttgtttatgtttaaatgatggtcaaatttcagtaattactcatactggtcatccagattatattctttgaaatctgtatgagaccctacagtaaaatacactgttctaaggaagtagatttagatgcttttctgaatttggtatatggtattcacgcttgaaacctaaacttttcagtgaccattcttttggactagttttttctttggttggctgtagtcacactgggaattactttattctctaatattgctaaagaaaataaatgtaaagcaagaagagagttactacattagaaggactggctacacatgtggggaggggttgcctttcaaaagattttaaaaatgaatcaagtctttacatattgtaataaaagtaagcctatttataaagcttagagggaggagttttcgtagttatgattattaactttaaaatttttattttaaaggaaaagtttattgttcttcccatcttcataactatatgtgatatatcaagcttgctccaaggcattatttcaagaggaaggggcatggacaagttatgagatcttggcacatttctaaaactctgagattaacttttaaaatttgtaaaccaagatgtattaaatgaattgataactccacataacatggtagctggtccagagtagatcttacatattagtttttaatctatctttaagtcccatttaaaaggatatggtatgtaaaacattaaaaaatatagatttggttcttgggggatatttacatttgcaggttacttatcagtcagttaatgtgaaataatactctgactaaatgatacagccaaagaacatatcattatagagagccagatagctgccaataaatatctagaatattcagatatcgtggttccttacaaagagttctttaaggtctcactgttttagcatgcattaaaaagaaacaatggactaaatcgtctctatttattagtgggaatttaaaatatctttttttcttggacaacttctcttaaactttttaagtgttttaaaactttttagtagaagtaaagttttgaaagattctcaagtctgttttttaggtaccagctactttaagctttgaaaacacaaagctattcaatgactgtactttgagatcaatattttgaatgtggtataatattttggactaaaacttaagagtctgtcattcaaattcctactttcctactgactcttctttgacctttgacagccattaagatttcactttactcaccctaaattaaagagggtgaaataggtattcattcacttaacaaatcaatattgaactacatgctagacactatggtaagtgcttgggatacattattaaacatgaagacagatatgattatgcctttctgaagcttatagtcataaagtaagtagtcaaatgaacaacataattacagattgtcatacgtgctcggacagaaactaacagggtgccgagaggattactctttatttgccttatcacatatcacatctgtttactttatctgcctatttcttttttttttgagactgagtctcgctctgttggccaggctggagtgcagtggtgcaatcttggcttaccacaaccccagccttccagttcaagtgattctcctgcctcagcctcctgagtaactgggactacaggcatgcgccaccatgcctggctaatttttgtatttttggtagagagggggtttaaccatgttgggcaggctggtctcgaactcctgtctcaagtgatctgccctccttggcctcccaaagtgctgggattacaggtgtgagccaccgcgcctggcctatttcttatttgtcctttctaatattagaatgtaagctctactggggtggggaagggtgtgactttttcttaatacttccaatgcatggcacagtttctggcacagaggcgaagctcagtgaatatttaactagctgcctgaagcaatgaatgcagtgatgggactggagagatagggacaggatcatgcaggtctttgatgtaacaggggaaggagttagaataaaatgcaaatggcagtgtgaagcaaagagttttaaggaagagcagatctgggttatgtgttgagatcactttggcagctatctgaaaaacatactggaagagtgtaggagggaagaggtgagaccattaggaacctgttgcatcagtgtaagctagagagactctcctagatcccttccagctttgaacattctctgattgtattgtaaagcttgcctacacttatcagtcttccttttgtatcttattttagtcatcttattttttttcctacttgtcattgcttaaaaaaaaaacatgaatggataggcttcttgtgcatatgtgaactttgaatacaaattctcagaaaaaagaaataatgaaacgcagactagaggttattgaatttttgtaacaaatttctatctttagattttgtacatttgctaatttatatatattcttatttaagcattcctatttctctctgaaattggctttactccttttcaggtgtctatttttttcataagcttaccacctctttattgtttcagatgtaatatactatattgttggtatggttgaagattcagaagtagaaactcagtgtattttatatcttaattcttagaaatttgatatcttttcaggttatcaaggtcttacaataaaggctgaaaggatgaatacttaatactttaggctattagttttactcagggctgcagcctctaactctaggtattcagcttgaatgtttttatctggaaagatttcaatcctctcctgttggtggtaaagaggtggtgcttggcacagggaaataagctctttattatggcagaagttcagctgtagcatctgtgcctaggaaaaactgcattattacacacaggtaaaaccagaagagatgttaaactttactgaatttaaaaaatataatggtgcctgcctcttttcatctggtttcacttggattttttcattttggaagcagataaagctaaccatctttgataagccaccttctataaagttcagttttaccctataaatactataggtcattttatttattattaccttaagtaaaatagttctagaagaagaactggatgctaggcctttcttttacctggtagtggagtttcatacttcaggattagtgaatacagtttgctaattaattttatataacctaagactcaaaatgaacttgtaataattactaaaattatatgaggagaaatgaaaagtcaatgagtaaatgaggacgatgataaataatgaataattgcaagataacatatacaagacggatatggtaatagtaaagcaatttgattagtgggcattcaaagtagaataaaacacctttctgaatggccagaaaaatggttgaatagccactgaccatctttttaattctatattatataacaaatctttcttggtaatctttacttattttcctcctcagttctttagagatacatatacttggtttgggtgttgaattaggaaattaattgctaattgtagtttttgttaaaatgtaaatagagattgcttattagctgagagggttagaaataatagaggaaattaaattagcaagcttttactgctgggagggcctaacaaactgtcaggtactattttctccagtaactacctttatcggaatgatgcttaggaagaataaactactcaagctgatcctcacttctgaaggatggagtaaaagtaaaaggttagggtcagagaagaagggtggttatactttattttccttttgaatcattgaagagtagttttgactttttacctgcagatcttatttttcactattgtatccctagaatatccccacatcaagaactgtagtttctagttagtctagcaacatatatttagcagtcctcaattagacagtatttttgtaattaatatctagccttgcatctgtgatggaaggaaatcagctcactaagccagagcacagaagagtagaggagcctactctgttatagataatagaaccattgaaacgttatttgtcagttagggctggttaatagaaataaaagctcattttgttggtacatatgtagccgtttgttggcaagaatggttttctttaaaaaaaaaaaaaaaaaaacaaaaaaacccctaacacttgctttatcttcagattcaatgaaagtaattaattatgcagatctttgggttgatatagtagaaagagcaaacattctgccaggagaaaacctgggtgttgtgcctgtctaccacagtatggaatatcatgtgaacttgggaaaatttcattaccttagtttctattttatagtacctacctcaaagatttgagtaaggatcagaggctacacacacaagcccaagcatactcacataaacatatatacatgcgacttaaaaaaaaaattattttaagttcaggagtacacctgcaggtttgttacataggtaaacttgtgtcatgggggtttgttttatggattattttatcacccaggtattaagcctagtactcattagttatttttcctgatcctctccctcctccctcccataggccccagtgttcccctctatgtgtccatgtcttcccatcatttagctttcacttgtgagaacttgtggtatttggttttctgttctgtgttagtttgctaagcataatggccttccagctccatccatgtccctgcgaaggacgtgctctcgtttgcttttatggccatacatgcaacttaaattatttttcttctctcctaccttttgctgaacatgcaacctttaaaactttgaaatgctatgccaaatatttgtaattaatacagttatttttttcaaggagtagagagtaataggaaggattgaagggaactataccagcacttcgaattcagaatttgtgatgcctgatgggtcgacatttatctttaggctgtctgcaaataaaggggttaattccataaacaaccaaatattagatattagagggcttattccttacagtgaccttaaaggctctgtatgatatggccccattccatccttatcttttgcggtattggccctctggtagttcctacaacaaaccaactgctttttattcctctgagctttttttcacttgtttgtcttccattaatatttatgacaagggccatatcagacttataatgtagtttcttccatgcctggcacataacagatgcttaacaaatatttatcaatgaatgttgaatgctttcgagcacttagaatgggggtccgcagacatttttgtaaagggccagatagtattttaggcagtcccttttgcagtttctcagctgtgccagctgtaacacaaaagcagtcagacaatatgtaaataaactagtgtcactgtgttccagtaaaactttatttgtgggcactgaaatttgaatttcatataatttcatgtgtcacagagtattattattttgattttttttcaaccatttaaaaatgtaaaaaccattgttcaggggctatatacagactggattttgacctgagggctgtagtttgccaatctcttggacattgtataggtggcatccctcccccaccttagaaatatgtttaaaaaactttgttcgggagcattttcttatagaattattgttatatatgtaggttaagttcctagactaatccacaatcctgttttacttccagtgttttagtctagcaatacaactttgttttacccccaagaataactctgtctctgagggaaaatagatttagtattccttcttggaccagaagcagcacatattctccccagcactctcacagtttccttcttccctgatctctcttctacctgctggggtttgcatcctaggaaatactcttctaggggctcctgtagggtggaatggtaacaaaactaaaaagagctttctgtgtgtgattagagaggagggcatgggaggagaaaggtggagagaagagtgcaaagtagtttcttttaaaactgcagattacagcccatttgaggcttataaaatcagtgtagagggtcaccacagacaaaaaaaaaaaaaagaaaatagaaaatattagaatgaatcacccatagcatagtattgttttgtgaaacttcagttgtgtgtgtgattgtatgtgtgtatgtactgggtcacagtgaaaaatgtgctatgtggtcagaaaagtttgagagcctgtgttccaagggtttggggtactgatcctgagtttttttgtttgtttgtttttgtttttttcccttactgtatatgaggcgcatgaaaagtgtaaaggcagtctcttgatttcttgctacagtacgtttttggtactcagctaccttatgaggtagttaactgttttacagatgagaaaacagggtcatacagataaaaagcttcacaactgagattgaaacagaagctcaccagaagctcaccttattttagaatatgttcttcttccattataccatgttgtttttcctgtaggaaaaggagctatgtacgacttcctttgtgttttagaggacaaaaattattccagttggccacagctcactgatttcttgagacaaagcattggctttagtgataggacagggccactgaaaggtgtgaagagaatggttaggaactcagtagaaaggatgacgtagtatgtaagaaaggagggatttcacctttattttcttctttgtcctctgtagtactatccctgctccttcattcctcaccaccagctgggctcttaactcatgctagaaatagcacagaattgaggatgaggtttagtgaggaagggtaatataatcatgtctttagctgaaaggggaatgaggagggaaacccaagtagcagggccacctggccacccagatgggttggctgttcccaggtggcaatttacaagtgggtgtaggtaaaacagggcctgctattaattgtgttacaagcagaagtcttggctgtggaaactggtagctttgatacgctaattgaaaatagttctttttaaagttatattaagggaaagcctgtcttaagcaacacttggttagtccagagtcagttacccattttaagtacttaaaaatcataatatatgtcttttaagaaatctctttttcttagtttctggtaaaaactaatttatccctgattctgatctctaccttaatttggaatggttttgggaagaaaaagattgatgggaaggctcttcttcactaggaaagtaacagaaccatagtagacaggttggttaattgaacagaaagatgagagatccttacagaatgtgttcatcttccccaggccgagttgggattcttgcttttacaatgggaattactgtttcatagggaatgagttttaactatgtagtagtatctgaagacttagtattttttagcccatcacttgcccctacagtattgcttaccattctgtattataatatcttgttaatgtgtcaggctcccagctgaccctaagttgttacagatttttcagtgtaaagttagtgtgttcagcttaggttaagagtattgaagccagatgcctggtcctcgtctggaaaatggagataataagggtaacctactttacacagttgttataaagtgtaaatgagttgatagatgcaaagtgctttgaatgatttctcacatgtagcattctaaataactaaataaatattaattgctgatgctgcttgatattacccaccagtgtcaagctctgaactatttattgaatacgaacaagttataatgtagtgaatgtattcacaatattgaggacattccagtatatttattgagaaactgtacctttgtagatggccatgctgttttgtttaggatgcaagtagtgtttatttataatatttgtatttatttgactctgatttaattctagaacatcatctggtgttcagggaagaatactaatattttcaattatgtagtttattggtatagttttatgtaaagattttggggaggatcttttcagaaaagtgtaaagtagcatgtcattcagtagtatacaggttgagcatgccagatctgaaaatccaaaatttgaaattcttcaaaattcggaacattttgtgtgacagcatgatgctcaaaggaaatgctcattggagcatttcagatttcagattttcagatttgggatgcttaactggtataccaccagtattttgaaatattgaaatatttgaaatccgaaaaaaaaatctgaaatccaaaacacttctgatcctaagcattttggataagggatattcagcctgtattcccgaatgagagcacctgaaaaccttctttccaaagtgagagaaagataaagtggtgtgaatgtgtgaggggaataactgaaatttctaaaagtgtatcttgttttgttttctcagcatctgaatattaacatttctgggtagtttccgtgttttatagttttttaagtgatttcatgtctgtttctgttgatcctatttgagcctgtttgaactaggttctgttttgttttaactcaaaccctgagataatgcaatttgcctgaagtcactaatcagtggagctagaactaaaaccctgattttcaagttcagtgttcttttgtagtagcaaaaaatgctttctggcttttagagagtccccttccactgtctcccatccttagtgtttgcagtgatttatagagttggttgctttgcagataatctttgtaccacactttcagaaacccatgtttagagtctggggagccagaagtagcaatatagcaataataagcaccaaagcgaactctaattctagggcagattttttttttttttggagtaggggtcttgcttggctagcttgatgttgtaactataaatccacatgttaattgttgcctgaagtaaatttgtaggtaaatcctgccattgattgctgcagatgtgcttttctcaatcacttttgcttttgattaagaacatttaaaattgttttcctgggcagggcaccatggcttcatgcctgtaatcccagcactttgggaggcagaggcgggcagatcacctgaagtcaggagtttgagaccagcctggccaacatggtgcaaccccgtctttactaaaaatatgaaaattagccgggtgtggtagcacacacctgtaatctcagctactggggaggctgaggcaggagaattgcttgaacccatgagacggatgttgcagtgagccgagattgcgccactgcactccagcctgggtgacagagcgagactctgtctcaaaaaaaaaaaaattgtttttctaacagtccattgctagatcagtctcattacacatgtgccagaattttacattattttcacattactacattacttgggtcaaaattggaactggcaagttatgtcacagcacaaccattatgtataacaatagtattgctaatgattaccgtttgttaaaactgtcattattaaccaccacttatagcatgctccctgctaagtgctattaagttttcatgataatgtgcctgactagccctacaaggtaattgttaccccattttatagataaggaaactgagactcagtgacttgcctaaggctatgtaattaagtaagtagcagaacttaggtctgtaaggcttacatctattctttggtatctactatgctaaaataatgagttaccaattccaggactgtgtgatgttttttgaacctgttctgccaaggttctctatcctgctcaagttaacagcaactactgttgccagcaccccttgaaacctatgatgtggtaaaaactgctgacttaccaaattgaagtgaatgatggtctactatgtttcctgtggctgataatagcagagctttctccacctctgaaatgaaagtacactgcttgacccttgaacaacgtggggattaggggtattgacaccctgtgaggttgaaaatccagatataacttttgactccaccagaagttaactaataataccctgttattgactggaagccctactgataacataaacagttgattaacgcatgttttgtatgttatatgtgttacacatatacatactattttgtatgttttattgtattcttacaataaggaagctaaaggaaagaaaatgctattaagaaaaatcataagggagggaaaatatttttactcttcattaagtggaagtagattagtcttgctatctcagggatggcagaggtagaagaaagtctgcatacaggtggattcacacagttcaaacccatgtttgagggttgtttgagggtcagctgtaattgtccatagctgcttaaaaactgagtaacagaagttgttccttttggttatatagtgagccagaatcagaactaggtcagaattcatttgctctgatcaccacttgagtaattagagaatcaaatgttcaaagtaaatgcatcttcttaaaatgattataccttgactcagagaagttgaattaattgaaatttgctcatgtagaagaaaacaaatccatgttgcttttgactcatatttagaacataatttaatgttagtggtcattaattgctcattggtgcctgtttcctgtgttgggtgagtgagcaagaacatgctagataagtacgaatagttctggcattaggatttgtggttcccctcttcacattatttttaagacaaattgattaaatgatgtagcatactttgtttttcctaattgaaggacctcaactttctgttactataactttttgttttttttgagagggagtctaactgtgtcacccaggctggagtgcagtggcgcgatgtcggctcactgcaacctccacctcccagtttcaagcaattctcctgcctcagcctcctaagtagctgggattacatgcgcgctctacaacgccccgctaattttttttgtatttttttagaggtgaggtttcaccatcttggccaagctggtctgaaactcctgacctggtgatccgcctaccttggcctccctaagtgctgggattacaggtgtgagccaccgttcctggcctgttattgtaacttttaaagtatcaattagcttgcagaaactgagatatgaagagaataggaagaaagggaaatttcttatctgtgttttttaggctagggaatatgaataaaaggtggcaaaggagtagtgaagacaagtaaaaaattcctagggacttgatttgaatttaagggatggaatttatagaaaaccaaatatagccataatccgtttagttataatttccattataattaaacaataatccacttagttgttgaaatcaaccaacaattaaggggaccctactatgttcgtctcattgtgccaggtactatggagcttacaaaaagagtgtaaagtttttaattgtctaagaaaacagtcactttggaatgataatccatatgctctaaaaatacacattctgaaactaaaaatgcaatataaaaacatgagatacattgattactaaaattaatgatatctgacaccaagtgactttttttttttgggaggcttggcttatcttttaggacttcactaggttagggatgcatttcagattctactccacctagtcttagttcttggccttgtttctttctgaatttattgctgctaaaataaaaccaccacgaggatagggattgtggccctcgtgtttattaccacagtcctagtgtccagtgctcaataaatactgttgaataaattaatatgaaagtcttcctttttcctctcaccgtccagtttcttcaaatgattcctctgtatgtggctccacatccgtaccttttgttccctctttaaccaactgttaacctaaagtaagtgacataattctctcaaagattaaggattttttagtagcctaatctaaagcattcttattatatttgattatgaattgacttttctataagtttgacgctattgtctgcctgtttcttctcaaagttctcttgtcctgttacactcccaattctgtagccccttgctacctcagtattcattctgcccatcctttttgtgttgctgtttctcagagtttaatccttaatggaattttgctctacatacccttcctgttgaagtaatcccatctcatcttcactttttgactaagtgtaggagatgtccagagttaccttgctgattctgatctccctcctgagctccaaacttatttattagtcatctagtaaatgttaagtatatgtcacaactgggagaagagatgaataagacacaatctttaccctaggggattcatagcctagtgggaggagaatgattagtaaactagcatttatgcagcacatggaatctatgttagagtcccttgggatagcagaagcagcttttggagtggggtcaggtaatttttcctacagggacacttgaggtgatcttgaaggatggatgattaggagttcaccaggtaaatagagagggaggaatattttatgttttctctgtcaggcctggtgagttgctccctggtggtgagacagctcagtatggacaagttttccaaggcccgaggacagttagagagtaggcccaggggagccaatgtcatggccaacaaaatggtatcaagcattaaagccagagggttagaagtgactgagaaaacaggggagttaataacaaacgaaatacatgactactcattcaaagcagtgtatgtaagggaatgatttagactaagactctgaaagtggcatgcgctgggtttgtccttttcagtgatacctgttgtatattgccgtagccaccatgatagattaaagcagtgcttctccagctttaatatgcataggaaccgcatggagatattgttaaaatgtagattttgatttgttaaatctggagtggggcctgaggttccgcatttccaagaggctcccagtgatgccatgcttggttcagggaccgtactttcagaagaaagagattaaaggagccaagaatggccaaatgcagaggaaacaatttatacaggcacatgaataattgttatgtgtttcaggaactgagattagttcaggacactgagatcttaaggcatatatgggggatggagcagtaatgggagacgagtctgcagaggtgggtaggggtcaggttatgaggggctggatttgctagcgagtgttaacttcatgccaaggactgtggaagggccattttgagcagaagagtactattatcattcaatgctttagaatgaagagatgaattaggtttttatcaagttgagttcaaagtacttgtggcccattctgatagggatatcaaataagtagtagaggtagatctaagctgggcagagagatttgagtattcagccaatagatgtacagcatgaaatcaactaggcagaatgaggaatgaaaacagaccaaagatctaactctggggaatgctgtcattttcagagcagggagagaagttaaggaagagcttgtagagaagatcaaggtgtgtccagaaaggtagaaggaaaacaagtatcgtttcattgtaagaaatctagatggagacagtattaaaaaaatgtcagatctaataaggtagagcctgaaaagtcaccactagatttgtcaattaggagattatttgtaactttaccaagagacattttggtaaagtggtggagacaaaatccatgttgtaggagatgagtagtgaaatgtagatgaggaagtggtttcagctgtggtctattacttttcaagaaatgttggctaagaagggatgtaaagaggtggggaagaaagccagagtcgagatgtttctgtgcttaagagttgagttcaggagagagcttacagaaaggggaaaattaaaattgaaaccatttggagccagaaacttggctgccatcttcaacgtgttcttcataatgttcttcaaaatccaagcaattactaagttctgtcagtttgactttccatgtgtttcttgagtctatacctgcttcctttccattaccaatgtgttagttccatccttaccatctcgtatctggactctttaagtggacctattcctcccttactccagaaactaaacaaagcaaacaaaaatgcaccagggaaacagaaaacttcccttccacactctttgctagaaaccgtggagattacagaaactaagggatctatgaaaatgtacagatctgctcctgacagttaacttcttaaaaccccttacttcttgtcacttacaaatggtgaaagtcaagctttttaacaatacacgcagtacccccaagattattcttttccagcttcatttcctgccactcactgcctcccactttaatcttacaacactagaagacttctgatctttactacccttgtgccttgtgcctctacactccgctgattttgtacttcctgcaattactgtgggacacctctatctcacctcttccctagcaagttgttaggtgcttctttctgtgttcccatagcaccttacttatttactgattgttacactttctacattattattttctctacttctctctcttcacgttagaacttaacaagtttttctcattcatctctgtattctccgtgagtggctcaatgctggtggaatcggcgcccagttcacgttcactgaaatgtgaagagtaatacaaggaggtagtggcatttgtctggaccttggaagaatgataggatgtcaccaagttccctttgatggggaagaggattctgtacagagtggctagcatacgcaagagctttgaggcagtcaagatgataatatttatagataatgctgaaaactccctttagacaggagagaagaagtggaaaatgtaatggcagataacgttagaaaaataagttgggcacagatgaaatggagcctgggatgccatgttttaagatttttctttccttttttcccctgtagcagtgggcaacctttgtgtattgttaaaaagtagaaaataacaccaactcttgaattttgaagaaaggttctgtattttctggaagtatctgatgtggataatctgttccctgccccccccaaggttttagtcatttctgtttctgttatattttattttattttatttatttatttatttatttatttagagacagggtctccttctgtagcccaggctggagtgcagtgacgggaacatggcttactacagcctccacctcccaggcccaagcgatcctgtcacctcagcctcctgagaagctaggaccacaggcatgccaccacacctggctaattttttaattttttttgtagaaatagggatcttgccatgttgcccaggctggtctccacctccagggctcaagcagttctcctgtcttggtccctcaaagtgctgggattacagacgtgagccaccatgcccagcctttattttttttcagtttccttcctaaagataagatgttttgttttgttttttcagttctcttcctaaagattatagcatgtttgcccattttgggtataagtactttctgtcactgttctttcatatctttaaaagcagtccttgacgagttctagatttgttttctctcagagataattatttaataatataccttgcattatttttttctttaatattagaaaatattctgatacctactttcatattccttagaaaactttctacatttgtttccttttggctggtaacttgctgttcagaattgcttgttgaaattggtaaacctggaagtgttaatatacgtatgcttttccaggttatttgtaaaagtgttgaaattgattttgcatcattcataagggagactgactattcttccttgacgtttgcttattcccttaagccaataatctagtttatgattgcaagaccctcgcagttgtgtttgcgtgtgtttaaatgtggtgttgtcaagttgtggaaggaaatccagggattgaatgtgtttgggaaactgttagacaagattaggttaaataggggaataacatatagggtaacagccattgaaaagcagtgtgccttttattttgttgctgtggagaaaacagaaagctgtggcctatgcttatgctctagttgaagggagaattctatatttaaatcaacagtaaatgttacaatatagtttatatttaaatgcaaaattgcatgagaaaccagatgaataccagctgagtaactaagaaatccaggacaaagaaaaatcaagaggcaaagtaggctggaaagcttcatgaaggaaatgggacttcagtgaaccttgaaagatgagttaaaatctatatagctggaaaagtggttgtggttgagggggtgagaagttgcggggaaggcaagggaaggggcatgaactaagatggggtgggacagtgagaacagtatgtttgcagtgtagggtttagaactgggttgggagggtcaattattgccaggttatttatgtaggtccttgaatgtcagagtaaaagagttggaaaggtgtttggggctgtatgaaggggtataggtgggtgtaggggtatatgggaggacgtatgaggaggggggatgtgaggtatgtgggggatgtgaaggtgttgtcaggtgtgtgagaaggtcttaatgtggtgtattctctaaagcaaaataaaaaaattagtagagtgaaaaatgtctgacctataagaaaaccttctataatcgtaaatgcctgttagtcattgtgattagcataacattacagtaagtattggcctattttttcctctctttaatattctacttgatcatctttgttattaatttaataaaaaatgctacttataatctgaaataactctatgtatctgcccttttttgatttagtctttgggtgaagtataccttgccacaatgctgaatttaacatgccacttctgatttttcttgttagagtgtttgagtcttgagagcagatgtcacatttcgtacaattctttggcctgtctagtaccctgtgggctgcccggtatggagttggcactaaatattggagatctatgcattaacccttacgtcttcaggcttggtaacctgtaaagtcagtatgcagtaactctgaatatcatagataattgtcgtgagtcttttagttgcaagaactgtttaccctgatttatctcatttcattctcctgtttaatccactgactatatcgtgaagacaaccccatttttccttcttcccttttaatgagtttcctttttcattacttctcagtacagactgctttctgcatatgtgccattcttttccctgagtaccctcttccttctttatatacttctttttatactttccaaatatagctagaatctttttcatatactgcttctatgaagccttttttaattaatcttttttattccttttagtctttattcacattcctcatgtattttgtttgccaataagctataaattattttcaataaatttctaaatttttgatatgtttgatattcagaatgaattgcagattccccaagggcagaaaaagactcttctatttcttttggtgtgtttccataatgttttgcatatactgagcatttagatacggttattgttacaagctcagtctcctgtcctgtgcctagagctcatgtgtggaaaggtgcctcccctgctttattaaaagtcctctggttctcagacttgatttttttttttaaatatacatttgctaggaagaaattgtttttcctttgtctttgtcaatgttgagtaaatgccaatgagttaatatattaatactacttaaattagtggttgaatacgctttattgtgcatttagctcctgctaataattttctttgcattttaatacctaaattctaagaacctgaagggacatcaagaaataatttaatttgatctacttttaggtcatggttttattcaaataagaaaatttgcagaatatctagcctagatgtctctgcatttacgtaggtatgtataaaattataagtacatttttatatcagatatatcaatattttgtgaagaaaaagtaaaaagaaagaatatgctgtttgctgtatgttctagcaagcaaaagtgtagaatagctgctcttatgccttgcactgccttttcagtttcaatggaattgagcagatatatattgaaaaactcattgtgtaatattctgaggactaagcctcgttgttagccatctgttaagatttcattttaaagacaaacttgccttctactctttggggtcacctagagagctgcttaaattgccatcttcttgctcttcttttaatcgacatcttgttaatttttctgctcattctcttctcttgtttctttctcccatttgcattccttatgacttgatttcatttgttcattgatctttggcatgagtaggagaaaaataatttgttgaatgcctaccgtattacagatttttatttatgaagattgcttgttctctgatgcaagttcttttacccaacatagtgacaaacctgatcacgtattttccattttctcctttgagttagcattgaaaatatggagcccatggtttgatacgtatttattctaccacagcaaaattttaatgattgatagctcacttcttaagtgtgttccacctgccacttttgcatctaccaaaaaaagtcatacattatttttgcacattagccatagtatgtaaagcccaattaaaagtaagccatgcgttgatgcaaaaagcttattatgtcttaatggaaagttaatatcatggacattcaatgtgttgtgtaattgatttaaagcattgatagcttaccttatgttgtgcttcatattttcagaatacttttcaacagacatttctctctcttgccccttttcagtctggcagcaatagactgcagtgatttttttatttgatgttctggtttatcactgccacttgtgcaaattcaagaaagttgtcaatgatgtatttcttggcccatacaattaacgaagtgttggcttgatctcttcctttgacatacaggctactagatgaacatggtagaagtctgtggtccctgagtcattttgttgagcaggatttgttgtagatgtttaaatgcatcctttctgaaaattatgatgttttttttcttaataacacatcttttaactcccagcattttgtatgcatttagttttacatatagatattttacaagtagaagttatacttgtctttctatagtttccaggattttctttttcctttgttagaggtagccatcactttaccttcttggaggcacattttaagtacacaggagagaaagcagtaagaaaagttccagaaattacttgagagagtaatttccaagtacaagataggactgtttctagggtaggcaagaaggtggtttatgtgttcatttgtttgacagctgtgcctatttgtttgacacttgtattggagacattcatgttagcttattgttttccttgaaatgcccacatacattatttgtgatgagacatcattttagattttttaattggatgaactagttggtacaacattgaggaaatgattgaacagatagagtggctgtgttctaagaatgcctcatatggcatgggttataatgaggtcattgggacaatcaagtttagcactatggagtgtctagagtggtgctacaaaagaaatgcaatgccagcagcaaacatgagccaaaaaatgaaatttcagattttctagtagccacattaaatgtttttaaaataaaattaattttagtaatgtattttattcaacagtatattcagaatatcatttcaatgcataatcaatatgaacatgattaatgtgggtttttttggtgctaattttttgaaatccagtgtgtatcttgtacttacggcacatctcaattcatattagccacttttctaggactctaactatacatggctagtggctactgtattggacagctaaagtctagagcatttggtgaaattgtgaaattgtgatgatgccaggaaattggggaaagcataagaggagcaaatatgaatctctaaggtagaccttgtgcagggaattctataggaaattatatacttttgggagagagacagaaactggtgtggaatgaaactttgatgatggtgaaaccatttggaaaatgagaatggcagagattcaatagaaaatgaaaataggaaacggcagaacttgacaatgcttaatattctatgacaaggccaaaatataatagttggttctttttaagaaaaacatctttttcatccaagggctttttagcctaggctgtgtctgtgtagcctggaggagagaagtagttattcatgaaacacaagagaagccattgagatcagcagataaaattgattgcagaggaataatgtggatagcagcgtggcatggaggatgaattatgctaatatagtagagaggaagagtctgaggtaaatgattgatttttgtaaagtaagaactggacaaagttcttggtgacttaagagcaaatgaaagattaggcagaatactatatcagaatttattgctttgacagtgaaataagataggacctagtgatagggactttggtcacagtatataagtggttaagagctcatgcacttaactttaatccagtcttgaccacttaactttgcatttctttgcaagttacaattatccaggtctcagttttttcatccataaaatgggcagaaacacctacttcatagaattacatggattaaatgagattatatatgtagcaactttgactagtatgacacatcttcctgttatttgtcttagtttgggatgtccagaggggaaaaaaagagttaccattgtgttttcttggaatacatgtttatatcacatcttctaagttgttaccccttaaagcagttttcagagttcagcttggtgaaatctcttgattatttctcaaactgtggtgtgaggacctccggcattagaatcactttggttgttagataaaaatatagattcttgagctgcacgttagggctgctcagtcagtctctgagagtagaaccaaggaagttttattcaacactcaaatatagctgttgcatatcacatccaattggagaaccactagaatggatgattctaagatctggtttggttcaagatgaatctactacgcactgtgttaatctagagtaggagttgggtaggaataataatacctattcctgtttacaacgtaggattgttgtgggggatgaaataagatatttttaagtttgtaaaagtaggtttaagttaaaagatatttgaagtttagactcctgtagattgtaacatctaaagggcagtgacttttctgtactaggtgagtctaggtggctcatagttgtcattaagtagtttttgatgacaaatttcctgtccaccaaattatgagcttatttttatctctttcatccacatttaattttttgcttattttacttgtgtagaggcgaagcgggattatagacgttcaaaccagatggatatataatttgaaatattaatatctgtttaaatttagaggtttagagtgtgtcagtattataaatttttttctcacaatctctgtaactcattaatcatttaaggtagattgttctgtttaaggattatctgtaatctacccataatactcttttccatcagttaacctcttctgctctcaattaatgataaaaccaacccagaacaaaaagccaccctaccgtgagtgtactttatggggataaaatacaatctcccattttctccatttccagagagatgtatatgctctcttattgagcagtgtaactactttgtgttcattacagtgtttcgtgctttaaaaatttttatttaatcctacacataactaatagaatctcttttttcccctgtggaaataaaaaaactgcttattaaaaatgcagagccccagacgaacagtacactttgagagaatttcagtgagtctggaataggcctgcaaatcagcattttgatgattttgatggaggttgtgcactgtgagaaacattgctctgtttcttattacctccagaggcataaatatgtaggtgctgtctacataaaataaattaggaatggtatgcttccagcttgaaaatgaacaaataaatgtacatcagaactccatgtatgttggtgtatgtttcacataggaactgaagatgatattagcacagatgtcagataaagggacaaacctaccatccacaggttacaagtgtttagtattacagaaaacatttttataaaaaggaagatcataggacatgtaacctctcaaagtttatacttctcagccttcccttttaggttagcttcagggatctagaaacattaccatccattacagaaaactgaaagattatgtggcaaaataaacagggaagcagaaatagaatagacagtgtacttctgttaagaaaaagtacttacattaagaaaaactattgagctttattagatactgagtactgtgctcttgcaagcatcttctacagcactagtgttcacctcttaaaagcattaaatgatactggcattgccttcattcccttcaatcctcagtttttggtcctctttcctcttcctaatttaaacagtctactcactgttattctattcttgtaatttgtctcacttttttggcttccatgacttcttgcttttcttttttattgtatagtataaatacaaaatgaataaaacagcttctaaaagaaaatttaaaatatgtatcaaaagtgagcaaaaaatttaaatttggtttaataaaacccattttctttatagcagtgttgctgttttttcttttaggtatttaccccaaaattatgccttgaggcatatgcctcaaggttgaggtatatgccataaattgcttatttatatttttaaaatgctaatattaaaggctaagatcttggactgtgtggcacctagggacataattctcatcagcctatcactgtcattcacttcatcagaattacaagggcttttaacacctgtagatatgtaagttcctcttgcgctttcattgcagttgtttcctcttcttaatttgtttttaaaaagcagaattgttcttcattagaaattggagcaggtggatgaaagtgataaacaaggagaggatacgtgagttccactaggaattggtcttaaaatttagtggaaggccagggattagaattggtgacccctgactcatctgccagccagttgcttaaattgagagcagttctgatagacacagttgttccttgtgtcctttcaactacattttgtcttctatatgttgctcctgtcccttcaccatgtcctcattgcacagatacgccactgagtttgaaaagggataactggtagccttattagtaaagctgctgtgtctctctattcttttactttcttctacacgtcttgatcgcaggattttatgctctgggtggacctgaacgtaaaagttggccagctgtggccttatttagtttttggtattccaaaagtagcttttaacatggagaaaagtgccctattatttgaacttttttgaatcttttggtatctttcagtggcccactagtaagaatttttttgtcttatgtttaaatgtttcactaatagaagactgggaacagttcccaataattattatggttctgtggatctttgttttttaagaaaatgatggatgtaaacatttctctgaggaaagaaatgggggaatgacattcaggataggttgacaaaagtcacaaagtttttttcaagacatttgttttattaaaacataagcaaggtgcttgctttggcagcacatatactaatatcggaataatagagaaaacattagcatggcccctggtcaaggatgccatacaaattcatgaagaacataagcaaagaaagatatatcaccttgttaatttaactcttccactgttgaatttaaagtaaggagttaaactttgtttattattctttagttctacttttcctgaacaaaaaattgcttttactctttgcttagtaaacaatttttcttattttattagttcacatagatagtaaaacttatcagtcattgattattgttgaagtaaacatgacctttcaagtgaaagttatattagtgaaattgataaaatttgtaaactaaatgtgagtaataggctttacagatgtttatatgaaagctttctgtttctgtagggggctagtctacactgtgttgtccatgttctgttgctgtgtcttatctatgttctgctgtaacttcgatccttgctttaaactttacatttatcatgctgctttttttactcttcgaaaactgtatttctcaattaccgactatacagagaaatgtgaatacttatagtagaagctgttgcctgtagtatgtgattttttttccattaaattatgagggcaaaatctatagagctactattaaaataattctttgtggtaattaacataggacagaactgtctttttgttagattttaggcagtgttaatatagcaagactataaaagtgtcagagaaaaattttttattttggtttacaagacagaattaagctggatttggaggaaatgtttttaattgtaaacgtgaaagatttaaattaaatatactttggaatattaaacaaaaacatgtgtgtgaatctgattttattattcctgctactcttcttttatagtacttacgtaagccagtatcgaaaacaactttggtgattgttgaaaggtgttgggttgagatttttacctttaaagtggacagacatgacttttacaaataagacttttacttttttttttttattaagaaagaggccaggaactatgaactagatttagatatttatctgatttagaatgtctatctgaaatttttggttgccttttctctgagtttgaggggaagactgcccttgttttgtgttacagtgacttagggatttttagagaaaggttattaaggtctttcctaggctgggcatggtggctcatgcctgtaattccagcacttcaggaggccgaggttggtggattgcttgagctcagaagtttgagactagcctgggcaacatggcaaaaccctgtctctacaaaaaaatacaaaaaaaagccggtgtggtggcagccacctgcagtcccagctatttgggaggctagggtgggaagatcaattgagcccagcaggttaaggctgcagtgaactgttaccatgccactgcactccagcctgggtgacagaaagagacctgtctttaaaaaaaaaaatctttttttggaggaaaaggtaatggttatagaaaaatcatataagcttaactgattattttaatttgttaagagtttagagaatagtatgatagtttcttgggagtagaccatatggtaaatgtatgtttttcaaacttactaaatgcaatcaaactgttttcagtggttcaagaagtatttgcaaattagagatgatattttgctttttttcatttcattttgtgaactggtgataactgtttttcaactttgttttactctgttttgtgttgctattacagaatacctgagaggaggtaacttataaagaacagaaatttcttctcttacagttctggagactccaagatcaaggcaaaggcatctggtgtgggtctgtttactgtgtcctcacagggcagagggcagaaggacaagagacagcccactcctaaaagccctttttataatggcattaatctgtgacctaaacgccaccattaggccccacctctcaatacactggcaattaaatttcaacataaattttggaaggggtgaacatttaaaccatagcaaactttttcaaacattttctcaatgtttaagtccactccattatctcacctattaaaaggaagttagggatggggagaaagtggtagaaagaatgtatcaaggcctgagatagtttgatgttcaaagagtgtccacttgtctcatgtgagttgaggctaaagaagagccaaactgtggaaaggcctgtaagatttgttaaagattttgattttaaggccaagggtagtgggaagccattgaatggctttaagttggggtagtgacttgattttgtttgctttagtaaattgtctgacttgtgaatgaagaactgattagatgggataaaatggaagctgggagaccagttaaagaggctgttgctatagtccagggagagatgttggtgacttgcagtaataaccttccagtgatactcacattctttaaaaatctaacttagattttctaattctaatgcttatgccttaaacctcttccctgatgttcttttttgttgttgtttcaattctctataaattctcatttgacaagctagataacatggttttattgttttactgattaagagtgctagtataaatgggtgatatctttatgactagtatgaattcctttatagagggtttatttactttctaaggtatcattactacctaccatcaagaagctgttatggttgctgctctgtattatcaagcagtgatgactagtaagcattttttattttaaaaaaaattttttatagtaggttcttgctatgttgcttaggctggtgttgaactcctgggtgtaattctcacacctctgccttccaaagtattgggattacaggcatgagccactgtgcctggccccagtgacattttttaatgccaactcaggatacttcaatcatttttttatatttctttattaatctttttattttctaaagtcagttttaagacaaaaatctactctttccagaggtattaacatgattttaaaaataataaagtaccttgataaagatgtatacttgaaatcctctgtctttatgatcttctagttacttgtctatcattccttccttctgtcttaccttgcaggataaattagaataggccttagttgagtttcagaattattgaaagatttgtgagttcttttactttctacttgttgtgtcttttgaaaattgagcttctcatttttctcttcctttcaagaagttagctatttctcaaactttggaattacttttttactatttctgcttaatacctaggttgtcaaagtgcctgcaactagtatgacagcattagatatttgttgaatgcagaagatgctgtacctgtgtgaaagacctagtgtcctctaagatttcttgtagcatgtcaccagaatagatttcaaagtgtcctgcccaggggtggaagggctagaaagggtaaaattttctcattctgaaggggaaaacactgggctcctatttttccctctttgtttaatggaaatctatcccttttataatgttatgagaagcttacttatattggttaaaatgagaagaaagcaggtcttttcttaaaaccatttcccctaccccatttttaattattaaaaaggcacagggaagttgagatctggaacattttcaggctttcttggcctgtcctagcaaagcagtcctaaatgtggtcccaggtgttattcagttgaatgataaatccgaagttttgtgatttgctcttttcctggttcctgttgttctatatatactttttgtatttagggaagtgaagttttttgatagttgattttaaaatcagtgtctttattctgggctaccaaccaaataataacaatttgaagtatatttcttcccaaaaagatgtcaagtcatttcttaagagtgttagaacagttacctttaaagatgaaatgattcttggttctgatgccttcatattgtaatttttctgcctgtacatcagtgtgtctgtatctgtgacttgaattttttttttctttcctttaggtctttttggagaaaacattataatggatgtctagttatttagtaattgaatgcaggttagttagcatctttttttttctcctctcaagaagctgcttagtgtgtgtgtgtgtgtgtgtgtgtgtgtgtgtgtgtgtgtatgtgtgtgtgtgtgtgtggttttttttatattagattgacagggcctaaaatgttgcattgccaatatagaaattttatttgaaaatttattcttttttcatatatctaacttgtctatcattaagtttgtgagaggataggacaaaaagatgctaactaacctgcattcaattactaaactaagtaacaacaagccctatgtagagtatcttctgtatttagagaaaggtttaagaaatttaagtcctctaaaaattttgttaatacaaaaatgtaccgtttgtgttgaactggatctacaatttaagtgaattaagaaacaaactattaagaattattttaaaaggatggttgcttgtctcttttataaaaggaaattctaccattacaaatttgccactctctttgggactctaaaacttttatgttgaggcattttaagaaagagatttgagaaattgattgagttattcaaattttggtctgtatccaggtagatatatatttatttggagccatctatgtggggataattagtcatttaagtgttaacaatattgaaatacgttttggatgcttgcctttgtaatttgtcaggaattaacattagaagaccttaaataacgctggatgcagttgctcatgactgtaatcccagcactttgggaggcccagtggggcggatcacttgaggtcaggagttcgagaccagcctggccatcatggcgaaaccctgtctctaccaaaaatacaaaaattagctgggtgtggtggcgtgcgcctgtaattccagccacttgggagtttgaggcaggagaatcgcttgaacctgggaggcagaggttgtagtgagccgctaagattgggccactgcactccagcctgaacaacagagtgagactctgtctcaaaggaaaacagcaacaaaaagaagtccctaagtaactagtggttaaatgttgacttccaagtatttttactctccttacacatgccacatgcacattgtctagtgccacaacatataatgtttatatttttagtttattctgtgctagttgtgcttttagtttagtaatagaaatatattactttagttagatggatggaatcttgtaatgttttgtcagactgatagtaagtactaagtatggggtattacagacaagaggaaaaaaaatttctgggaagaaagccagacaatgtttgtgttttcctttagaagtgattgtttggtggtgggaaggggcttagtttaaaaaaaaaaaattagattgacagggcctaaaatgttgtatggccaatgcagaaattttatttgaaaatttattctctttcttcatatatctaacttgtctatcaaaagtcttttgggacagtgtggactttatgataacttttgaacagtgttacctttcataatgcttaaaagcaacccagggcagccaaataggaaaggtgactgcctctaggatgtgtatcaatatagaaaagaaaagatatcaaaagactcaatgtgtagtaaaatgagtttttttgtttttgtttttgtttttgttttttgagacggagttttgctcttgttgcccaggctggagtgcaatggcacgatctcagctcaccacaacctccatctctcaggttcaagcaattcttctacctcagcctcccgagtagctgggattataggcgcacgctaccacacccagctaatttttgtatttttggtagagacagcgttttgccatgttggccaggctggtctaaaactcctgacctcaggttatctgcccgccttggcttcccaaagtgctgggattacaggcatgagccactgtgcctggcaaaatgagttttcaagtaggaaagaaactacataatacacaaaagtaataaacaagacattgagatttttttttaatactcataatcttgcttcttaaaagttgaagcaacatagttatgaaaaaaactgttggtgattatggcctgttaagtgattctatatccattgttatttaaggtcattatgaattatcagcttaccatcttctactgtatttaaagctactctaatatatattgttaattttcttcattagctggttttaaatgaccaaatattgctttgatggaaatgtttgtgatgaggtttttgtgctttgttttatttttgtttttcaaatttctcactcttaacattgctggttcctcaaagatgatttcacattatcttcatagcaagcagaagtgatccatttttactctttctgtgacagattgatgttttattaaaaagagggcctgcatcttcctaagtaaaataaagcactaaacaaacccttaatgtaggtagtgtcttttcagtgtaattgacacttttaggttggtttttgcaggaactagtaggaactattgtgtgcatgtttgtttccttaatttttttagaagctctgttctgattttgagaatttaccttttatctcttattcttctaaatttatgcccgattttgtttttttgtgcatttaaaaaactagcctataaattctgttgcaagtattggcctctagctgcagtcaccattatcccttctccccgcaaagaagaacatctaatgttagaaatctgttttgcacagcctagttaaaacttgtatttacttgtacctgttttgatgtaattcatcttatgagttagggccagagaactgcatggaactattttaatcttaaaacccgggcatttgtagatactctacacattttgtggctgtaggcaaaaagaattttctgttgtgtgttaggtatttttgaagatgcctaacttattctgggcaatatacagtgtatctttcatgacagtaagactaaaatattaggaagataattagcagtgaagtgaagcataggataattatgtatagaagcaagctttgttttctcagaagtttataagataaaacatttagaaacagctaactacccaacccaataaaccaaatcatttttatcttttagtttcttatgcttagggaaaacaaataagggactgtggaaggcaaaagcttcatctctgtattctaatttgacaatgcatttgatacctgtggcctttcagcatagatattgtataccccttgtttttattgggtagttaatatagtgtcctgagttttgttctgttccaacagtttactcattgttttctgattaatctttaaaatactacctctattcttttgatgacttccaaacctctcctggctatacccaatactacagaatatagaatgctgtagtccaatgagggcagtcttgtcaaacactctggttattcacaaccctgtttatttggtcttcatcttcccaacctctgtttaacttacagttctgtgtctccttaatagccctgctttagtttcattttctctgcaaagccctcttttttcttactattctaggccttgtgaattgttgatttagtgcaaatgtaactgaattcctatactgtgctaggcactgatgatacttcatctgcatatgtccagtattaagcaaagttttctctaaaaaaaaatttctaaaaaaaagtcatcttatatttgagtccttaaaaagtttttcatattttgagctctctctcaattattttattttgaatagaagtatagtatttggagaatatagaagagcttgaaatgatgtcagtcagtacttgttttaaaagtctgtagaggtttcctgagggaatagataaaagggtatagtaaaaagtttaaacaaattagaaattatttgtgggcagggagttatactcttataagttgttgtgaaaaaagcctttacaatcacttttaaaagagatatgtaagcagttacattgtgaagatcatagtatgtacctgtagcacaattaaaaaaccaaccatcttagaatcatgtgaatggatatttgtggcttggaaaaacattttcaatgatggtattatgacttctaaaagtattgtttctcagaacaacttaaatggaagtaaagattattcacttcatgatacttacaggtcactcaaaaagaaagtaacgagatgatacttggtgaagatgtaggtaaagtttgaataaagttattttgtaaaatttatgtgctttgtgattttaaaacattcataagactaaattaataaaagtatatattggactgtatgatgtacatggaaaggtttgtatatttcaaattggtaaaaatttaaaaaaagaactttttattggggaaaattgggaaatcctttgtgttgagatttgcctggtactcatttatttatggtagcttgcaagtttctgggcagtaggatgattattaagcatagtcagagactgttaaataatacctactgaactaataaaattttgtatacatttactgattgatgccatgaaagattgtactataccagaattttccaagtacctaaaatcattcttttgtatagtattcttgatacttaaaaaaaactatactgtaagatgttttggattaaaaccatcattcaatttaatccatcttctatagctgattctttggacttgtggtttgtccccagagtggcaggagcaatgacacgtgaaagggaaacaagaattgctttttaagttggatttattacatttgaaacttcattaactcttcccagaggactaagttgcctgtggtaggcacaagtttaggaaagagattgtttcatacctctttatactgtttctcaatgactttttgatgatttcagacagcattagaatgtttttccagaaattcctcaaatttgtaagttcccgaaacagttcttatttttctgcttaacattggttgcatacataggagaattgtgataggtaagctagtcacaggactatgaaagatattgtcatcttaatcagaaaaaagtgtagtgaaattgataattgtaaaagatttacatttcatccacctgtttcaaagagtagagggaaatcagtagtagttgagtttttattcagttataatttgtttttgcattttatcattcattaagtactgtttgtgttaagaactcaagtaagatggatagtcttagaccctagtggcatcttttttttttttttttgggacgtttgttttacattgatttaattcaaagctgcagaccccaaaaactccttaatgccaatgataaaattgttaggtatttcatcatattgagaatgacacattctaagcaactataactgtactgtacaagaagacaaggctgagtgcttggctcacacctgtaatcccagcactttgggagtcagaggcaggaggatctcttgaggccaggagttcaagaccggtctgggcaaaatagcaagaccttatctatacaaaaaataaaaataactagcagtatgtggtggcacatacctgttgtcctagttacttaggaggctgaggcaggaggatcgcttgagcccaggagctcaagtctacagtaagctatgattgcaccactgcattccagcctaggctatagagcgagatcttgtctcaaaaaaaaaaaaaagtttaaagaagggaaactagtgaaaatgtgattaaagaatgtaatagatggaacagtttgggaaaaaaagaactctttaattttatattaagctacatccagatattttttgattgactacatctatttgtcaatttaccaaatattaattgaatgccttctgagtttcaagaattgtgctagatattagggattcagtcatgaaaatattacactatttgcttgcaagaagctgacagtctggtgaaggacattccattctatcaccaccttctatcttctttctaaataaagacgtgtcagtttaggccattctaactcatatatcttctctggtccttaaatcaggtatctatcattatttttataaaaattaattttttaattgacaaataattgcatatatttattatcaacatggtttgaaatatgtatatgttgtgggatggctaaatcaaacaaattaacatatctattacctcacatatgcagtacttattttttatggtgagaacacttaaaatctaaccccaatggaattctgacatgtagaagaacgtatatagacaactgatttaaaaatcagtgagtaaatataaaacaattacattggattgcaagaagtgtgcactttgggagaaggaggagtcctgattaaaagatttttaagattttattatgcataccttgagaaaacttggaaattgtcaccatatgagaggtttttctgggaggctttctacaagagctgggctttctggaactactgggataatagagtgaggacattcaaaatgtatttgcctgaaccatgtctgattgctccagctccatttgttggaaaagctattccttttccattgaattgcctttgcttatttgtcaaaaacgaattagacgtgtttgtatgtagatctctttctgggtcctatatctttttcactgatgtatgtttctgtccctctgtcagtaccttgctgtctttattattgcagttacattttaagccttaacgtcaggaaagcgggtggtgatttctcccactttattattatttttcaaaaaagtttagaatatacttgtttacagtgaaacttgctgagattttgatatgaattgcattacacctatccatcaatttagggagaattgacatctttatgttcaatcttccaatccatgaacagtttgtctttccaaatgtttaggttttatttgatttctttcatcagcattttaaaattttaatcatagggatcctatacatgttttgttaaattatacctaagtgttttatttttcttcagagcaaccgtaactggtgttgcatttttaattttagtttcacttgttcattgtcaccaaatagaaatgcaattgatttttgtgtttcgttcatctatcctgtgaccttacttaattcgcttattagttcgggggctgctgctgctgcttcttttttttttttttttaaagattccttcggaattcctccgtataccagcatgtcatctgcaaatagagggagttttatttcttcctttctagacagtatgcccttaagttcttttccttgccttattgcagtagttacaactttcagtactgtgtttcagtactgtgttagagtgttgagagtgaaattgttgacttgtttctgagctcagcaaaaacatttgttgtttcactgttaagtatgacatcaactgtaggttttttggtaggtgctttttatgacattgagtaagttcccttctattcctagtgtactgatagttttttttttattgtgaataatattcaattttatctaatgctttttctgcaaccaccgatatgaccatatgatttttcacttttagtctgttgatttgttagattgtgtgattgatttttgaatcttgagacagccatgtatgtctggagcagatcccactttgctgtgatgtaatacttttaaaaaatatattgttggattctctttgctaaaattttgttgaggacttttgcacctaagttaatgagagataccggtctgtgtttttctttttgggctttgtttttgatatcgagatgatactggtctcataaaatgagttgggaagtctcttttgtttctggaagaggttgtataaaattggtgttgatatattaatcatgtttttaaaaaacaaaacttgaattgtcctcagatacagttgcttgaggtgaaaattttctcatagaagtagacttttggccgggcgcagtggctcacgcctgtaatcccagcactttgggaggctgaggcgggcagatcacaaggtcaggagattgagaccatcctgtctaacacggtgaaaccctgtttccactaaaaatacaaaaaaaaattagccaagcttggtggctgccgcctgtagtcccagctacttgggaggctgaggcaggagaatggcatggacccaggaggcggaggttgcagtgagccgagatcgcaccattgcactccagcctgggcgacagagtgagactccgtctcaaaaaaaaagaagtagacttttgcagagttatggtaaaacattttaccaaatttcagattctgtgtattgctattttttttttaatggtaggaagaatgaagcagtcagtactagtcagtaaaccataagcagtactttgaatatagaactattatataaattaactcatactagattatgtgattagacttactgatttactgtaaactgagtgtgaattatggttctggaaaagaatttggaaattgaatcaatctgcttgattttacagatgcggaaacaaggtagtgaggggtttggtaccttgtccaaggtcacagtttgtgaaacagattccagattcaggccaactctattaagccagtgggttttacatagggaggaacattagattaccagtgggtctttgcagaaaaacaaaaacaacaacaaaccccacacatgtgcatatactatattctgtatacattagaagtagcagcccttcttctatagaatacaggtgagacagattaccagaggagtttgcagtatgtcagttcatgctattttttcttccgtagttgagaggaagtccatggcaccattagtatagtgtgtgtgtgtgtgtgtgtgtgtgtgtatacacacatacatgtactctttatatatagtagcatgtatatatatagtgtatgtatgtgtatatttatatatattctcaaaataaacttttcagctccccattcccaggacctacataatggcactcagacatatgaatgtgagaaaatatagaggggattctgatgcacatcattggttaagaactgctgtactaaaccctgcacgcaaaccttttatacttatttatttcttttgaaaatgtcagtagtaactatttagagttactttgatagaataaacctatgggtagagatttaaagtttcagaaaattttaaattgggagatgtcgttaaaacttaatatacataaataaccatgccatcctttttagaactacacctttaaagttgtaatgtaagcttaagaatataaaaatacatataatttacttatttttataatcatgatgttactatattgagtttttttagagacttgatgggatagagactgattgcagaatcagcttgaggaggggtgggaaaattgtcacagcattccccgtaagccattttctttctacttatgaaaaataccactctagtttagatctagaaaaccatccttaatcctatctaccttaaaaaatggtggaaatatctttttaataaataaaatggccctttgtttatcttttttctagactaggatggcaaatacaagacactaatgctgctccccttcccttccaatactatgaaatcctctctaaaaatatcctcaaaatctttcttggtatagtgccctaggcagccattactaacgctgattggaattgactccgaaggtaaaacctatttggcacttttgctctaggcagtgttcaatttttttgtcagttttgtttagtttttggggtgttcctatgcctgagtgggattcttcttttggaaattggaaatagttgcatagtggtttttaacatgaattaaataggtgataattcacagagccccctttcccaacaaaataaacaaaaggtaggttagacggactattgggattaggatgttgttttaagctaggaggtggcagaccgcacaacctatgggccaaatccatcttggagctaagaatgatttttatatttttagatggtagcaaaaaaaaaaaaatccaaaaaaagaatagtattttgtgagttgtaaaaactaccaaaaaaatccaaaaaaagaataatattttgtgagttgtaaaaactacatgaaatccaattttcagtgtccataaataaagttttaatgcaacataatcatgttcattcatgtattgtctatggatgcttttatgctacaagggcagagttaagtagttgtgacagaccacatggcctgtaaagcctgaaatatttactgtctgaatctttacataaaaaaattgccattcctgttttaagataacagtgggggcattgaatattgcttttgtattatttggtaaaggaggaaacttaccttgctcatattttcaacatgtttctgaaaataatttagaaagtgcctattgtttgcatacagataagtggtggtagcagcccttcttttttttgttttttttgttttgttttgtttttttgagacagagtctctttctgttgcccaggctggcgtgcagtggtacgatctcggctcactgcaacctccacctcctgggttcaagggattctcctgccttagcctcctgagtagctgggattacaggtgcgcgccactatgcccagctaatttttgtatttttaacagagaaggggtttcaccatgttggccaggctggtctcaaactcctgacctcatgatccgcctgcctcggcttcccaaagtgctggcattacagatgtgagccaccgtgctgggcccattcttttatacacggttgagatggagttaccagaacatagtttgcactgtcagttcatgctataatttcttccacagttgagaggaagtccatggcaccattactgcccacaaatactggcaacttataactacatctctgtgctagtatattgtagaaccactgttctcaaactttttagtctcaggacttctttagagctcttaaaaattaaagaccccaaaacttttttaaaatagtaatatatatcaatatttaccatatcaaaaattaaagaaaatgtttaaatattaacttatttaaaatagcaataataatccattatgtgttagtaaagaacaagtttttatgaaaaatattttccaaaacaaaaaattagtaaaattacagtctcttaatgattgttgtagtagaagaaaactggattattgtatctgtttctccgttcagtttttgtgatatgttattttgattgaagcatatgaaggaaatctggtcatacacagatacatagttagaaaaaaaggaatagtattttaataatttttttttttggtgtgactgtttttctttgatatcataccataactcaagatatggtagtttcttttctattgttttttttgaagtcagttttatttacatagaataaaatgtgcttttttagatatgcaattccataagttttgattagaatatatgaaccatacatattatacaatcataatacaccctagtcaaggcgtggtgttcctatttccttcatcccacaaagtttcctcatgcccttttgtaatcacctccttttccctcactcccagcttctggcaatctctgagctgatttctgtctgccttttccagaatattatgtaaatggaatcatacgggacagccttttgagtctgtctgctttcacttagcataatgtttgagattcatccattttgttgtaggtatcactagttcattccttttttattgtatggatatttgcttctccattcaccattgatggacataggagtgtttttagttttcagagattatcaataaagccactctgaacagtcatctacagatttttacatggacttatgtttttatctcacgtagatacctacacatgtgattgctgggtagtatggctggtgtatgttttaactttaagaagctgtaaagctgttttccaaagtgactgggccattttgctctaccaccatcaatatgtgaaagttctagttgctcacattttcagcaatacttgatattgtccgtttgtgtttttgttttgttttagccattctaattagtgttagtatttcattgtagttttagtttgcatttccctgatgattgataatattgggtagcttttttcaaaaaaaatttttattctttgctctttggcaaaggacctatttgaatcttttgcccatttaaataattggacagtgttttttcctatgattgacttgtaagaggccgttatattttctgagcatcagtccttttttagaaatgtgttttgcaagtattttcttccagtctgtgacttttttcatccccttagccttcaaagagtagaagttttcattttagtgaggttcagtttatcggttctgtcttttttgtaggtcatatgtgttgttctaagaaatctttcgtaattcagggtcacaaagatttttcatgttttcttttggaagtttaatagtttcaggtattattttaggtctatgatatgtttagaattaatttttgtatatggcgtgatatatgggttgaagttgtttgttttttctttttgtgtatggatattcaattgctccagcatctgtggttgctacgactatcgtttttctattgaattgccttgacatcttttctctacatcagttgaccatttatatgtgggtctatttctgggttctctgttctgtcccattgatacatgtttctgtcttttcactataaccatactgtttttattgctgaagttttatagtaagtcttaaaatcagttagtatgaattctcctttgtacttctttttcagaattattttgggtattccagtttccttgtttttcaaatagacaagacataattttgtaaatgctagttgcagtggggaagctgaaaccattgatgaactttttgtcttttgtaacattaaagtctgctttgtcatgcacattgagtggatttttttttaacccatgaatacttttgtaatatcacaattcatttggaaaatattggttctctgaattatgtagactttctaaatactgtcacatttcattattcaatatttaaaagtcacatttattgatatcaccactgatctcatcagaaaattcttttgactattggaaaggttgacaccatcacctattgctgatggtagtagataaaaattttcaaaatttttattttttgcttgaaaacttaaattttatcattggaaacgcatacttgttagttgcctttcttgaagtcacaggttcacttggtttacttttgagaacatgcctgtcagatacccaagtctaaatagccataggttgttagtttacaactcagtcatacgtgggctttttcttgaggcaaccattgtacagttgatccttgaataacaagggtcttaattgtgtcagtctacacatatgtggatttttttcaataagtatgttggaaaaggctttggagatttgggacaatttgaaaaaactcacaaatgaactttttagcctagaaatattgaaaaaattaagaaaagatatatgtcatgaatgcataaaatatatgtacaaaccagtcttttattatttgctaccataaaatatacgcacatctattataaaaagttaaaatttatcaaaacttacatacacacttacagaccatacatggcacagtttgcagttgagagaaatgtaaacaaatgtaaagatacagtattaaattataattgcataaaattaactatagtacatagtgcactactgtaataatttcatagccacctcctgttgctattgcggtgagctcaagtgttgcaaatatctacttacaacaccatatgatgctaatcatctcagcttgagcagtttgtctctccagtaaattgtatatcacagtaaaaagtgatctcttgtggttctagcatatttttcattgtgtttagtgcaatgccgtgaaccttgaataacaccttgggacccatacaaagtgccactcttggtactggaattgctcctgagaagagaaaagtcttgacattacaagaaaaagtggaattgtttgatacataccatagattgaggtctgccgttgtggttgccatttatgatttattttgtgaacagaaggtgtaaacttacagtatcgataaatacagttcagtactgtaaatgtattttctgttccttatttttaaaataatattgtcttttctttagcttactttagtgtaagaatttagtatataatatgtataacatagaaaatatgtgttaatcgactgttgatgctattggtaaagcttctggttaacagtagtctattgggaaagtttttggggagtcaaaagttacacactgatttttgtttgtgcaaagccagtgatccttacccctgagttgttaggggtcaactgtagtcactatgcagcagagttatgtttgcttagtttttgtcccacacaatattaaaaagtagtctactcaagggccaaggtttcataaaattaacaatttctgtggcttttcatcaaggacattctcaagtgaagtgaaactagtggtgttcagagaaatactgtgatatatatggttatttcctattataatggctatttttatatttaaagtacagggattaacctggaaacctaaacccaaagttataagtgggaagacggtgaattactgacactttaggaatacctaaagttgctatcttgggaaacagtcttttattttaacagataatgtggttatattattgtttttattatcttataggtgctatacttggtagatcagaaactcaggagtgtcttttctttaatgctaattgggaaaaagacagaaccaatcaaactggtgttgaaccgtgttatggtgacaaagataaacggcggcattgttttgctacctggaagaatatttctggttccattgaaatagtgaaacaaggttgttggctggatgatatcaactgctatgacaggtaagaacacatttaagattttatggtagtattgagtaattttcacacttcccctctttttgaaaggggaaagatcagtgcataaattttcacttaaatgtttcttgctttttaaaaaatgggattataaagaacattataacatgctgtaatgacagtatattttaaagtaataaacatggcatatatatgttttatctttgatatattttgaataatctacccagtagtgagaactctgaaataaaaaccattttccccaatattgttacgattataaacttttaaaatgccagttttaaggaaaacatttaaaaaattactttaaaagagtatatctgttgaaaatctgtcctcaagaagaataaaacttaatcatgtgtttaattttctttcagtttccttctttatgtatctggaagaaattgatcttactacattcccccctccccccgccccttttttttttcttgcaaagtaggcctttcgctctttacccgaagagactttttatttttgagacagatttcgctcttgttgcccaggctggagtgcaatgatgcaatcttggctcaccgcgacctccgcctcccgggttcaagcaattcttctgcctcagcctcccaagtagctgggattacaggcatgcaccaccatgcctggctagttttgtatttttagtagatacagggtttctccatgttggtcaagctggtctcgatctcccgacctcaggttatccgcctacctcagcctcccaaagtgctaggattacagatgtgagccaccatgcctggtctaccccaagagacattttaacttgacattcagaatttcatcagaactaacagtcctcaaactacatacttgttttaattgctttactctgtactggaagtaaaatacagtggtcatgttattgactgcctgtgatctttctgtatggagtcccatagctgttagggtgatcccttaactgcctgggccacaggatttctactgtgggtaggtgctgaagacaggcagaagctgtgaagtcctagataaacagacattttggagccaaaaagtactgctgtatacagtgaacactagatacttctggatcacttttgagagcctcagttgattacctggaatctgtgtttgattagctgtatgtgactaagagcaaaatgcattgaataggcccttgaaaattggattaactacactttttgtgagaaattacaacacagtcatttagatttagatatatatttcgtatttagaatgtacttctaagtatgtgaattttccagggattatttctatgtacttatatattttagctgcatttctgattatcagcctctgctaacagaagtggtcaagtgatatgtgctgttacgaaaggtacacaggaagaaattggggaaaaatgagtttgggaatcatctttatcccaaactatcttttatcatttagttggaatcagggattcctattcttttttgtagtagaaaactactttgctctttacctaaagacaatactccagctatgtgagactcggatagtgccaaaaagagtagtgagccattttcactggagtctgcaagtgtgttattcattgcaaatacttgctcttagaatggtaattactataccatctttgtgtctggaggttaaatgctaattttaaactataaaattttgtttttatactctaaatttgattgaaaacaaataggatagtaagagaagtaagaggaaaagaagattcaagaattgtcaaagtgtggaagaaaagaaaatgataaaagaagaatgaaattgaatggtgaaaagtaactttattgaattaattaggctaagtaatcatgttaatctgttgtaatttgagacatgattttaaatatgtttttaaatttatatatttctctttataaattgttaaaatttagctttcatttatctttaaaaacctcctgccaaatagatgttgatgttgagtatattttagtttgattttgttaaaactcctatctccctgaaatttcttcagcttttcacttaagaattaaattctaccttattattctgacaactatcaaaaaagttcagtttgttattaagatacatcttttaagttcatctgatgttgattttttttaatagttttagctgtttattagtggctgattaggatttgttctagaggctaaatccaggtcttttcatgacttaaggtcctatataaaaggctactttatttttatttttttggtttaattctaatccgtttgagttagtaggtgctatgtgattattgtttacgtgtttgttttctacttattgctgctcatctcaaccctgttcattgcattcagggaatttaaatctacactctaaaaaacagtgacagtattaatttctcagcctagtttgggtttctgatgttgaaatgtttcacccatgagatacgagcttttatcacttagcatgtgtgtatgtatttatatgtatacatacacacacatacacagttttatatatagttttcagtttttgtattcacagaatggaaatgccatatttcctgtgagcaaaagcactctttgaccaaattgcctcattgactttatgtcctcttcaagcttttctaataattaaaaaaataaaaaaagatgcttgccttaggttgctcattaaaaaccaaattacagcaatagtctctagtagtcagtgtgattgttataaaatcagttgttaatttttttttcttaagagatttagtaacaggaatccaggaacatttttggtttttaagaattattagatataaatacgaatcttgaagttgaatataaatgactaatttattattttattgcagaataaaaacacttgttgtagggtcagtataataatattgattttaattattttttctctgcttatttataggactgattgtgtagaaaaaaaagacagccctgaagtatatttttgttgctgtgagggcaatatgtgtaatgaaaagttttcttattttccggagatggaagtcacacagcgtaagttcacagggaaaatacgtaggtttgctcaactgtagattggaaacaaaatatatttgtgttgatggaataatttgcccctacctcttccccaaaatttgagactatgacagatatttattatagaattttgtagaccaaatctgagttatttttcccccccttttccacagccacttcaaatccagttacacctaagccaccctattacaacatcctgctctattccttggtgccacttatgttaattgcggggattgtcatttgtgcattttgggtgtacaggcatcacaagatggcctaccctcctgtacttgttccaactcaagtaagttattgtcctgtactttgtagtgttttaaattgtatatttttgagaaatattactgtggtgaaacccactaacttattacagattattttcctttggagttaatttttgaatgtttattgtcatgagaactctagctaactttgcaaacttattaatgtacctaccgtgtccttaacttttctcactttagggttgaggtcgagtagaatgaagggatattcccatttctattcctctttggagagttttactctcatgctaacactaacctgctttgcttcttgagaagtcatttatgatggagaagtgaaatcataaccctgtctttgccctctgtcccctcctccatttctagatttctgtgcctttttcaagaccacttggcaaaacattttatccatggggatagacttaggaaagtaaccaaaaaagtatagaaaagagaggtttcataaagccttcaggaagatacctccataaagatgtttttgtagggaagaggagcagaaaagtaacctttcttaccatatgttgttggtagatcaagtattttttttggttgcctcatatcaagtgtgtactgaagactaaacacttcttttaaggctcttgattgtcacacatcacaccccaaatatttctggaaatataggtgtggagagtaatcagattaaattcattaaattttctacattctcttatcatgtagacactttgtgcaggtctggtatttataaggacttttcatggaagtagttagtattctacaggtctacgaaaactgataacttttggttttacttgcttgagacatctctgaattgtagtttttactgtgtttcttttaactcttaagatcacattacctcagccttctgaatctcttggtgtaactttgcttctttaataccagaaggattaatggttaaaacttgatagaaaaaaatggcaaagtcctataatttaatgaccaaaacaactccttccctctaagctttatttatataacacatttatttctcagcgcttgcagcaatctgttagcattagatcatggattcccataatccttgtaagatgtgtatatagagaaataaacccaaaggtaaaataccatgttcggtaattaggtaaacattattttgtacaccttgagtattttaacttttaaacagtagtagctaagtttgtgttcattaagaatcatttctaaaaagtgttttaaaataaaaagttttagtacctagtctatgtagtttactccaaatggccataggatacactttaccttctgtcagtgataacttttaaaaaatttgttttagtatcaaaatttagaagagagagtattcagtattataatagtttcctcagtttaccagatctgtgatatgctaggaacaagctgggaaccacatttataaataaatttgttaaggtttttataggaggagttttaaaatgtaatcttatagataacactgatctgtatacagtattgttacaaaaatgtgcttaaagcttttcttaaagggctttatatcctatgtatgtggtcagttttttaagaaagactaaataatttaagggtttggacttttaaaaaggattgatgttatgcataaataagaaccagggattttctgtgagtatccgtacatctctgtgggttttagatatttgttatggttaaagttactgtacacatttatttagtacttacatgctctgtcatgagtttatatgaatttgtatgaatttctgaaaaataaggaagaaatgtaaagattttgtgataaagtcacctggtgtggtcaagctttggtatgaaaaatacaagacaggcctgactttatgctttccttctgtcataaactatgttgtggaaaaggggcattgtcatcagtgtggaacttcacttttgtcatcttttgcagtctctgaagcagtatggtttcgtgcttcaaatcttgtttttgctgagaggtttatgcaaactgttctgcaagaccacttcgtggccatcatgtaacaaaaggcttagttttatcttctatttcaaaataatgataattacatcaagcatttattgagcattttacagtgtactagggcactgttaagttatattatacataaagatataaattatatgggaacatataaaaagcataaaatattttttttcaatgatttccaagttgtgagactgattatcatctttggaatttgttaaaaaatacaaattttgggaccacactcctgaaagtatggaatggggcatgggatgttatgtttttaataagcttcccaggcgattctggtgaccagccaggtatggaaaatactaatttactttcatctcacagagttgtttatgtagtaaaatctccattttatagatagaaaaatctgacccaaggactctttgacactaaagctttgttcttattacttacgctgttctgcctcttttttcataaagcacatgccttttgtttcatataattcagtaaacttttctgccatctcaaaatcatcctgtaggctaatttattttccttttggatattgaataatttgtatgactactaaaatgaggaataacatcatcttatgtaaacattgtctcacataggacaaaaagagaagtaaagaagtcatagatacatagaagggcatattcatgtgttttccattaaaaatttccaaaaattctaaagtacattttggaatagggttgatgaccctttttagaatagggtttataaacatgtgattgggctgtagataaaaatatctgtgcttgagttgatactgccaattcctattaagactttttcgaagggtaggagaagtaggagagagatatttgaagtcttaaagtgacttctgtatttcaccccatattcacgtccccatatttcaactttacatcagttaggaaaagatcttacagtcttgctgcggatttttggaacattcttcctctggattctttaagtgcttttagacagtgccataacatttgtcattctttttcttagggagactttttctcaaagctttggctaaaggatggtttgtgaatgaactggtctgttgtaagacattgttctcattattagtaagctggttctggcagttaggtgagggattctttatgacatcaaattgtttagaatttttcctggttgtgttagtattttgttctgaagaagtgatgtaggggtataagtactttaaaatctggtctttcattatggttcctagtaaccaatacaaatacaaattctagaataaatttagcacagtcgaaggcatagaaaaaagcagttttctggtcgttttttttttttcataagtcctatatttctgtcattgtttcatggtatcactttattcttattcatcctggatgaaagccttggagacaactattcttggctctgtcatttaccaagtcctgttcattcaccttttcatcctgattgatcctattgtagttcaggacattattactcctaaggctaagattatttctataatctcaaagttggccttcttgcgtccatttctctcccttcatctgtactattgccagaatagcattttacatgtttgattatgttacttatgtgcttaaaatatgtgtgggctctcagtgagccacagcaaagaatacaaagttggagcatgacatgtggtcttccatactctctttgtcttttggtactttcttcccattacaccccaaaacatctgtcatatgcatctaacattgtattagttgtaatcctccttgaaagatttgagaaaatagtgcttgggtcattctttcatttgtcattcatataaataaccccagttgagaagggctcataatgtgttttattctcccactagattgtaagcctcttgaagatgagatatgtattgtaattactgctgtgtcttacacagtatttgtatggaataatcattcagtaagtgctgaattgctaaattgagtttgttgcatttggaattatactgagatgataatgaagtatgtccagggattcctttaataaacattcaggtgctttagggctttgcgttgagagaaatcttgaggccatgattttgtggggggctgtaaaataagttgaagtatttcaggcatttataagagaatgacattattcagttctttctgtaatcacagactgaagcatcctatctgttttcgttacccagctcacttttcttttgcctgtgctgaaactatcttcccacatataggaagatgcttttataatatgcattgagtaaaccgaatgcaaactggtttttctagtgacagtgagtcatgaatatgagggaattgatggactctattattaagaagtcttattgtggttagagttaatgcagtttcagtaaaatggcgccgctttcataaccatatgtgagcttgtttcctgcttataagatctatatttgtgctgataaaataccacttgataagaaattgaattttaagggttagaaatgacctacctttaacaaggcacgaagttagcttcttgtttacttttaaaggctatataagtagcacttcagtattgaaaattaattctttcttaaataacatcagcctgttcaatctttatgatagtttgtctaggtgtgggtctgataaggactaaagctttgggatacctaaattaggcatacaaaataatccttttgaccttagcattaaagtgataataggttgtcatttcatgctatgtcagagtgctattcactgagaaaccaagccatctgtgaaaatgctttgtaggattttcttcttgaacatgagtttatgtatttaaaattaataagaatctgaaagggtaggaaaacagttttcagccaagttaatttagaagagtatactgcttccttactgggggagggtgcaggagaaatttactaaatttattgagtatttaatatgctaataacaagttatacttacaaaatattacattcatagaaacatgtcttgaaataggttgactactgattggagtttatgaacacatctctttctcttctgctttttctctcttcatttaaaattctcttctaattaaaaagttaattataaatacatgcttgtggtatcaagacaaactgtacagaaagacgtatgaaaaaatagaatcattttctcctcttttccctttctctgtcactttcctgaaataatcaattttaacagattggtgtgtatcccttggcacctttctttagccttatttttttgagtatatatgttttcttttttataaactataaactattccacaactggcttattttaatttaacagtatatggacagcttttcagattgatatttttaatcttttgttttattatgtgtttttaagtgaaatgtaatagagttttattgtatgcttatgaaatagcaaaatttgattttttggtaaaaattttgtatatttaaggtgtacaatgtgattttttttttaagcttagagtttgtattaggtttctgcaaagacagaactcacatctcacaaatatttgcaactgtattgttttagtatgtttgaaatatgacataatgctgttgtcttaggcgtgagcattcttttgtgtgtgtgtgtgggtgtgtgtatgtgtatgtctaagaaatagtatagggctactatagatgttgttctgtgtcctaccttggtgtgtgattatttttgtattggtaacctaaattacaacttactttaaatatatacttctaattgtggggagaagtgtcataagttatctcgacatgcaggttgacaaaaaaaattactctcatcaggcatatataatttattccacttacaaatgctcagacaaggccagttggagattgtctaaaattctgtgtccaaaagcaaaaagggaggaaggggagaaagtagaaaatttaaacctttatcaatagcttaaaataaggtaaagttgcacattaaaattaattagtgcaccttatttctaaaagtgacttctgtttaaattttgaaatcttgagttcaggttttctttggcttgtacagggtctcgtctgtcagttgattggtgcatatggaccagactatataatttatcctccttctctggcaaggagatgtgtatttaggaggaagtgagtttgtttttttcctgtgttcttcatttcctggacctcatcctagaccttgttctttcattcctagttacttcattgctgtcaaatcttttttttttaaattaagataatagaaatgaaaaacgtcccattgttagctaaagctgcttgtagcacatgagctaggaattgttcagggttttcatttttgcttaaccgctcactcaatgcttgattgcctatggtgtgccaggcaccatgctgtgtgtatggtaaaagtggcacgaggacagtacttgcttcaccttctggggcctacagttaatatgtaggtgaagtaacacaggatgattgtttgactgtagcctggaaatgaagggtaaagagtgtaagaagtgagttgcttcaacaattttaggcaaagactggaggaagggaggaaaaatgtctatttccagatctgtactgattgggagaggagccacatgtgggtgcctagctaatgctaagtgctcagtaagtattcactgttattggtgttagagtaacagcttcaaaattgaactcaaacagaatcatttttactgaaattattgttgatatatgttaatactttgaaattaacttggtgtaataaaagattcattttgagtattatatcaggcactatacagatcactttacacatattaactcatttaatttgttagtaccatggggttctgtcctgtttatcaagtccatttttttttttttttttttttaactttaaattctgggatacatgtgcagaacatgcaggtttgttacataggtatatctgtgccatggtggtatgctgcacctatcaacccgtcagctaggttttaagccccacatgcattaactatttgtcctgatgctccccttcccttgttcccctgccccttgacaggccccagtgtacgttgttcacctccctgtgtccatgtgttctcattgttctactcccacttatgagtgagaacatgtggtgtttgggtttctgttcctgggttagtttgctgaggattatggcttccagcttcatccatgtccctgcaaaggacatgatctcattcctttttatggctgcatagtattccatggtatacatgtaccacattttctttatccagtctatcattgatgggcatttgggttggttccatgtctttgctgttgtgaatagtgctgcagtaaatatacgtgtgcatgtgtctttataatagaatgatttatattcctttgggtatatacccagtaatgggattgctgggtcaaatggtatttctggttctagatccttgaggaatcaccacactgtcttctactatggttgaactaatttacattcccaccaacaatgtgaaagtgttcccatttctccacagcctcgccagcacctgttgtttcttgactttttaataatcagccattctgactgttgtgagatgctatctcattgtagttttgaagtccgttttatagataagaaaattgaggcattcatagatgaagtgacttggcttagagtcaccctagtgggtggcaaagcctgggcatttatatccaaggattattgcccattgattgaatggcttatttcagtaaataattaagtggagtccataaaaaaaccaaagcaggggctgggtgtggtggctcagacctgtaatcccagcactttaggaggccgaggtgggtggatcacctgaggtcaggagtttgagaccagcctggccaacatgggaaaacaacatggggaaaccccatctctactaaaaatacaaaaattagccaggcatggtggtgcacacctgtaatcccagctacttcggaggctgaggtgggagaattgcttgaacctgggaggcggagcttgcagtgagccgagaccatgctactgcactctagcctgggtgacagagcaagactctgtttcaaaaaaaaaaaaaaaagaaaaaaaagaaaaaaaaagcaaagtaggataaagagatcaaagtatataaactacatttaaaatagttttcatagtgactatatgtggccttgtagataaccattttaccatctcacaatttattcatgtgtaacatggtttattttctggttttttcagctacacttgcagaatacagatatgaaaataaatcaaaataaacttctgtagccagtcataaaacctgattcttttaagcatcaaccccaaaaagagaatgggcatacctacgtttttttcagacttttaactccagtgctggctaccttgaggtgctctacttcttagggaacatatccagaatcttcatttcacctgccttggcctttctttgctttcctttcaagaggagtaagatgagagaaactgtaggaagtaggaattatcacagaggaattttgacgatctaattggctggaatcattgctgtgcaattgacatgtcaatactgttgaatctcttaatgtatgtcttgctttccttagttcagaaacattgtcctcgcatatactgtattatttataaattctgtttctattctgcttggcaggatagtctttttaaaatttaaaatggtaaaatttcttagaatgtaaaataattagttgatattaagaggaaacaaattcagaatttgtcagttttcatatagtttggataggaggaccttaattcgtcttggtagtcctaaaaagttgttgagtgaggtatctccactcccagaaaaaaatcagtctctctctctctagatacagagatacagatatttcttggaatggtttgaatagtaaataaaagaaatcttataacacatatcatatatacatatttatagtatataaacaaaaatctctattttctggaaagattttttgtattccagatctgtgtatgtgtttactaaatatctccatttatatgtctccaagcacttaccattcacaggtagtgattgtctctcacaaacctggttctcagtaaatggaaccactgtccatttggttgcataagccaggaaactaggatgtctcaactctgtttttcaccttaactgcttctccctagtacttactccatttttcaagggtgttctccacagggaaatcttctcagactttacctgtcattataagtcaggtttctctttacagatgttgaaggtactgaattcctttttattagtgtgaattgttgattagtccttctgtcctgcactgctgcaagcttcatgagagcctggctagtcagtgcctggcacagactagttactcagtaaaatttgttggatgaatgaatgaatgaatgaatgaactattcttcattcttttctgatatttggcagtagttttttttccacctcagggagaagcaacaaatctttttctcacctacaaacctaatagcttgatattaatgtgcagattcgattttcaccgttacctacagttatagtatataatagtcaagctacattttctatgttgtgaatccagagttttgtttgctttttgcttagttgtatattttagtgcattttattttgctttatttttatttttggagatgaggtatcactctgtcacccaggcgggaatgcagtggcatgatcacagcccactgcagcctcaatctcccaggctcaagatgtcttccctcctcagacatccgagtagctgggaccacaggcatatgcaaccacgcccagctaatttttaaaaaatttttttgtagagaagggatctccctgtgttgcctaggctggtctcgaactcctgagctcaaagatcctcctgccttggcctcccaaaatgcagagattataggtatgagctatcacacctggcctttaaaaaaattttgctttaccgctcttattttgtcatgtagtttatacattgaggactgttgctggtgtctcttgtttgtttattctaatcctcatttattgagaagtgtattaagcaaacatatgtggttattttgtatttattcatgtacttaagtgaatgtatttttttgttccgtttttacccttcatattttgttgcatagttgatattttgaggcttgttcttggtgtcagtttgggttattttatagcttatcctaatgttcatttcttgggaaatgtattgggcagagacatactttttggtaagatgtatggatagcacctacttgcacagtgctagtatagtgtcatctttatagtgtcatctttatctctgaaaacacctgtatttaaacaagatctgagagatccttgagcctttggaaaccatagtctacttattcagttggcatgtatttctttcaagggattaattttactctggagtactggataagatgttttgatagtaggattatctcagccttttggatgaattataaatactcttgaatcattatcacaggaagaaaatctagaaggaagaaaactagttaagcaactggtacagataaatgagttgtccattctgttttgtcagtgctattgttctctatagaaatattggaaactggggaacatagccatcatccattggaggaattctcagccttccctaccactggtgatcatatttcttttaattttaaatttagacccttacctattttgggatgactggaaaaatgaaaatcctgttctctatcagtgtctgagtgtctttagaatgtgagatgtgtgattacttgttcccagggccacctctgcttaactgcttcaccttgatgtgctgggcaagtaggtttgataatattctgtcactatgttttacttaattctgatgatcttgttttcctgtcttagtttcttgccatggtgtattatggtgcacgcacatagccaccagaaacatttttctgtctcaccattatgattctgtcttccatgaaagggaagtgaggcagttcaggaaataggaaattctagaggttcttaagacaactatcagaaagtctgagaaactgatttctagctatatataaatttgttagggctgctagctcgtttttgctaaaggcaatactgccctctagtgtcgagaaggcaattccaatttgtaaattccttgttttataatttagactctagaggctcttagaaaaataaataatcattatttaagacttgatttagtttgtttgcaggcatgaagtcattggatcagttaacttgggattaaactggagtcaagaatttgtttaccacctatctctcatatctaaggggttctttttgatattactttcctctgtttgtaaggaaagtgttccctatctttatttaaacaatgtaaaactttggatcattgccaacttttaaaatactaaaccattattctctttccttcacttttgtaactgatgtgtcatttttcatttcattctggatatgaatcgtaatttcttttgcctgtgttttttcttcacaagcacgcctttcatataatgatagaggtaagatgcattgatgtttgttttatggttgtggaactttctgtggatgcatactaaacattttgttcttagatttttgttgttgttactgctttactgtgcatcctctataatttatatatttatgtcataaagggttctccctcacccagcttttataattaaaatgtgattgatttgacttaggaatggcttttagttttaagagactgagagtatttatatttatttaaggtaggatgtagaaaaaaccgttttacttgattagaagttaacaccttaacggctccattcgcctcaaaaaccttgtattggttaatttttatatgtcattagcttaaatgtcagcatgtgttcatttttaacaggggtcgattttctaatccagcccattgtatttaaatgtgaaatagatatttttagatagcttcatctttggcatctttagcaaatgaactagctacaggagtataacttttgatgatattttgctatctgaggtttaagcgtttaattagattaaaattcacccttcaaatggagaactcagaataagtaaaatgatcagagatgactttgtagcttcccacctctaataatttattccactgttggttatagtaatgatattgggtagtggtttgggggcaggagattactttttaccaggttatcatttcagtatgtgttctgaagctgatgtcttctgataccataatttttacatataaatgagtaaagaagaaatgtaatcagaactgtgtttgaatgcatatctttttagttttgcaaaatagcatggatgttgtaagagaactggaaatttagggaagtttttaggaattctgaaatccttctaggtgcctctcagctccccattggtttctctatgtagccaggtaaagccatattttgtgtatgacatcagaaattgcttgtcattttgaaatttatgtctacatttgtcttcccaggggctcatatattttaaaggtatacatttttatttttagaatcaagtattgatttttttgtgaataaattactataatgatgccaattaattgaaaatcatttctactattataggatgagtgaaacttacagatgaatttaaagtttcattctagtaattttttatttaaaaaggattagagattttataatctgtcctacagttatcatttttgaacccaatcctttgtgtattaaagaatattatttaaaattccatttttgaaaagctcatgtcattgctaaaggttttgagattctacaggaagaccttgtagacctttttgtcaccctttcgaaattgaccagtattctttctaattgaagcttttaccttttaagtaattttgacaacaatatttgttctggctgttactatacaatattgaataaattatagtaggagggtgatctaagattatttctttctgaaataatgatagcttagaaacttgttaaacagagccttgggaatgtatgggaacttgaagtatatgcatttggaaaacatttaatgaacttttttttttaatgtagatattaaaaattattttttctaaaattaatgttatactaaaatcatagtttgaattgctgacatattaattgtggattaaataatctatatcttacagactgaatcatattcatgttgttgatgtcctttagaacagagaatgggtaatgtgtagattaactatagagacattaccagtgtacataaaagctattaaaaatcttaatattgtaatttagcactgtattccctctacctagttatttttcctcttcagctttcagccattttctgtatactttagtttttagtttttggcatcccctctggtttgaaacctatctctctacctttctaacattttctatttagtttaaatatgtctttatgcagttatacaataactctttgcccttgaggactgaatggtttcctttcctgtagaagagttgttttcaagctttttttctcttgtctccacattcatataagcagtctgctctgatcagtagaatttctcggatagaggtgatcacttgaagaatgagggagggagggtgtagtttttaataaaaactctctagaggttcttgtgtcccctccactgagaatcacacttgagagcccatccttcctataagatttatatctgacctccttgacccgtcactctgctaaacagaaacgttctttcatgttttgaatgtgggaaggacaagcaacttgtagacaaaaaaaaaaaaaaaaaaaaaaaaaaaaagtctgagtttgaaatgagtcacaagaagtcttttgttttatcttactgtttaaacaggaattctaaagccattttataaagatggtttcatttagaagaagaaattgcatgtttttcctacataacaccttgcaatgtttctgttgctgaggttctttctagtacacagtaaacttttaaaactcctgagtggcaccagtgagctgagtgatgcctaaagaaagcactaactgtctttgaggcattagaagaagagagaaaaagaaaggcagagaggatgcattgatctgggatcacataccatttccaagtgtctgaggtgccacccagtgtcatcatatcagttgcttttgccacagaaattttagttcctcctcaaaatactcattatgcagccctccaaacccttctgttgcttttctctggaagctttccaaaaggcttcctgcatcttgctttagttgcagatagggaactgagagaatgctttcaatggagggttgcattctgctttgataggatttccttgtgatttgtagatgctgtattcctatttatatattatgtttgctctatttttaaaaaactatagcagtgcacgtttctttcatttaccatatcctgttatctactatgatgaccacttcttttctggatttttattcgtacttctttgccagtcagtcagttccagaacacaaatgattttttatctcagatcaaagggatgaattgttaatatgtttaaaattagaatgaaccagtttggttaaagaaatatttacttacatatttcctgtatgtgctttgtatttgatatacctatctgcaatgtgtttaagaatgactgccggtatctctgagattaatgaagaaaaaatttaaacagtcactggagaaagtaatagatcttcaggagaggtttttgctgatatatagtcataatttgctgtttctggcacttttcaaatcatcctcctcgaagtacacactggatgaaacaaatgaaatattgttaggagtatttcgtagttcacagaaaatcttagtggggaatattactgagactgatcagaaagattttagatcttctctcctgtggtacatatatagcaataatgctgaacattattatgaaactctgaattcaggttgcctgccttgtgatcactatagataattagtaatctaattatggcaacattgaagttaatgtcattcatatgtgtttactgtttctgtcagttgacttttcagtatactcactttttttctcattttcagagttggtgtgtgtcatgttctgcttatttatagtattattattatttatctgtaggacccaggaccacccccaccttctccattactaggtttgaaaccactgcagttattagaagtgaaagcaaggggaagatttggttgtgtctggaaagcccagttgcttaacgaatatgtggctgtcaaaatatttccaatacaggtatgtttattgcagttttgtcatcttacatacatgttttatggctaggtcatcataactcagaaatagtctcaaaacagaagccatatgtaccaaggtggttctttgtgatactggggaaagcagttagctcttttaatgcctgcctttgcatctgagaaatggaattgttaatataacaatcattatgtttgtctggagtggtggaattaaatgaatgcatagtagatcttttgccagtgaaaattctaatagaaatgttaaataaagataaagattccaataaacaagtctaattgagtggttaaattttaatatccccctacgttgtcagagaaagcaaacaaaaaaacaaaagagcagtatactttgttttagaattggtatttagaggtatatcaccagacttgacttactttcattctactttgagtgtttaattatttcagtttttgtttgatgcattttcagaggcaatcgagacttcaaataattggtttactgttgaattgtttttaaggttggctggacttctcataaaactctgatctaatgtacctctgagctattcttgtgttttgttttgttccgttggtggtatagatttatgatgattctgtcttccccatctcttgcttatataccctggcagctcatgatacccttggtactgacgtcttggctggatttggtgttgcaggctctaccaccatacttagagagtggatgtttctttttccaaagttatcatataagcagtttctttgtcttaatatacctagattttaacctttttacctcctctgttcaatcttacctcctctgttcagtctataaactgtttacatagagtttatgaactgtattacatttttttttggtagctgtaaaccacagtttagttttcagagagaaagtgtattctgttgtgccaagattcataaataagataagggaagaaattatttccatgtgtaaggaagcataaagctcagagaaaggcatttggatgatattaacaagcccgacaacagcaacaacagtagctaacattttattgtatgcttttattgggtcaggtaggggtgttttacatatatgagtactcactaatatgtgtacgtatattacccacatgtacataaaatgcaacatataatacaacaattctataagacagacactacaatgccttttctacttaatgaggacactgaaggattatgtaacttgccagaggttagtgggagagccaggatttaagtttggacagtttggatgcagagagtttctaagggtttctaaccattatgccatagtgcctcttactattattgtcttttagtagtgaaaagaagctaatcttttataagtagatacttagtagacatggattgcttgcaggcacaagtgaatatatggtgtcttaaattattgcattgcatatctttgccccttgctttctcatagaccttgtagggtatgctaaacattttttgaaggatgtttgatattatgttagtttttgaaaagaagaagttttctatttagaggaagtcattctgccggaatttcatctttcaaggagattattctgaatagtaccacaagtaacttcacaccatgatgaaattacagtgtaatacttgcagtaacttacgtgttgccattgtaagacacagaatgcagcatttccgatcaccttctgtgtttgtaaactagaaacacagaaaagtacgttttgagggaatgaaaagggcaggcatttagtataaatttgttaacctattgtcagagctttttcttattacaaaacagaacaaaaaattttttaagacttttttgttttgttttgttttactttggaacttatttgagtaatctcttatgcatggtttattaaacctgtattccttgtgttcttactattctttctttttgactctaggacaaacagtcatggcaaaatgaatacgaagtctacagtttgcctggaatgaagcatgagaacatattacagttcattggtgcagaaaaacgaggcaccagtgttgatgtggatctttggctgatcacagcatttcatgaaaaggtaaaactacttaacgttttactttagtaaagtctgagttggcctgcctacctaatgctggctataaatccctcagagttatttttcgagacatcttatagttgattaatatttaacctgaaaataaaaatcattcttgaataaaaatgttttaaaaggtagtttattttaataaaagagcaaagatggcaactttttaacctaaaactctactcatataaaccacccttttgttccttatttcttgtgctgtaattactcttacaaacatttattttagtgtaggtaatgcttagtaattttcatttaccatttacaattcattttgattacgtgaaccatttttttaagttttaatcagtcttgcttgtgacaaaaccagagtcaggaaatttatctgatctttgatctgtcactaacttgcagggtaattatcaccaaaatgtaattgctagttttcctcaatttttctacttttagagtcagtgtgaaagtaccattaatgaagtaggaaattatgtttttggtaattggtttcatcattgtgaaatgtaagtggttcttttacttctcttatcttgacctaaaggacaacaataatctagaggaatattctacatattagttgttattttatgttgttattttgtgttctgctagtcccatgatataacaactctatagtcaggatattttaacttttaaaatattttctagaaccttagattttcaactagtctttaaaaaaaaaaaaaaacaaacttgtcttatagattggtggaagttgactattcttgtaacaaaagtttaaagctctggtatttccttctggtcaaatgtttattaatgtgaaatggaaggaaatttgaaccatttgaaccattccagaaagattgtttcttggatattatttttccctgaaagggaaactcacaacctcttataggtaaaaagaaaagtctccttatacatatggcctttgtcaagaacataagtttctttttttccctctttttttagggttcactatcagactttcttaaggctaatgtggtctcttggaatgaactgtgtcatattgcagaaaccatggctagaggattggcatatttacatgaggatatacctggcctaaaagatggccacaaacctgccatatctcacaggtagactaaatttatattgttttcccagataattgagtatatatttactaaacttttaagcccctgggtaaattttaatttttcctttgttatgcaatcatgctttacaagacagtcagttttcatttgttttttaaaattagctttgagattggccaggaagtattttggataatgtatatgttaacattattggtaaagtttaatgatctacttcatctcatttctgaaagcatgattgaaaataaactatattttctcgatctcaaaggaaaaagacatttgttttacctcaaaacatgatttatcaatagggattattatccaagggcatgtaatgaaggagagactttgaatgtcttccttgcttgttttttgaatgaccttatctgtaccctgagccaagtcttaaagggaggcatcacttaaaacagttgtccagtgaagaaatactacttagacccaacagttgtcatgcccgcaaaaggaaaaatgattgtgtcttaaacatggaattcagtttgccatgtatttaattttcttgaacgtgggattcaatttgttgtcttgtgttccatttaaagatggttgtttgaaaagtaggcattaactgattcacagaacagatacttagctgagtgccaccaggcgatgttttaggttgctgggaggcattattgtaagtcagcctctaatttaggttctgattttgcaaactttaaatgacgtctacctcagaaataactcttctcactttcttacatgcagtctattggcctcgtcttcgattttcccttgccctacctggtcacatagggaattaatccttaaggacccccaaagttattaagggcctgaaagtcttttgaaactaagatcgattagcttttatagcatttgggagtgtctgcttgtgctttcagtatcccattattggtctatatgtctgcacataaatttaaccactagtcattggcatagatgtatttaactagggtatagtaatctctaggatgagccagttgagacaggtgtgtagaagaggatatcttactgccttaaaactgttacccttttcagaacaccaggatctagctagagcagtgtatgtttatggtaaaaagtttctgttattcattccataagatgcttttctacaaccaggtggaagaatataagaacctctataataagggattattctaaaatgtaggtctctaccaataagcagaaggccccaattcagctattttttaaaagtttcttcattttggtttaaaatttctgtttctatgggagtttgcaaatcagaactctgagatattaacagtagttttatgattggtaggtgggtgacatagataacatatctttttggtatggcagatttttatataactgctttataggtaggattccttcttattgtccatgttatgaataggggtttgtcaccgtgctcttgtgtttaaggctgcatggggctctgagctttgtttgtctcactttctctgcatttcataattttaagtaactattttttcatagtgtacatattcccccttttctgctttcaataaaaaatttaaaaaggtaactagtttaaacttaatttgaatactctttttatttgcaagggacatcaaaagtaaaaatgtgctgttgaaaaacaacctgacagcttgcattgctgactttgggttggccttaaaatttgaggctggcaagtctgcaggcgatacccatggacaggtaaggatgatgattataaaatgtaagaaaaaataaacttgttccatattttcttagaatggcatgtcaggactgaattagtctaaaattgttgtggtgtttaaatcagcatctaatagagttatcaaagtttctgaggaagacattttcatatgatggtagaggactcaggtggtttagatcaagcacttcgtaaagcaacccttagacacacgtcataggattctttttgaaaaattgatcaaagaataatccaccaccttttaacagacctcattcttagggaattcttcgtatgaactccgtagttttagtctgttagttctttcaccatcttaagaagagtggaagaataattagtcactgtccttactacagtgtattaagatttcctgtccattttcccatgcaataatagtttattgcttcttgttgtttattgcttcattaatttctttaatcaacttgatggcttttctccaaattctctccagagttcagagcacttgtaaacccctgaattaggtaactcttcacacctctgtatatatccatatgcacagaaatcttagtaatgggaacctctaggaaggccaaaagggaaaagaacattatccatacagtttattctcagaaactttgaggctggaaaagatgttttcattcctgcaagatcaccttttatttttatttatttatttatttttgagacagagtctcgctctgtcacccaggctggagtgcagtggcatgatcttggctcactgcagcctctgccttccaagttcaagtgattctcctggctcagcttcctgagtagctgggattacacacatgcaccaccatgcccagcctaatgtttgtatttttaatggagatggggtttcaccaagttggccaggcttgtatcgagctcctgacctcaagtgatcctcccacctcggcctcccaaagtgctgggattataggcgtgagccaccacgcccagccaagatcaccttttaatcagggaaaccagttcaacctaaaaggtgacattttctacaaagctaaatggttcaggccttcgacattatcatttcttcatctttcatatcatgtaaattatttggccaactaattcttaggtttcttttccccagcatatcctattggttcctgaggacacgtttttaatgtcatggcaccaccaattttggcagtattgactaactatttaagaatgtagtttggggtaatggtcagtagccatatagctctagaaaagttgactgcaaatgtgtatgggaatggaggcaattttgtggagaatactaccaagattgtgtaggaagcctgaggacaaacttctaagctaattgaatgatagactatcataagactaaattctgggaacatattcttaatttggtacctcataagccctccctcattttttgagaaaaaaaatttctgactcattcatgtcatatttttaactccttcacaactgggttttatgattagttaaaaattattggcttacagtaatgactccttgactttagatttcatggaccagaaaatttcagaaatatttggagggacttgcatgttattgcacattttatatagtacaaagaacacatataaaagagggaacattttatgtcaacatggtaaataaaccataatcttacaataaaagaggtaggtaccttggatggcatacatttacctgtaagagaaaagtaggctttagggaaacattcactgatagcacaattaaaataattattctgagtagtaaattttttaaaagtagagccacttttccctttaatgtgttctccttgaactttagtcttagtgatctgtctttattcttaaaaaaaatctttacatgtatatttgcataaattgcccaacttttagtctagagtagagattatagccacctaaggatggagcgttatggacgtaccaatatctagactactctctagttcgaatacatcgcaagtatgttgtgatgtacccagctatctcacaaatatttttaagcattcatatatgaatgttgtcaagcaccaaccaaagctagctgtactagcttagtaaccatagttacagtactaagaaataccaaattgttggggacagttataaataaaggactccaagacagaagaatttatgaataaacaaatacatagattttgtacagatagaactttttaacatcagtctgtcctttacttagctaattctttttataacattttattagtttttttaatacagagaaaagacctcaaaaaaagttttttttttaaagctacatttcaaacagtatgcaaaggtacagttgaaaagtatgcagcatccttctcccagctgacaattggttcagtttcttgtgattacatccagaaaggggaacataaaaacttctaagtctgtaccagcataatgtctgttgatatattttttaagtatacgcagaaaggatctttctatttatacgctatagtgtgtataccttaccctggtaatagaccacatttggttttgattcatcttacaaaatcatatgttagttcataaagttaatgaatgagtactctttgcttttaacatctttttcaggttggtacccggaggtacatggctccagaggtattagagggtgctataaacttccaaagggatgcatttttgaggatagatatgtatgccatgggattagtcctatgggaactggcttctcgctgtactgctgcagatggtaagggaaaaaaatatttttaaaaaagatatatatgcctaccacacatatatgaaaagggatgatacactccaaggtaatattttaaagtacagtttttttttaattgactccaagagatggtagagaattcaggaggcaggggagcagtgggtggggtaggagaggaaaggaattgctatgtattgatcctttaccattactagctatgttgctggacacttcacataccttaaggttatttcctaaaacggtttcagaggtagttattatgctttacatatgaggaaattgagatgcagagaaattaagtagtttgcctactttagcctcaaactggtgaatgatgaaacctagatttgaaactctgatccagacatagggagaggtctgctttaaggtcatatgggtcctgccccccaggttaaagggtttctattacttgttcttgttattgaagtccatgttcaagtcttatagatatttgcttttatttatttatttttctgggtaaattttcagacgatatttccagtgtgacagaactattttagtgtttcaagcactgtctttagtactccttcataaggtctttactctgtcttcaagtatgttgcagcattttttgttttgaataatataaggcaaacttgccgactgctaaactcctaaacagatgtaaatgagcttgatctgtttcttaagttctaatttataattgcctaaaaacttcctgtgattgtcaaagaccatagaagaaattgtgaatattttaagttataaccaatgtaacctatgttactaacaatattttattttctgagtactgtaataggctctcgttgtaggacagactgccactggaatatgaaattcaatatagggtactattaaagggaatttaatagagtgttcagaaatgggcattcttccaggattgagggattggcttgggagtcaatgccaaacctaagaaaagttgaagcaattttggaataatttcagaagtctttaggaagaagcgttaagaacgcagagtgttttgactctaagaggaatgacatttatgatgtgcatttatggaagcagaagtaggttagatggcagatgttataggaaaatatattttataagaactttattaatatgaactctccataacaaatcattggattaagtaatttaggagacacaagaccttattctcaagtaatatacagtttagttagggcaataaaatatatcctggacaattaactctagagtaagttaagtgtgagttgtctggcccattccccagtacataggtattcaataaatgtttctgggttagtgcaatacttaagaaatacaagcatgtgttttaggagtttaggggagaaattgctttgtttatggggaagagaggtttcagagaagttcttttggaaaaagaaaaggctagatactgacttttcttaaatgccatgaaataatttcagagtcaggcatttctgactcttaagtcagaacccaattgttaagtcagaaattggggtagagaggatagtgtgagcattgattgctaaagtaggtgctttcacgtgtgttgatggttacttgtttgttaaatgaagtaattctcaaactttaatgtgtcataccagattcttaggaatcttgttaaaatttagattctgactcagtaggtctgggttgaagcctgagagtctacatttcttaaaagctaagctaccagttgacggcagtgttgctggcctgtacaccacataagtgttgaatagacaccttagaatgtcggtactttgtcactggaagtactcaagcagagaccaactgtccagccatagataattcttatatttgaagagggttaagttagatgacccctttatgattcattgtattctacccaggagtatttagtgcatttcaagagcttcacaaaatttgtgtttatgcacacatacatctatctggtcactgatactgctcagtggtgacctgtgtctgtcaaaggaaggcaatccagtgattaaaaccagacttcagagttatttagagagttgggttcaattccagctctaccgtttaacagctgtatgtctttgtgcaaattatgtaacttttctgagcttcttatcagtaaatagaggtactgccatcttaaccctgtgaagtaagtaatatatgtaaagtttctgatcaggataggtgcttactggatgttagttattattaactcctaaatacaattttctatttatctgagtaggcctaagaaaaaaggaattatttatgttgtttaatgttgtctatgaaggcacatcctgacttgttgggacccctagttggagagcctgtttgtgattttctaaaaaataaacatgtactttttggcagctgttgtgagggagtgtagagaagaggtatgactctgaggtgcataattcctcatgtggggcatgcagggggtttggatatgccatagaataaacatggttataatagattgaacctagagcctccagagctggaagcaccactgttaacattctgatctgaattgtaaggaatgggtaccttaaagggatattatataacgttaatttacaaatactgattgttccttatgtcctctgtgcagatggaaataggcatcctttatacctagataagaaagccccttatgcaatctttaagggaattacatgccaaattataggccttttcatttcccatacattagtttggtcacactgtggtataagtacagttgagagtctgtttctcttctgtcctcatagcatgtaaacagttgggaataggtgacagagtatattttagaaagtttgtaccagtttgaaagtcaggaggattttaatgaaaatgatttattttacttttcttacttttcaggacctgtagatgaatacatgttgccatttgaggaggaaattggccagcatccatctcttgaagacatgcaggaagttgttgtgcataaaaaaaagaggcctgttttaagagattattggcagaaacatgctgtaagttatccagttagcttttcatttgaaattccaataaaacacttttcagaggaattatttatctctgcacatttctctttcttctgcaagtattttctggaaggtgatcttcacacaggatattctagagttctagaggcagaattagggctatgtctgtatacccctgaaggtgattgtaaagtaatagagctttagagggcttttgtctcaatggtcctgtgcagaagattgtgtcatctatttagaaagtttcccagggaaaaggcatgccagactcggaaactgtggatagttgggtaactttgctgatgaccacttccaatatgacaacattttaaaaagtttatgaagcaccatgttttctcctctccatgggagtttgttgtagccttttaatttcggcttagactttcaagtcttaatagtgctttaaaactatagagaccaggcacataacagtattgccctggttatttcagtctaaatataactagaaacctggctaaaaccaggtagagaaatcccaagggtggctttctgatcttctgtttaattgtaagatagaaatgctgatattaactaagaaaacaataaaaattggtaggtcccctttatccttgatttttgagtccatttgaagggttagcattgaaatgacctgggttatgaacaagggatagagattttttttttggagttaaaaaaattcctcttgtgatagtctcatgcttaaaaaaaaagttctgtttgtgcttttctttatgattctgcacatggtagtcaataaaagtgaatgttgacagaaacttctttgacccagaaaaatagccatttcttcatgaaaattttattgtttcctaatagaaaacaaaaactgctgtggcgtttgagtatatgtttttctccttttagggaatggcaatgctctgtgaaaccattgaagaatgttgggatcacgacgcagaagccaggttatcagctggatgtgtaggtgaaagaattacccagatgcagagactaacaaatattattaccacagaggacattgtaacagtggtcacaatggtgacaaatgttgactttcctcccaaagaatctagtctatgatggttgcgccatctgtgcacactaagaaatgggactctgaactggagctgctaagctaaagaaactgcttacagtttattttctgtgtaaaatgagtaggatgtctcttggaaatgttaagaaagaagaccctttgttgaaaaatgttgctctgggagacttactgcattgccgacagcacagatgtgaaggacatgagactaagagaaaccttgcaaactctataaagaaacttttgaaaaagtgtacatgaagaatgtagccctctccaaatcaaggatcttttggacctggctaatggagtgtttgaaaactgacatcagatttcttaatgtctgtcagaagacactaattccttaaatgaactactgctattttttttaaatcaaaaacttttcatttcagattttaaaaagggtaacttgtttttattgcatttgctgttgtttctataaatgactattgtaatgccaatatgacacagcttgtgaatgtttagtgtgctgctgttctgtgtacataaagtcatcaaagtggggtacagtaaagaggcttccaagcattactttaacctccctcaacaaggtatacctcagttccacggttgctaaattataaaattgaaaacactaacaaaatttgaataataaatcgatccatgttttgtaacaaattcactgtgttatttaaggaaaaaaaggtaagctatgcttagtgccaacaataagtggccattcgtaaagcagtgttttagcatttcttgtgctggcttgtaatgtagggaaaaaaagtgctgttttttgaaaagatggtgtcatttcccccttcttcccatgttttaaagccccatcttatatccagttcccaaaatttgcatacttacctaagtattttttttaggtgtgctgtgtttggggaatatttgaaaatttaaagcatgatttaaaattttttaaagtgagctgtgacactggaaagctcttcattttatcttttaaaatagagttttttctatttatatatgtaaaattgtagtgtatttcttttcaccaaacagtgtgtgggacattctttatcactgttttaggatcacctcaggaagtgtcgttacccagaattccccactgtctgctatgagacttgtaactttatcactatacttctgcttggtgccatcttgtcagagtaatatttgatgtctgtgatatgtaaagaattatcctaggataaagatattaaactttaagcagatttcagatgttactgctttaaaacaaatcagggataacaaattaaacgtataacttaaaatatgcaatgacatttagaggtaaccaatgttgatataggtagcatagcctagcctcctccccaaaattgcttttacaactaacactgatactaatttaggatagttcatgccttatccttgctaagaaaatggaattgatggtaggcaggtgctaaagtgcttttcaaaacaatattacgttagaatacaattggattcttcctcaaatttatacaggccaaaaagtaaaacattaattttctgaatttccagattaccaatcaattaatcaacaaatagccagtattatgctgtgtatttctgtcaggtcattttaaaatccatgttaattttataaaagaattttttacatgtcactgtcaggagctcactgtgaatgtgttgtcttcaaatggttatttaaccacacagtacactacattttacatatatgtacgtaatctctgggaatagtaaattaattatgttatttataaacaatacataggtcaacagactttaagcagggaggaaaagaagagtaatagcgtctgtgtgctgcagaccattcagaactgtcacgtgtgtccccatggtctcattcattgtattcctagcaattcccttttcaatgttgagttcacctctttatttcacaaagtacttggtctctcaatttcttgatctggttttgcttccatttaaaaactaatcaagaagggaaaatattgagaatgtgcatacaagaaaatcattaatttcctgaagatgaatttctacctgttgtgaacatttaactttctttttaaaagttaaacaaaaataaacaagggatattatgatgaatgtttggcttatgtgagtactagagataaaatttttaaacccagttattcacaatataaaatgttttcaagttagaaaaaatttttagaaatcctgggtattgtatttaactgtagctaaccaattttaaaacttgtattcttttgagaactattattaatagaaaaactttttataagcagtaaaataagaatgttccagtgactacctgtccttatacctagtcttgttaaaactttcttttgcagggtatttagtgtttggtttacagtcagtgcagagtgggcaagttaacagaaagtttgagctagagatactggaaaaaaaaaagatcaaagaatgagaaaaatggtgatccattttggggcaaactgagaccccccaaataactctttcctcatgtgtatggtgctcctcatgactcgtcttgtattttgcctttctgatacccatcagaactgctgctgctctaacttatactctttaccttgcccagatctccgcgtaaggaatgctttatgatcaacttgccataggactgatggattaaccagtgttcggctttatttgaagtctatgccctgcacagctcttgtatgtattttagatgctagaagtttttttagcatgtgatgtgtgattcttgtttgaattctaggtaccttgtgaattccagaaaaagagactgtgcttcacgattgttagtcccatgaacttgcactatctatctttcatggtgatgttttgaaaatacaatcaggaaaaaacccaacacctttggaatttaaaatagaatcatatcatgaaatttaaaaagaatctcttctgttgcatttcctcacccctaagtaacagctacatttaagtaaaatgcaggtggtaggggaaaaaaaaccatggcgagatggtggtttagtggaataaactgattactggtttttttgtttttttttttttttttaaagaaagaagcttcatcacagatactttccagtttctcttttatacttttttgaaagattactttttaggaacatttggtatgatatgcataaaattatttatccatttatgggcaaaatgatacaagtagcatcttgattgaacatcatttacctcagatattcaaccagcagtacgttttttatgcagtctcaacccatatcccatttgttacctctcagaatattggtaagcagttattttcgctttactctgtatttcttgtgttttgggcacaggttattgtactactgtcaaatcgtacttgctattttttctgcaagtatttaacagaaagcttaaaatccccataaaaccccaccttggataagtgattgttaaatattgtacaaataaaatgtatgctatccccattccatccccaagttaaataaaaaaatgaatacggta

SEQ ID NO: 30 - DNA, 76575 bp, Homo sapiens
acgttatccatgaagtgtcgcgagagaaacggacgccgttctctcccgcggaattcaggtttacggccctgcgggttctcagaggcaagttcagaccgtgttgttttcttttcacggatcctgccctttcttcccgaaaagaagacagccttgggtcgcgattgtggggcttcgaagagtccagcagtggggtaatttaggaatcgcattcgtctcctgtttctgcaggttcccaggcggaagcccagagttaactggaacctcgggaagagcgggccgagtgggcaggggaggggtcctggcgggctcagcgttctgattccgaggttccctgcggtgagggcgtgttgaggcttggaatcccgacggaatctggagctccagatgtggtgggggttgtctcgcggtggcagccactcttccccaaacctggctattttcagtcatcctgctggtgcttaaaggtgttcctccgcagaccacgtgtttgtttatttacactcgctttaaacgcgggcccgttcccttttccaaactagccaggtcctttaaaaaaaatcgtggggtttgaataggaaatacaggattgcctctgttctccagagtaacctatgcgtgcaacttaaaaatatctgcacatctagagttgtttgtgtgttgaaccagaaccgtatgtgaccctttctgcccatttatttagcatacattaatttcccataagagcacgggaaaggaaaataggagtttaatcatcttggtgaaactaggaaacaggatgtacactggagatatattattttctatgctcagttcattaaaaaaaagtatagtgggtgcttagatgaaaatgagacttctaaatttgccagtctaattaagacgtctgtaccttgtgcagcgtaaatcatgttggttaaatacgtgcaggcttttaaaaaatgtgttttatgatgtaattttgtttttagaatttctagaatttggaatcgagtgcattttctgacatttgagtacagtacccaggggttcttggagaagaacctggtcccagaggagcttgactgaccataaaaatgagtactgcagatgcactgtaagcacctgacttctggaatcccttgttatttggggtttctaaagctcgtcaactgtgatcacagtaaaagaaaacttatttaataagcagtaaataaggaacctgtttatgaacagaaatattagtcatcaaaaagggtatttggaatgttttaaatatttatctgtttgttaactggaagctaatatgcagctatagattggagtcttgcagtaatttgatatattgatatagtattgtttatgttcttaggcttcatcttaaattattgaagtgataaatattcttgaattttcctgacaaattcttattagtcaatgcagttctgtttaagatttttagagtaaattcctctagtattaaataagctggaaatgaatttgaatggaatgggaataaataaaaggactgtaaaagttatgtgcactttgggaggccgaggctagcgggatcatctgaggtcaggatttggagaccagcctgaccaacatggtgaaaccccgtctctactaaaaatacaaaattagccaggcgtggtggcgcatgcctgtaatcccagctactcaggaggctgaggcaggagtatcatttgaacccgagaggcggaggttgcagtgagccgagatcgtaaaaaaaaaaagttatgtgggaaagactttagacttggagtcttttaccctagtttcaagtccttggaccctactagctgtgtgaccttgggcaagtcagcagttctctgagccttgcctcaattttgccattggtataattggaataattatacctttttcagattaattttgaggcttaaatgagagaattcatgagaaaatacttcataaattgctacagaaacatgtagtattatgatttgaaaagtatctgacctaccttcttggatatatcagtgagaactgtgtgcatatcatttttgaagtttttgaagagaaatcgtttgtggaaatatcttttgtttgtaaagatttgaattttggagatatatacagagattttttaaaaattcattgtggtttattgaaaatagcctgagttttcatcatgggttttagtcctgtttctgtcactagttatgtgataaagcagttaatttctctgggtttagccttctcatttgtcagagataataatgcctgactctttatctgtgagggttgagatgagatcataaaaataaaagtatttcatacaattaaatttagtgtaagagtattaataactattacattgctacttcacattaaagtacctttgaatattaccaaattcaaattgaaacaattctgtgttggccaactttattaatgaaatctaactctgtagagagtagagtcatgcaagtgtcttcaaggccctgaatgtaaattattgcatattagtataaaattgactcataaacttagaggaaggctttttaaattaacttcgattttcctggaagagtacgaagtcagataaataacaagtttatttatctgaggaaaacaagcaaacttttgggcctgggttacatgagtttgtaaaactggttataacaaggttataaatttttgaagcagttatagaaccttgtaaagatttatgtacatttgttctgtattgaactagtggttaggaaaactgtaatgttaatgataacgttgaatacttcagattttcagatgaactctaaggctaaaaaaaatgattttactctataactgttattatttattttataagtttgtctcaatttgtttgaatatcctttaatgaattattaatatattgaaatgtttcttctttcttaatatagtgatgatgaaaacacatttaaaatattagttgcaacagatattcatcttggatttatggagaaagatgcagtcagaggaaatgatacgtttgtaacactcgatgaaattttaagacttgcccaggaaaatgaagtgagtgtggtttgtatttgtgcactatctaccatattcccttggttaacaagttatttttccttctaaagttagagatttgttttataagctcaggtgcttaccttgcctgcttgaatatcaatatactgaaagctcaaagctgattttgtatgctttgtgtcttaaattcaagtaggagctacttttgtaaatagtctgttaaaatttacaaatgtttttggggtgtttactgaatgcaggatcctgtggcagtgtctattcgaaatgtaaggtgactgtcaaagcttctgctttcagataacgtagaagaaaactggtgtgaaagacaaatatccacaatccacagatgcaaggttgtatgtgataggagccctaagaaaattctaaataacatttcctttgagtttagaggcagaaaaaatcacgtttagattatagcaagatgagtttaatgaagaaggttgtgtttaacttgggctttggaggaagggtagacttttggccagtggggagcatagagaatgtacatccatgtgaagcaggagtgaggaaacccgtgagacagtataaggtatgttaggggccctgtagtcaatttggctcaccagcaggtcatagttagcaagcatgctgagagactagaaggaaggatttgagctgcattaatgaggacttcaaatatcagattgagaaatttgtatccagttcaagagaaagtcttttggcagcggagtataataccatgaattggagaccagttagaggctttttttgaagtattgaccttagggatggaaaagaggaaatgaatgcaagggatactgcaaaaagaggatttgtgtactttggttagttgtagcggggtggggatgagggcaaagggatgacagtgactctgaagtgtgtggagtttgggtgaatagttgtaccaaaaatagaaataggtagataaggaagaggtactgcttcatgtgggaaggtgacaaattctttgtttgatttcgacaaacttagagttggagactgcaatgggacattcagggaaaaatttcagcaggcagttaacacgccagcccaggagagagttggagaataaatgtaaaaattgacttgcaaattaacaccgccagccttgacttttctggagagttctcttaagtttatctgctaggtccttagttcttcctcccaaatatatatggttcctctctactactcttttcacactaataaacttagtccaaaacgatcacatttcacatggcctgcaggaggtccccttccatctttctgcttctattcttttctgctacatctactcagcatagcagccaaagtgaacttttaaaataataaatcagatcatggcactctgttgcctaaaattttccaagtgtccttccattgaatctagtataaaattcaaactacaaggttcgacttgatcttgacccctgccatgaaacttcatctcctactactctctgcctgatttacagtgctacatccacaccggcatgttctactctgaggcccttgcacatctagttctttctgcttggagcacattgatcttggtggggccgacttctgagagttcaagtcttacctttttggagacgtcttccctgatacttccaagcactgttttatcacattactctgctttttttcatagcatatttttaatagcactatctgaaataatttattgaattatttacttgtttattgtctgttgtcttcactagaaggaaaactccatgagagtggaaatcttttgtttgttcatgctgtatcttagtgcttagaaagaatcagaaagcagtgggtatacatattttaaatttcttaattaagtgaggcaatggctggattctttcttttattttaggttcaggggtacatgtgcaggtttgttacataggtaaactcatatgacagggattgttgtacagattattttggcacccaggtattaatcctagtacccattcattatttttcctgatcctctccctcctcctatcatctgctctctggtaggtcccagtgtctgttgttcccctctttgtgtccatgtcttctcatcatttagctcccacttacaagtatttgatttttctgttcctccattagtttgctaaggatgatggcctccagctccatccgtgtccctgcaaaggacattatctggttctttttaatagctgcatagtattccatggtttatatgtaccacattttctttatccagtctaccattgatgggcatttaggttgattccatgtctttgctattgtgaatagtactgcagtgaacatatgtgtgctgtgtctttgtggtagaatgatttatattcctttgggtatataccaagtaatggaattgctgggtcaaatggtagttccatttttagctctttgaagaatcgtcacactgctttccacaatggttgaaccagtttacacccccatcaacagtgtataagtgttcccttttctccgtaatttcaccagcatctgttcttttttgacttttcaataatagaatgtaaggtgcatttttccttccttgaaggcaaaaaaacttgtggccaaaggaggtctgtttcctgccagagaatcctgtatgtgctctttcttttttaactcttgagccctaaaacagaatcttctcctgagtgtaagctacttaattctactttgccctttccttcacttctgcttctactgtttctcttccctgcgtcccttaattgtaactgttccaccccccataaccccaggtagggacttctagatgtgtattatatttactcattctcttgatttgtatttagtatttcttattattgaatctaaagtcttcctgacttttaagtcccttattatgtgggcccatgcccactaaccagtcttagttctgttccctagtttcttggagtctttttttaaaaaaactttttattttgaaacaacatcagtctcacagaaaagttggcaagaatagcgcatagaattccttacccgtcacccaggttttctaacattttgtcacatttgctttatcttctctttacaaatacacacgatttttttcctgaaccatttgagagtaaaccgcatgtataatcatagaaaaccagaaaattagtattgattcagtgctattatataatgttaagatgttgccaattgtccctgtaatgtctgttacagcactttggaggctggttggtggtgtccaggatccagtccaggtttacatattgcatttagttgccatgtctctttgtctcctttaatctggtacattttcctgcatctgccttgcctttgtttttcatgaccctaatattttgaagagtacacaggccagttattttatagaatcttcctcaaattggctataagtggtatttcctcatgattaggttcagattctgcactttcggcaagaataccacagaagtgagtcgtgttcttttcaatatttcctggagtcactgccagccagtttaaaaaatttttttaaatgtttgaatgatggcaaaatatattaaatacataacataaaatttcccttgttaaccatttttaagtgtatagtacagtagtgttaaatatgttcatattgctgtgcaaccaatctccagaattactctcatcttgcaaaaatgacacccattaagcaacaacttcttttcgccccagtatgtttttcatttggtttgttgtttttgttttgtttcttccatgcctttgattgagatcattttcttccttttactcaaatagtgttcattctggaaggcctagcttaaacctcacatttttattaaagttatcctaactaccatacgcacagtgatctataccttgtattcttttgtgtgattaagaacttaagtttctttaggtgcatcgtatacgtcttgaaagcctgtgttagactttttctgtatgatttccctccttcactgaagttattcctagaattctcttcctcacaatcatttatctttcctagtgcaactaacatgccaccatgttagttcattccttctagactttctgtcctcaggcgaattgtcctcccttgagttcaaattcatcgtagtgtcatctctgctgctggttgcttacgtgtccattctagtgcaccccagagtttgacttatgtttaaatgtataacagtttgcctcttccattagagtttgaacatatttaggatagggatcatattttattcatcattgtatcctcaggactcagtagagggtcttgcatagagtcagtatttaatgagggcagggatataatctattttgtagattgctattttttgagcttctagaacctgtaggaattctgtaaataaatgctgaatgaattaaatgaatgatttggattgaatttggtatctcttcccatacgttctgttaaagtgctaagtttatgtttgattcaaataatagaaaaaatatgatcaccttgtgtggcctgaatcagagacttggtgtaattggaagatggcttttttgaagatagcttagtcagctaaattagaaccagattaattaccagattgaaagtccctttgaataaataaaatgtaaatttttaagttgccatatataatagtgtcttttgtgagtttttttttatctctttcatctgtagtttacaaaaattttacctgtaaaacatactaattttaacacctttttctgttgatcaggtggattttattttgttaggtggtgatctttttcatgaaaataagccctcaaggaaaacattacatacctgcctcgagttattaagaaaatattgtatgggtgatcggcctgtccagtttgaaattctcagtgatcagtcagtcaactttggttttagtaagtaagtatatttatttacttgagtgagtgattacttgtgtatggtatttgctgtataagacacgtaaacacacaactgttttgccttccatataagctattttcttagtaaatatcattctttgaatttttttgtacatcattgtattaatttatattttcctaattaatagtggaactgacccagctactcgggaagctgaggtgggaggattacttgagccccagaagcagaggttgcagtgagccaaaattgtgccattgcactccagcctaggtgatagagcaagactccatctcaaaaaaaaaaaaaaaatacatggtgggactgaatatcttctcaggtttatattgtacattttggtatcctctcctgttcgtatcctctgcctattttaaaaattgagatttttttgtttgtttttctacctgaattgcagaagttacttatatattctaattagtaaacctttgtgatacatatattttttcccaatcaatggcttgtcttttgactttgtttatggactcttgttgacagaaatatttaatttttatgtagttaaatctattggtttttctttttttccatttgtgcctttgggactatttatgatatttgtcaatccctatattataaaaatatcatcatgtgttttttctttttttttttgatggagtcttgctctgttgcccaggctggagtacagtggcatgagcttggctcactgcaacctctgcctcctgggttcaagcaattctccctgccttagcctcctgagtagctgggattacaggcgagtagttgggattacaggtgagtagctgggattacaggcgcccatcaccacgcccggcaaattttttgtatttttagtagagacagggttttgccatgttggccaggctggtcttgaactccagacctcaggtaatccacctgccttggcctcccaaagtgctgggattatagacgcaagctaccgcttctggcccatcatgtcttaaacattgtacaggatctcacattgcatttagtagaaacgtttccttaatttcttcagcccatgtcaggttttctgtctttccttgtctttcatgaccctgatacttataaagaggtcaggtattttgtagaacgtccctcaatttggtattttctcctgctttctatgattagattgggattacaggttttgggggagaatattcaagaagtgaagtaccctttcagtcgcatcatatcaggaggtgcgtgacatcaacctgatttatcactggtgattttaaccttgatcacttggttaagctggtctctgccaggtttctccagtgtaaagtcattattttttcctttccatatgctgttggttagaattgagtctctgagtccagcttactctcaaagggcagggagttaagtttccacttctgatggacataagttaaaaccaccaaagtaattaataaatattttagggtagatattttgaggctgtgcgacttttctgttcctccttaaatttgttcattaattttagattcatcagtggatcttacctacaacagttataactgtgatattctaattgtgattttccatttcctatattctttctacatgtattaattgggattcttttgtaaggaagatttgtcccttgtcccacatttgtttattcaattgtctatatcagtagaaacccatttttttttcctttgggttataatttattactatcataatttacttgtggcttaaattgttccagctttagccattgggctccttttgagattggctcctgtatccttttgatatatcccaccttttcttctgattttttactttgtctttcttgtcttcagactcagccatttcttcaaggaaccctggttccttttggagaatggtatttggaaaccaagatctggatgttacatgtgcacattactattgtattgttgcttctaggctctcactggacagagctaagaaaaatatgtgtacatactaacccatgagaatagacatactcatgtttatttatttatttatttatttatttaatttttgcttttgagacagggtctggctctctttcctatgctgtagtgcagtggcatgatcatagctcactgcagcctcaacctcctgggttcaagccatcttcctgcctcagcctcccaagtagctgggactatatgcatgtgccactgtattagtccgttttcatgctgctgataaagacatacccgccaagactgggcagttcacaaaagaaagaggtttaatggactttcagttccacctggctggggcggcttcacaatcgtggctgaaggcaagaggagcaagtcacgtcttacatggatgatggcaggcaaagagagaggttgtgctgggaaactcccatttttaaaaccatcagatctctttagacttattcactatcaccagaacagcacaggaaaggcctgcccccatgattcaattatctcccacgaggcccctcccataacacgtgggaattatgggagctacaagatgaaatttgggtggggacacagagtcaaagcatatcagccaccacacccagctaatttttaagaaattatttttggtagagatggggtctcactgtgttgcccagctggtcctgggcccaagcaatcctcctgccttagcttctcaaagtgctgtgattacacttgtgagccaccatgcccagcccatatttatttcttatttagtttttaaagtgtgactttatattgggaggtaaatttttttttgagattttgtccacatgaaaatgtttatgttcactttccccttgattgatagtttggctgcatatataattgagttttaaaagatttgtataatactttgtccttgtttttcaaaattgtgatcaatgtctttaccctccttctattcaaatctaaaacttgggacattttttattttttattttttatttttgagaaggagtcttactgtcacccaagctggagtgcagaggcacgatcttggctcactgcaacctccacctcccaggttcaagcagttcttctgcctcagcctcctgagtagctgggactacaagtgtgcaccaccatgcccagctaatttttttatgcgtttttagtagagacggggtttcaccaggttggtgaggctggtcttgaactcctgacctcaagtgatcctcccgacttggcctccgaaagtgttgagattataggcgtgagccaccacacccagccgggacattttttaacttcagtattttctttctttcatcttatttttaaattgcattctgttttgaaaactgtttccccaccctatatacatgtttacctatttctttgctcactgttgttccttgtatttcatttcttttgtgtagattcagtttccttctttctgaagcacagttttcagtagttttttcatggagtgtcagtgagtggtaaactcttattttttgttgctgttgaggagtctactgttaggtgagttgctagaaagtttagcatagtgattaagagcatgggttccggtataaaacagctggagttcaaatcctggttctgtcatttagtagttgtaaaattatgttagtcacttaactactctaccttagttctgtccttcataacatgggaaagaaatgtgccaatcttacagagttgagaagattgagatgataagaaaaatggctagagtagtgaccagcataaagacaatacttgggtaacttaagattttctcattgttcttaacatgttgcagtcttatttagctgtggatttaattctgtttgttccgcgtgggctttatcatatattctaatgtaatattgtttttcagcaacttggggaaattcccattctattcattatgttttcaaatattgtttcctttctctttctgaatatcatttatatagcatactattaaaaaaaatattgcccataactttacctctttgtgtttcattttggataatttaatcttccagttcacagttcatgtagaaaataggcaaagatagggaaatcccaaaaaagaagactactaaggagttagtagccaattagatttgaagtataacaatgctacaataattgaaaatgtggtatggctcatgaattagtagataggtaagtgaaagagaatagaaactctagaaatagcctcaaatacatgtaggaattgagtatttgatgaaggtcaccatctcacaatgtaggggaaataatggattcagtaaaactgctaggagaaactgttacacatattttaaaaatctaggtgtggggaaggcttctaagtatgacacaagacccagaagtcataaaagattcatacatttgtctttgcaaaaataaatttctgcatgccaaaaactgcctgaagcaaagccagaagtcacagttcaatcaggaagaatatttgcaaccaattgcaaattaaggttgaattccccaataagcagttctttcaagacaataaaattcatgagttagtaataaataaagaatatggacatacttcacagaaaaggaaataacatgacatttaacttttatttttttttttcgagacagagtcttgctttgtcgcccaggttggagagcagtggcgcgatctcggcttactgcaacctctgcctcccagattcaagcacttgtcctgcctcagtctcccaagtagctgggactacaggcatgtgccaccatgcacggctaatttttgtgtttttagtagagacagggtttcaccatgttggccaggctcatctcgaactcctgacctcaggtgatctgcccacctcggcctcccaaagtgctgggattacagatgtgagccaccgcatccggcctaaacctatttttaaaagtttgatttcactcataagaaaaagacagagctatactgaaatatttttctcctataaggttggcataggtctgtgactctcaatcctgagtgcacagtacagttacctaagaacctttgaaaatatggatggccccctctccaggccaactaacttagagtctctccaagtatgtcatgggcattggcatttcttgaaagatccccaagataattccaacatgctgctagcattaagaactgctagcatagatttaagagctggatgacctactgtgttagtgaggtaggggaaaactgtccctcttgtgcactgccattgcattatgtgtaaatctctatggtgggaaattggcagcacctatcaaaattacaaatacatgtactctttgacctaacaattcccttccaggtattcctttacaggtcgactcaccagggcaacaagattactcgctgtagaagattactttgtacaagattactgactgtagcattgtttgtaaaacaagactgccaagaatctaaatgtccattggtagggaactgctcaaacacattgtggtgatccatgcaatggagtactgtgtggctgacagagcagaagaaaggtcttcatgtactgatgtggaatgatttctaaaatatgttgagtgataaaagcaggatgcagaaatgtatatttttctatcatttatgtaaggagaaagaaaaatctgtttatttgtgtggataggtataggatccttttgaaagatgcactagaaattgctaacattatttgcctctgagaagaggagctggatggctgggggcaggggctgacaggagactttaatttgaacaggcaataagtgatagagctgggagttttaatctacctctttgggattctaaagtatatggattttcttccctccccccactacgaataaaaaccatatgctaagtttttaaaattttgaaggcttattaacttttcattaattagatatactactcatacataccacaagcactgtttattatagttggggtttctttaaaatgtagtgctttgagatattttcaaactaattgaaatgaattgtcgcctatgattttattttttaaagctctaaactagtggtcatatgccaatgtagattatgcagtttgcctatgattgcattaatattttggaggagaatcttagggaaaacagcttttgtcccgtatggaaattttaagtaactttttttttttaaggtttccatgggtgaactatcaagatggcaacctcaacatttcaattccagtgtttagtattcatggcaatcatgacgatcccacaggggtaattattgttttcttagagtttgttggaattttggaaatgatcagtttagtttgtctgtggaaagcatgccttccctttttctcattgtgtagtcaaattgagtcaaaagtcaagttgacttttcacattcatacaagcttttatactgctttttagattttttaaaaatctgaaataagaattggtgtatgagctatgcttttatttcattaatactgatgttaacaataagaagccaggagtaggagtgaacacctaacatctgtatagtggtttacagtttgtcagtgtttttataactatcttataaaatctcacttttaggaaatgattgttcaagaccatctttaaatctaaattagattatcttattacctgtttgatatggaagtaagactagagatcctacaagtattttttcattttatctggtcattaatattatgaatcactgattatctatggtcttttttccccaggctttaagacggttgcttaatattacaaagcatttatctcatggctaatttttatttttttgtggccaagacatcataagttttgatgagatattaaccttgcctttggcatgtgattccagttgctgtaggtgatttgtagtacaaaaatgtagcaaatacttttactattgtaattttgttttgagaagacactatcctcatctatgtttttgtaagtagaatatggagtatgcttttaacaggtgatacgatattcatgcagatacctacttttacatacacactaacattctttgaaattattttgcataggcagatgcactttgtgccttggacattttaagttgtgctggatttgtaaatcactttggacgttcaatgtctgtggagaagatagacattagtccggttttgcttcaaaaaggaagcacaaagattgcgctatatggtttaggtaagacagttttattttactgtttatgtccatgtgtgattctttaaacaattgagaaatttggagataagtttgtatctgtttggaaaaaatggggcaaaccttattctttattggtgactataaaaaatgatggatggttttggtaaaaatttttggtgaaaaaatgtcttttcgttactatttattattttgggttttttttagactcaggtgtagaatcctgaatgttagaattatagaataattagcaaaactgcactttgatatcttggaagtctttgaaaggtctaatgcttcactgtacaataccgctagcttataattttgtgcagctttcataatacctctggcaagtagaaaagcatcatggttatttatattttagagataaggaaaatgaaatctggatgttatatctgattctgcaagtgaaagagcaggaagtgaaatatacttttcttaaaaaagctattaacagttgttttaatcactgcagtgttattagggatcatatctccagaaaattgcctttcctcctccattcagactaaggacagattccattatgcctcagtcaccaccagaagcacatctctccagtcatccattttctcccaaactcttatcttatcctgttctattataccttccttaactggactctgtctccaccctgcacccctccctgtcccccagctcttcattataaactctagaactctttttataattatcagattcctcattattatcagtctcttctctgaatgttacctccactttctaaccttcagtgaagcccagctgtcccctgaggttcctgtgtcccatgcagttctcttacccctgggcttttggaaagaagcggggatcactgttctccttgctccacccactgcttccttttctgcctgcaaacacactgttccctttaagcttctgccatctggctaaaccgcattgctttttctctcagactttttacctacttacctaccttcaattttgccagtgtttttagtgtttcaacactcaagtagattaatcttctaatgccttgggctttgtgtgccttgacttttttgtctccagttacatgttctacattccacctcagccatgtattccattggccactcctgtagcattctccttgggagctaggccacttctaacttctagacttctacattgttggcttttcttctgagaccctctctaatccgtatataaagtagcagtgttgtccacccttttaattccatagtgttaattcgccatcttagcatcctggctttttctccttttataatatttaatatttgtaactattttgttgacttgtttttgttagtttctttcactagatcaaggtgaacctgtggagtatgagaattgtttgaaagtcattgagttatttaaaaagcacaatatattaaaacaatgtaagaatattgtttttaaatacacttttatcatcccttttaatatttatttctgcacatgttataatgtatatattagatcaaaagtatatataatttataacaaagggatggtgaaaaatagtattactagaagttttaataagaattttaccatagaaaactcacatttttattctacattttgctggttttgaacatgtatatgtctgaaatggaaaatgtttttcaaatgcaactaactactgttatcaagaacctggaacaggccaggcgtgctggcacacgcctgtaatttcagcactttgggaggccaaggcaggtagatcacttgaggtccggagttcaagaccagcctgtccaacgtggcaaaaccccatctctactaaaagtgcaaaaattagccagacgtggtggtgcatgctgtaatcccagcaactcaggaggctgaggcacaagaatcccttgaacccaggaggtgaaggttgcagtgagctgagatcacaccactgcactccagcctgggcaatggagcaagactgtgtttagaaaagaaaagaaaagaaaaaaaaccctgaaacagctaggcatggtggcttatgcttgtaatcccagcactttgggaggctgaggcgagaggattgcttgagcccaggagtttgagaccagcctggacaacatagcaagaccctgtctcagttaaaaaaaaaagataaaaaaagaacctgcaacatacccacttataaattattccagaattcaaatatatctcccaacagtaaagtgaaatactttgagaaggacataatttagaagcaaaatagattcattttttaagccgaagtaagaaaacaatttaaaaataatgtaatgtccatttcaggatccattccagatgaaaggctctatcgaatgtttgtcaataaaaaagtaacaatgttgagaccaaaggaagatgagaactcttggtttaacttatttgtgattcatcagaacaggtaaaacttttctctgaaaaagtttgagccaagtgctgaggcttcccaaatctgtttctgagcttacctattttagtgaaatgcccttaatctttcaaggttgtcaatgcaagatcagacaaaacatagatttgctttgtgtgatttcattttgaaattgtttttagtatatattaatacctacaagaatatttgtaacataaggataaggcatacacatgaatactcctcaattcaacaaaaaggtagaatctttttgttggattatccattcctttatcccattccttttccctgatcccacctgcttccccctatcccaaagggaagcattattaattttgaattaattatttcattgcttttctttgctgtttaatcacatgtatactcatattatgctatatttacagccaacttatgttcagcattacattactgagatccattttgatgcttggatgtgtaatttatttttactgatgtgtacagttatgctttgcctcctgtcagtgaacaggagttttttgcttttataaaccttgctgttatgaacattcttagacatgtttcctgctacatatatgcaagtgttcttccaggatatacaaatatagctagattacctttcttttgttagtagttttaagaaatttaatctgttggcagggtataggattgattgaaaagaagacagacttgaagaagcaagatttattatctgatcactgcagtaaaaatgtgaggtggtgacagtgatggcaatgaaacagaaatgggagggacacaccggagaagttgtcagggaagaactcaaaggatttggggcctgattatataatttattacagttgtcccttggtatccacggggggtgttcggtccaggacctaaaatcctgggatgctgaaatcccttgaataaaatggtatagcatttgcatataacctacatatatcctcctatgtactttaaatcatctctagattacttgtaatacctgatacaatgtaaatactgtttaaatagttgttatactgtattgctttaaaaatttatatttttcgttgttattttttattgtttttttcctgaatatttcgatctttagttggttgaatccacgaatctgccaatacagagggccagctatatttattgaacacatttattgaatgcagactactctgtgcattcagtgaatgcagacttaggttaaatactcggtaaaagaaagggtttaagaggctgacttgtgttaccttatgtgtgagttcttgaataaactgtgagtttcaaaggaggggcaggccagagtttagatatgtgtgtggtcttcatataactttgcaccactgggatttgttccttctcttccatagagcttcccaggtctaccatttttttgtactatgccaaagtagggatgatgagttgaaaggaaaactcataagtaattctaagaatttaagccaaatgaaaggtagaatagcagcattggtaaggggaatgggtagtcaccatatgatgttgatttttctcattgcccccctcatcatttgattaagggaatgtgtaacagctttctctgctgtaaagttcccattttctacttttcaattaataaatatttttgggaaaatactttgagactatgcaaatatcctgtttcaccttaaacttttactcgctaattttagcatccatgggtgatcttatttccagtaattaatactgtggtattttaattgtaagttttgatttccttcattctttctatatttattaatggaattcttctgtaaggaaaatttgtcccttcttctctatttacttacttatttatgtcattatggacttgaagatccagtactatcagttttttggttgctactgttcctctgattgttgcagctttgaccattgcattctcttttatgttggcctctgtgtcctttcaatgtcttcccatctgttttgaggtcatgaccttagttagctttttggcacctcaagatggtctaggctcttggctcttgtaatggcaaaaatcacaattacttttgcaccaacctgatattttcctacctagccctggaatcaaccatttctccaaggtgctctgattctttttattggagagtggtattcagaaatccacaaatgcgtactaggtgtgcttactgctaccagggcttgctcagcactctgaatgaacagagttatgggaatagatatatgtgtatatagtaacccatgcatacatacatgtctatatatgtgcttaaaaaaccaatgataagttcagactgattctaatccagccctacaaggtccatttttgtcttctccctttccttacttgtgacttctttgtctaacagaagcctggatcatattataaatatatatgtttacttattttttcaatcttggtttaattatatttccaatcctggtataatttgaaattataaagtaatttcaaaattgctaactcatacccctgtgcaaaacaactttcccaactaggttacaatgtttgtgtaagttattttagtctttagcctttctgtatctagttgaaacctaatttttcaaacttacttagctcattttctccccacccccttcactgtggttatgtggttctttggtaatgctgttagattcatttgtcaccctgtgcattctcaagatacttctgctttcatatttaaaacaaagaaggttttcacagattgggtgagaatcttgagccttctgcattttgccttatttcccatttgtttctctacatcaactgtttttttctcttgtttcaaagaagaaagaatctgaatttggagatgacttggtcatgcaaaatctttcaacaaggatattgtgatcacttctaggtcacaaattacagtcagcctaccagcatcatcctcccttcttcttccgggaaagaaccagcactcaatgaaggcacaatggcatcatgttgtatttgggaattattctgcttttctttagtagttgtgataatctcataccttagatgtatgttttttacataaaaacattcctggatacacaagcctgtatattctgtcttccctgcatttattctgcttagcccttctgttctccttgctgttccttgaattcactgaacacattcccactttagcaccatctgctcttctactgcttaggactttctctctccgcgtactgatgcttcatctcagttctctgctcatttgatgctagtcagagaggtcttcctgactaccctgtgtatgtagagaggagtatggcacttctatgtcacttttccctttatttttctttacagcacctatcactaactgacaagttatacatgtgcatacttacacacatgcatatacatcttgtattagagattgagtatcccttatctgaaatgcttgggaccagaagtgtttaagattttggattttttggattttggaatatttgcacatatgttggggatggaacccaagtctaaacatgaaatttgtttacattttatatataccttatacacatggccttaagttaattttatacatgttttaaaataattttgtgcatgaaacaaagtttgtgttaagtatttatgtgtggaatttaccacttgtggtgccatgttggcacttaaaatattttggattttggattttcagattagggactcaacctgcattgcttgtttcccacactagaacaaggactttgttcactgctgtgtcttccatatctagaagaagcctgggacatctgacataaagtagacagtgtttgggtaacagtatttgttgggtgaatggaagaatattggtttggattaaatgaatgcttggttaaactatgtgaacacttttacttgaatctccaatgatgtaagttaatattagggaaaactattccttcttgtcttctatcaccttgcatttcatgtatctttaaataataactgatataggtataataccatagtttgcatatcacttgtttatttaatatttgatattgaaaactcttagcacttatgtgagattgatgtttttactcccattatatttattagtaaaaagataatgttaagaaattactggacatatttatacttacttgcattttctgtgtgttttctctagtatatagttagactgatttatagatttctactattgatagaattcatgcttttctgattgaccaaaggggaaatccttcctatgtaaaacctttcatgatcttcctccaaatatagaattgactgctttctcttttcgggtttccacttgtctgtgtccaataagtttgtaaagctctcaaggtcaggagttagcattgatgatctttacattcccaatcctgtgcacactttctggtacatagaaggatgcaataaaatctttagtgaatggagaaagaaagatctgtatagacttcaataatatgaaatttttctaatcaccgaatttatatttttcaaaatcttgatacaggagtaaacatggaagtactaacttcattccagaacaatttttggatgacttcattgatcttgttatctggggccatgaacatgagtgtaaaatagctccaaccaaaaatgaacaacagctgttttatatctcacaacctggaagctcagtggttacttctctttccccaggagaagctgtaaagaagtgagtgttatatattttgagccaatttttaagaaatctttgctataataactaatcatctcataggtttaaggcctatgttaaggttaccgctaactggcagtattgtcatttatatgatagctttatttttgaaaattgatcattctgtgtagtcttattgtttttccagattttaagccattttcaaaaagagagcatccaattggtgttattttgctgctcattaggcaaattcaagatgcacatttttattatatttcaaggtagatgttttaggttgatgattactaatttcacaaagttcattataaaaaattatcctaaaaccatttaattgaaaattttctgattataagtgcagtataatagatctcatttttaaaacatttttgggggaatgatatgattgtaagaagtagttaacagtgattaaactcaatttttattatgggttttatcttttgaatcacttgagttctgattgttacaatgataatagggttaaagaatatggtagtagaatctatgttggttggttttttttcttcatgagtccactgcaaaatcattttgtctatatgtgtacatgtatgtacatatacataggtatatagatgtaatactatagtctacatatgctaccatcatagtcctgttaacatttttttatgcttattatgtctatcttacaagactgatcagacagggataataatggatgagttgattttactctggggaaggaaaatgtctaccatcttttcctgtgatgataacattaaggttaaattagcagaaacatttatttttaagagtatgattttataaagaagcatttttagaaactaagaaatatgaaagctttcgtttgcacatcaccctgaggaaatttacactgtgactcggtgttcatttctctccacttcagacatgttggtttgctgcgtattaaagggaggaagatgaatatgcataaaattcctcttcacacagtgcggcagtttttcatggaggatattgttctagctaatcatccagacatttttaacccagataatcctaaagtaacccaagccatacaaagcttctgtttggagaaggtaattctttttgataaagtcaatgagatctactttagttgaagaattattcaccttcaattaagtaatttaatagagtagagggaagcctttatgttgattacattctcatgaagcctgtaaggacactgttcttcagtgaatgtgtttaattgtgtccaagatttttttttttaagtcattgagagagaggaatactggatgttaaaaaaaattaaatctctctcctagtttctttcttccttttcaaaaacataatacataatcttttctcctttttaatcctgatttgatgatttgttcattttatttatgaaagcaggcagtaactttgattgaggaatgggagactatcgtgtgtgagaaaagccttagcttctaataatctgtattaggcgtccctttcaccctgaaagctaccccaaatgaaatgtgaaaaatgtgtttgctatccaccctattgctgcaatgtaagtcccaaacctccctctctatgcacattgccacccctaaatctctagaaaatttcagccactactaaggttgggtggattaatgcatttaataatatgtggtttgacagcttaattagcatcacttgctgacgctcagttcttaactctgtgtcagctgtcctactatgttttcttttcatgaaaaatcaggtaacatagtaacaatgataataattatgaccagtgatacttactgatttactgtatgtgatgtgcactgttgacagcatttaatctagccaacaatactatatgtgagtagtttctaccatctatagtttagaggaactgaaccttagataaggtgactcattcagtgtcacagctttttgagcagtgtgtagctcacgtaaccaaaagtgtacgcttgtttcaagatgattgactctagaaactcaaacatagattaagattctggcatccctaaatccaatctctcaagccaaagagatagaaaatgcattaattgcttttgcattgattgatccaggcctgagtcatgtgcccttccctggagtcagacctgggtttttcaactttggcttagttgacattttgtactaataattctttgttgtgggaggcagttctgtgcactctgggatgtttagcagtattctccctggtttgtacccactagatgccagtagtaccccttctaactggtcgtgatgatcaaaaatgtttacagaccttgccaaatgtccttagagaagcaaagtcacctctggttgaggtctactgtatgaacttcacctaaatcctgtgggctttggtgacatgaatccagagaggaaagtagacgctggtgacacaaagtaatagaggttcattttaaacaccaggtgtgcacataactttctgttatctctgtattttatgtacatttctgttattgtacttagttaagttatattattttttataagcatgtgagtgtcttctgaactctttgaggacaggacccatatcttacttttctgtctcagcacttgacctagtacctggcaaaatgatgctctataaatgcttgttggattgaaataattgacctaggagatcatattcttatagattttctctgtgctgtctgatatgtattcactagcacatgtggcgtttacatttaattatttacatttaaatttaaaattcagtttctcacttgtactagccacatttcaagtactctatatccacatatggttttggcaaccatattgaatatgcacatagaaaaaattattgcagaaaactcttttggacttcattgttacagacagtttaaaggacaagattataaagtcttagatgtgaaagaaatctgaggacaaaaacacttgttctgtattgttcttgagatcaggaccaagttataggaaggcagtttttgttccaatacaagaactttctaagaactagaattgttcagctatgaagttggccatctggagatatctaatcactgtgcacacagccatttatgaaaataatctagtgctgtctccttgtaacttggttttacccttaagaacaatatagaacaagtgcttttgtcttcagaactctttcaagtctaagatgttataatcttatcctctcagagtatgagacaactccacatatttgaaaacatcagtcttattttcttttaccttgaactcttccaagataaataatctaaagtccttgcttattgatccctaaatcttctggtgagtctcccatggatcatatgactgcaaaaactagacttacttggttttaagttggtaagctgaggaaagccttattgaaacatgagtagtaatattttaagttttattctaaaagaattattttagagattgaaaaattatgaagaactttcatgaaaggaaaacattaaggaatagtattaaaggagcattacaagaaggtatatttgaaaaggtgtcataaatgacctaggaaataaagatgattatgtagttcaggaaaattcctgtggtaataagctgctattcagccaagttaaactcagtttactacgttgttttttaatctttttaaaaattttgagattgaagaaatgcttgaaaatgctgaacgggaacgtctgggtaattctcaccagccagagaagcctcttgtacgactgcgagtaagtcctatttatatagattgaatattattaattttcaaagcatagtaatgtacagtttacatggtttctttgaaaagtagtgaggagagtgctcatagtaataagaagagcaatcaccatcggaggcaaaaacaaagatataaggatttgagttaatcacagtttaagtgataggtttggtaacttatttttctcattttctaaataatttgttgttatatttaatagattggctgagctctctggcttcatctttaactacctcctctactcacttcattccaggcatcttggccttctcgcagtttcttgggcatgtgggatgtgctcttatctccctttagtctgctcccgtgtcacctcactgcagccctatcatcaagattgcagcccctaccttctctccagtgccctgatttcacttaccttcttctgcttcctcttttcttcttatttttttccccgtaacacatccttctaatctatgtacggtttatttgttttggttattattaggattgtttcctgtgcctataaatctgcttatcctttctatcgtgttataaacaaagaaacaacaacagacttcttctttaccactatgcttttcccttttccaaactcctaccccatgttgcttactctctttaaaagcccctaaaagtatataacctatatctctcttaactttctcttcttcagttcactataaccaaggctctgacttcaccataaccagtggaaaagatgacctttaattgttcaatccaatagatcgtgtctcatcttgctgaattactcttgggcattctctgagttatttgtatccgtcccgtctcatagttagccctcttttcagtgtaggcatacagctttaatgaccaccaatagagtgatgacttcaaaatctttacgtagacctccttcttgttctgtatctccaggagtcccctgaggcctggtactgaggagtgtagtctttaaaccagcagtgttgttgttgcctgggaaattgttaaaaatgcagagcctcagaccctgcatcagaacccactgtattttaacaaaaatctccaagaaatgtatatgttcatgaaaatttgagaagtactgggatgtagactgtggaggtaaagagtacagtgtagagccagacttcctgagcttcattctggcccaaccactagttgtatgaccttgagcaaccgcatcccttatcccttggtttgtattaggttggtgcaaaagtatttgcgggttttgtcgtagaaagtaatggcaaaaactgcagttacttgtgcaccaaccaaatgcttcgtagatttatgagatctaaatggattaaatagtgtctgttgcacagtaggtaatctgttcccgtttctttatcccactgtcgctggcatagtgaagcccttattaatacttcctggcctattgctgcagcctcctaccaggactctgcctccagtttccttctctctccacactaatgccaaaatgatctttgtaaaacacagttttgcatgtcttttctgctaaaaataacttaattattccccagcactaacaggaaaaagtctaaacttttttaggttagcattcaggggtctacatgatgtggtctaaaccaaaaaagctgccgtcccctgggtgcagtggagtttatttcactggaacctttgtccatgttgatcctgttgcgtgggacatacttctctcctcctttctctataccttcttcagcacccacctaaagcctctgtcttcaaagaagcctttcttgacctgcccacagagaacatgcttcttcctttgtgtcctcatccaactttgtacatacctcttatagcaccactcacagtctgcttccagtgatctgtttacatgtttttcttcccagtcagtttgtgaatttcttgacagccaagattgtatttatttatggttgtatccctggccctgaacagcatacttagaacattgaggacatccaataaaatttgttatgaccaaacatttataaatgagaagtttgaaggagagacctaatagctttagcatttagtattttgtcttttataacatggtagctgtagagatgatctgggtaaggctgggcatggtggctcacgcctgtaatcccagcactttgggaggccgaagtggctgaatcatctgacgtcaggagttcgagaccagcctgggcaacatggcaaaaccctgtctctactaaaaataaaaaaattagccaggtatggtggtgcatgcctgtaatcccaactacttgggaggctgaagcgtgagaatcgcttgaacccgggaggcagaggttgcagtgagctgagattgtgcctctgcattccagcctgggtgacagtgagacgccatctcaaaaaaaaaaaaaaaaaaaagagagagagagagatggtctgggtaatacaaaaataattactttaagggaatcacatagttctcttcattatggcaaaagatcccaattttctcatctgtgtctgcctcacagcattaaaactaaccagactttaatagaaaattggcatttcttttcctaagcacagtaaattacgaattcattcataaaacagcacatattgtcatataagtaatattacaaaactacattgtactgactaaaagacattcattaattcattgactaaatcttactgagtacctgctattatggatgctgcaggatatagggatgataaaacagatgaggttttgaattcgtcgagcttacaggaggtggaggtgcaaagagagacatgatacacaaatatcaaataaatgaacaaaaaaccttagcagatagtgatgatgagtgaaagtgggagcactttagttagggagcattctggataagctgtgaggtggtgcagtgctggtccccatagcgtactttgggaacagctagttgagaagaacatatctctgagaaagaaaggtggtatttgtctttgtaaaggtctgtttaccactacagacttctgtagaaagagtctaccttgagagaagttctcagtttcagtgagataccatgttttggaggtaatcatttctcaaggctcacagatttgattctttattacctggatgttcctagcattcatctttctcttgaggcacatctctaagatgatagaccaatttactaatgcatttaaggctagtattttattttggtgtgtgtttgtttgtttgtttgttttgaaagttcagaaaattgttttcagatggtttgcttggtaggtacctagactattagtgttatcagggggagatgtaatcattctgcattgtggaaattattgcaataccttgattccatcgaacaaagtattttgcttatgcttataaacttttcaaacattagtttctcagtaggataaatgatatagctccatcatgatctactgtagaaaattaattcataaatttcaaagtatcaagcataaacactgtgaatactgaaggattagtgtgtgttttaaaaattggcaaattgttgtttcctagcgttcatagattattctgtgttttcaggtggactatagtggaggttttgaacctttcagtgttcttcgctttagccagaaatttgtggatcgggtagctaatccaaaagacattatccattttttcaggcatagagaacaaaaggaaaaaacaggtaagctagttatttttatgaggtaaaaaaatgttcttataggatttgtgaaggaatctttattaaaaactgtaacataataatggaagatgttttaatatgattgtaatgtcttaaacaaattgacagtgggaataattctcttgtcttctaaaaattagatagcaatcttttttattattattataccttaagttctagggtacatgtgcacaacgtgcaggtttgttgcatatgtatacatgtgccatgttggtgtgctgcacccattaactcgtcatttacattaggtattgctcttaatgctatccctcccccctcccccaaccccatgacaggccccggtgtgtgatgttccctgccctgtgtccaagtgttctcattgttcaattcccacctatgagtgagaatatgcggggttcggttttctgtccttgcggtagtttgctcagaatgatggtttccaccttcatccatgtccctacaaaggacatgaactcatcattttttatggctgcatagtattccatagtgtatatgtgccacattttcttaatccagtctatcattgatggaaatttgggttggttccaagtctttgctattgtgaatagtgccacaataaacacatgtgtgcatgtgtctttatagcagcatgatttataatcctttgggtatatacccagtaatgggatggctgggtcaaatggtatttctagttctaggtccttgaggaatcaccacactgtcttccacaatggttgaactagtgtacagtcccaccaacagtgtaaaagtgctcctatttctccacatcctctccagcacctgttgtttcctgactttttaatgatcgccattctaactggtatgagatggtatttcattgtggttttgaattgtatttctctgacgggcagtgatgatgagcattttttcatgtgtctgttggctgcataaatgtcttcttttgagaagtgtctgttcatatccttcacccactttttgaaggggttgtttgattttttcttataaatttgtttaagttctttatagattctggatattagccctttgtcagaagggtagattgcaaaaatgttctcccattctgtaggttgcctgtccactctgatggtagtttcttttgctttgcagaagctctttagtttacttagatcccatttgtcaattttggcttttgttgtcattgcttttggtgttttagtcatgaagtccttgctcatgcctctgtcctgaatggtattgcctaggttttcttctagggtttttgtggttttaggtgtaacatttaagtctttaatccatcttgaattaatttttgtgtgaggtgtaaggaagggatccagtttcagctttctacatatggctagccagttttcccagcaccatttactaaatagggaatcctttccccattgcttgtttttgtcaggtttgtcaaagatcagatggttgtagatgtgcattgttatttctgaggcctctgttctgttccgttggtctatatctcttattttggaaccagcaccatgctgttttggttactgtagccttgttgtgcagtttgaagtcaggtagggtgatgcctcgagctttgatctttttgcttaggattgtcttggcaatgtgggctctgttttggttccatatgaactttaaagtagttttttccaattctgtgaagaaagtcattggtagcttgatggggatggcattgaatctataaattaccttgggcagtatggccattttcacgatattgattcttcctatccatgagcatggaacgttctgccatttgtttgtgtcctcttttatttcgttgagcagtggtttgtagttctccttgaagaggaccttcatatccttgtaaattggattcctaggtattttattctctttgaagcaattgtgaatgggagttcactcatgatttggctctctgtttgtctgttattggtgtaggaatgctgtgatttttgcacattgattttgtttttattttcatttttttgagacagagtcatgatctgttacccaggctggagtgcagtggcgtgatctcagctcactgtaagctccgcctcccaggttcacgccattctcctgcctcagcctcccgagtcgctgggactacaggcacctgtcaccacgcccctgctaatttttgtatttttagtagagacggggtttcaccgtattatccaggttggtctcgatctcctgaccttgtgatccgcccacctcggcctctcaaagtgctgggattacaggcgtgagccaccgcgcctggtctgcacattgattttgtatcctgagactttgctgaagttgcttatcagcttaaggagattttgggctgagacgatggggttttctaaatatacaatcatgtcatctgcaaacagggacaatttgacttcctcttttcctaattgaataccctttatttctcctgcctgattgccctggccggaacttccaacactgtgttgaataggagtgatgagagagggcatccctgtcttgtgccagttttcaaagggaatgcttccagtttttgtccattcagtatgatattggttgtgggtttgtcataaatagctcttattattttgagatatgttccatcaataccgaactaccttgacgtcacaaggcaccagcagtacccatgattgcttttgcatcgtcagtgtagcaatgatggcagatggcaaaatggcaaataacatcttaggattattatgaaagtatttttgacgttattactccctgaatgggtcttgaggacctccagaagtctgtgcttcacccagtgagaacagctacaagacacctatcctggaggtatgaacgagaaatactgactgtggggaaaagaccgtggctattaacaaaaatggcttgttttgcctcaaaatttaccatgttgagcaagctggcagttgctaaagtttggccttaccttctccactgacaacttgcaatgagtatgcacattttaacattatgatagaagctattttttgatatacttctttttttctaggagaagagatcaactttgggaaacttatcacaaagccttcagaaggaacaactttaagggtagaagatcttgtaaaacagtactttcaaaccgcagagaaggtaatttcttacagttcacattttgaataatggctaccttatagtaacagattttaatttaggatatgtttagttgatagtttaaacaaaatgaatcctcaaaatgtttctatgaagtaagtagggtgacaattaattacattcatttgcagttgctgcacagcagggaaaattagtgtttaattaatgttagttattagtactgttattaatatagctgttattgttgatgttgttattctctttctttgtatctctgttgcaattattaaactgaataattttaacttaaatcagggacattcttaagtgaaacttagaagtaactagggtgacatttacattcatttgtagttgctgcacatcaaagaaaattagtgtttaattaatgttaattgtgaataccattattaacataactgttattgttgttgttattttcttactttatttgtatctctgttacaaagatctcaatccagatttagttttctcacatttggatgtaatttcagaattattctacaaacaaagacagccaaatgatggtgaagccactgaaacttacgtcataagtatatgccactctaagatcctccggttgtattagtttcctatgggtgctgaaacaaatttccacaaacttagtggtttaaaacaacacaaatttattatcttacagtcgtgtaggtcagaaatcgtacacaggactggaatcaaggttttggcatggctgtcttcctttttggaggctctaagggagaatccattttcttaccttttccagcttctagaggtgcctactatgttccttggctcttgctctccttttatcttcaaatcctgcaatgttgtatctctctaaccatttccccagagttatttttccttccagctcccatctgcctccctcttgtgcttttcaggacccttatgattacactgggcccacctggatagtctctgatactctccctattttacagacagctgattagcaacctttgttcctctttgccatgtattcacaggtcccagagtttaagacgtggacatctttagggggctcttattttgcctatgacactggttaatttcatctctattaatcatagctgccatttttggactccatatcctagccatcaggcctctacatttcacgtgtcctgtactcctcccccatttctggttttgactttgctttttctggttcctgatattagtaggcttaactacagctgttcactatattttttctctggtaacatatttggtaattttccttgctcatctataattattttgtaaggaataaaaactatttctgcatccagtgatttgtatcttacagaatgtgcagctctcactgctaacagaaagagggatgggtgaagcagtacaagaatttgtggacaaggaggagaaagatgccattgaggaattagtgaaataccagttggaaaaaacacagcgatttcttaaagaacgtcatattgatgccctcgaagacaaaatcgatgaggaggtaagtaactaatttgagtgtctaggtctatttaaatagtctgtctttaagagtagctctgagatttttttctggtaaatcactatttaacctctctgatttgtttagtttttctcatctataaaattgaaatgataaaatgaaggttaaattagaaaatgtagaaaatgcctagaacagagtcttgcatatggttggtactaaagtgttttgttccccatggatagtatcttctcttaaagatcctttgaaagggctttaaagtgaaccttgtaggatggtaatttttgttcattttaatttttttagtaagttttgattgagatcttgaatttcatttagaaaatttctgctaagcaagaagcagtggaaaaattacaggaaaagctgtctagacttgactacatagaaattataaatgtttgcatatcacattgtcaaaaaacaaaattaaaagatattgacatgaaaatatttgtatgtgggcagaaaaaagtttaatattcttaatattaatgagctcttagaaatcttaaaaataattaaacatttgatagaataatgaacaaaggacatgaataggtggttcataaaagaaatataaatagctaataagcatatgaaaatggtgtttagcctaggataatcaaagaaactcaaatacatcttttgtttgtcaaattggcagcaatttgagaaaaatagtatctagcacactgctggtagtagtattacgtttgaatagctttactgaaaagcagtttggcagagtatattaagaggcttaagatttaccctttaactcagcctgggaaatttccctatgaaaatagtgaggtagagatttgtgtatggagtgattcatcttagtgttgttcatagtggggaataattggaaatgttttgatacaataaatgttggtacatataccatataaaattttacacagcttaaaaatgacattttggaagaagaacatgagaagatatttctaatctaatgttaattgggaaagatttcaaagataaaaaactgcgtagtataatctcaattatttttattttatatgtaattgtgtatgtttatgtaaataaagaaaatatcccagatatattatcaacagttatgtcaaggtagttatattacaggggatcactttctctatttcccagattctccctaagcagaagaacaaaacaatgttatttaaaaaaaaaaaaaaaactcattcccttattttagtgcttttggttaacatggttctcttaaagccttatggtgtcaatgtgtaactaatattatttaataccaagtacttccagaggtaggacaggcagttcaccctctaaaaccattcactctatgactctggatgtgttgggtttgctaatttatagcataaatagatttctcaggtacataccagaaataaaacataaccatccccacctggagtgacatcatgactcctgagcagcaaagtctgtgtggggtgtgtgtgtgtgtgtgtgtgtgtgtgagagagagagagagggagagagagaaagagaaagagtgtgtgtgagtcatggtggctctgaccagacacccgtgttcaaaatcaaaacccttattagctgtgtacccatcattgagttatctaaacccacctatccctcagtatcctcatctgaggataaaatggtgatgataataggccctccttcaaggttgttgtaaggattagaagaattaatccatgtaaaatccttagaatactgtctgacacatagtgcctgttcagtgttcccactctgactctcatttctcttctgtgaatggcttagcacctttggtatgctacttatcacctagggcacgattacatactgtctcatcttttaaaatattgttattcttgtatttttcctctactgaatcataacaaacatgctgttatttctttcagcttaagaaacaaacaaaactctcgatcccattttcctttagctactgctctctgttcctcttctagagcagaatcgcttcaaagagttttctgtatttgctgactcattcttctctctccattttctattaaatctatccactcaggctcctgatcccatcattctagtgaagctgcacttgtcaagatcaccagtgactgccattgctaaatccactgtcagttttctatcttacatctcacttgaccttctttgaaacatgttttttattggatttcaggataccagactcttgttatcttcctgcctcactggctgcatattttcagtgtcttttgttgattcctctaattgctccagcctcttacattggagtcttatttgctgttccctctcccatatcatcaattgattatagattccatgagagcagctttttgtctgttttgttaataactgtattctcagtttctacgataatatatggcacattgaaggtgctcagtaaatatgtgctgagtagattattaaataaatgggcttaaagaacatatacatagctgtataataagagccttgtgagcaggaaccattaaaaaagaaacctgtagtctccttcttgataccaggaccatgctcagcaaaccttcatgagttgactcttaataaaaatggatcttcaggggccacccacttcagatcccatttcacagagcctcctggatgtcttgcagcaaggtgcacaagagtgatttgcaatgtaataaatatttcaagccttgtcaaggagatatttttgtttttaactagtttactgaagtgtaatacccatagggtattagaatttttcctgtacagtctgaaagactttttcagtgatgtgaaacattttggcagcaggtaatataattttgcttcgggtcaatatgagtttttttttttaagagtacattgtgcaattttaacgttaataattggaaaaatatgatttacttttgtgagacattgttaaatttgcaagttttataacataaagcatttcttaattgtagccccttgttttatatttacataactggaataggcaacatgtttgtgatttactctgttatgatctaggtacgtcgtttcagagaaaccagacaaaaaaatactaatgaagaagatgatgaagtccgtgaggtaattattctgctgcaaattcttgtgtttatatatcactttcttaaactagaataaccagtaggtttagttagaatagtcagtccataggtctaggggataggagtgagctggggttggcttaggatggctgcttttggttgatttcagttcagcctacaaatattctgctcattgctctttttttccattttgttcttgtctaaaacctgtttagcaagtgcagtgactcacacctgtagtcttggctacttgagaggctaaggttggaggggattgcgtgagcccaggagttcaaggctgcagtgaactatggctgcaccaccacactctagcctgggcaacagagtgagaccctgtctctaaaataaataaataaaaataaataaaacccatttaattgtatgtgtgtggggatatatacaacaaaagcccctattactcaaaataatatctctttgttagcagagcatcttatagataaaatcttatcttactgagctgatattattttgggcaaaaaagaaacttaaagtgttttggttagcaatgttaaccataagtaagcaagcatgggcaaatagacaatttctattatctattctaaaatattaaaattagcttaagcaccatcatcactgtcttctcagtctcattgcaggtttgaatctacaagttagcaaccatttacttaaatttggggcctctacctggtacttgttgaatttatgattgaaatgtattttcttattttctgattgcccttagtgttttatgattgctatctagtatttaaaagttataaactatgtactgttagttttgtcttgattgctttcattcagcaaacattttatattgtccctgttatgggttagatattctgctttatattaggactgtacatataaaaaagctgaggtctgtagccacaagattttctcaatttagtagataagagacatttgtgtaaggaagatatttattgaattatttttcctaggtgcccattttataaatgaggagacagaccagactcaaggtcatggagtggcgctagaatttgaacatatttctgactccaagtgtagacttttctatcatcctgtgtcctatcaaaattttagattattataatattaattcggtgcattgcaaatggatggttttctaaaaatgaaaaacttctaaaagtgtcatgcaacacatcagaatcactgttgaaatacacatagttgcaaccactgtatcttttacaggttgttttttggaagctaaggaaaagaagctatagattagaaatggcttaacacgtttattatatttctatttatcttataaggtgcatttaaaatagaaatagtttgccaaattgcaagaataatgctaggaagaaatgattcctgattcttaaatatctagcttaaaattgattaaccctttcaatttaacagggtacagaaatatttctttacgtttgagtgagttcttcatgtttgaagcgacaaacctcaatttttcattaagcttttaaaagagttaagagtgaacgtcttatacaaggaaggtgggagaggctgtgacaaatttcatatgggagttttacagaagaaataacttacaagttcagatattcagctatattttaagactaaaatgtaattggggcttcctaggtaatttttcagcatatcataagatattatatattttttcattttcagcatactatttagaacttaggtaatggagtctgaaactctgccaagctgtaattcacagctttgcagaatcatttggcttagaatatgaatcccagcgccatgcttaaattacttatactgacaaacaagactattagctcttctatttggagaaaaaacagtatgctttaaagtctttcaggctgggcattgtgacttacctgtaatttcagcactttgggaggccgaggcaggtggatctcttgagctcaggagtttgagaccagcctgggcaacatggcaaaaccccatctctacaaaaaatacaaaaattagccaggcatggtagctcccacctgtagtcccagctactcaggagacttaactgggaggatcgcttgagcccaggaggcagaggttgcaatgagccgagatgacgccactgcactccaacctggatgacagagcaagaccctgtctcaaaaaaaaaaaaaaaaaatcttttgttcacatagaaaaactctcaaatcttttctttaatgataaattcatatttgaataaaagagcaaacagtaaccattaggctttgcgggacatgtgtggtctctatcacatattcttgtgtttttttgtttgtttgtttttttattaatggccctttaaaaatataaaaactattcttagtcttacccacagtcgttagtttacctggcctctgatttcttatgttctacctcaatttgaggtgggttgataccctctttcaaaatataataccaggcactatcaatagtgaagaagtgacccacagaatgagagaaaatatttgcaaatcatacatctgataagggattaataagcagaatatatttttaaaacttctaaagctcaacagtaacaataacaaaaaaacccaatttttacaatgggcaaaggacttgaatagacatttctccaaagaagctttacaaattatagcacatgaaaagacactcaagatcaccagacattagagaaatgcaaatcaaaaccacagtgagataccacttcacacccattaggatggctgttattaaaacaccataaaataacaagtttcggcaagaatgtggagaaattagaaccatatacattggtggtggggatgaaaaatgggtcagctactgaggaaaacgatagcagttcctaaagtagttaaacatagaattatcatgtaatatagcaatttcacttctaggtacataaccaaaagaattgaaagcaggaacttatttgtacatcagtgttcgtagcagcatgattcacaatagccgaaaagtggaaacaacccagttggtcatcaacagatagatggataaacaaaatgtggtatgtgcatgtaatggaatattattcagtcttgaaaaggaatgacattctgatacatgctacaatatggatgaaactctgaaaacattatgagtgaaaaaaaaacagttgcaaaaggacaaatattatatgactctacttatatgaggtacctagagtaatcagattcatagaaacagaaggtagaatagtggttactggggagagggaggaatgtgaagttactgttgaataggtatggagtttcagtttgggatgatgagaaagttctatagatggatggggggatgattgcataaccatgtgaatgtacataatgtcactctactatacctaaaagtggtaaaaagagtaagtttatgttatgtatatttcaccacaaaaaaaaagtgtttaacagtaggatagtatgttttcaaatctcacaaaatgtatatggaaacatttttgccattggctctagacctgcactcatgagttaagctcttagaagtaatacattccaaagataacagtaaactctgtttttcataggaaaggtagagttaaaatacaatttgaatatacaatttgagatgataaaaatgaagatacagtatttagacaaagggaaaatacaaagtttagaaatgatggttagtaattgattccaagaagtaatcataatagggcatatttattttaaattttgctacatactgccacattagtccaaagatgtcttaactagtttatattctcaccattagtatttgggagtgcttgtttcctcacatctttaccatcgtgatgtattactgtatcttttgatctttacaagtctaaggggtaagaaattatttcctactgttgttttcagttcatactacttttttttactaatgagtctgcctaatttttatgtttataaatcatttgtatttatatgaaacacatggtcattttgtttggccacattttctctttcgagtagggtattggtctttctcttttttttttttttttttgaggcaaagtctcactctgtcacccaggctggagtgcagtggtgtgatctcagctcactgcaacctctgcctcctgggttcaggtgattctcgtgcttcagcctcccgagtagctagcgcgcgctaccatgcccagctaatttttgtatttttagtagagacagggtttcaccatggtggtcaggctggtctcaaactccttaccttaggtgatccacccgcctcggcctcccaaagtgctgggatgacaggcatgagcaaccgcgcctggccgggtattggtctttctctaattgatttgtaagagcactcacttgaacacatttgtgtgtgtgtgccctctctttctctctctggatatatacacatagtaatatagcatatttagggttttttgacacataaagtatccacttattcatcagcttatttgtttaaatcaggaatgattggtgattacatggttctgattttatgaagatatacatttgggttttttctttctttgttccattaatatagtgagttatattattatgtacatagcttattgacccatcctggtaatatatccattaccccctggtaatggatatattggtctttccataagcttctggagtctctatttgctttcataattataaataagattctgtaattttctttttgtgcacgcagttctttgtcagtactgtgtcatactggcattgtgaaaacagtttggaagctgtctttctgtatgctctggcactattgaaatagcagtgggcttatctgttttttgaaagtttggtagaatttacctacgaaactttctgattgtggtccttttttgggagtatttttcttttaataattttctcaaaattttctttgataattggtttgttgaacctgtttttttcccaccttggatcagattaagttattcattttccagattatttagaattgagcattctctcataagtcttgggtcttccctcccattcttccttctttctttttttcgagacagggtcttgctctgtagtgtgctaccactcccagctaatttttaatttttttttttatatagacggagtctcgttatgttgcccaggctggtctctaactccagggctcaagtgatcttcctgacttggcctcccaaagtatagatgtgagcttctacacctgtagtgctagtattagagatgtgagcctctacgcccgtccctcttatttctaatgatgtatatttgtgttttcttcctttctttaaagctttgtgatttttattaatgttattgttttgtcccaaaggaccagtgcttatatttattcattctaatgtgtttttgtttaaaatctattaatatatggtttcatcttcattctaatacttggataggctttattttgtttctcctagctttttggatacagaattaacttatttacatttattcttagcaggctataggctttcttataagcattgctttagctctctcatatgttgtgatgttcagtattcttgttatgattttctagatgttctgcaactttcgttttgttttatagttttgactctggtttgttttcaggaggcaggtttttgctttattattaattttttattttattgcatgatgattagacagtgtgataaatttatttctcctatcaaaaatgtattgagatttttgtttgcaccctgttatgtatcagctaaaaagtttcatggggtcttgaagtatattattaattttcagtgtatagaattcaacatttatcaattagatctatcttattaattatgtgatttagatcatcttttttctcttaagtctgctttctaaaagcatacagctggttccttttatttgtggtagttatgtcgtataaaatcacttccagcacagaattagcaaatggtgaatcattgctcctaggggaaatacaaaattagctttctatgagccactgataacgtttttgtcagctgatcaatacgtaatctttttaatgtgtttctgtttaaagatactgtatttaacatttgattcattagcattgaactcatagccagtagcactttaacttatacttgaattaagtttatctaatatacattttttctccaaaagtcatattgcagcctttttgcatgtaggaatgaacactaaacatgttgagggggtcatttgaaaacaccacattaccaaagcaaaagtacaaaaatgcagaaaatgcaataaatatgtagtcatgtgccacatacaacattttgatcgatgtcagactgcatatccagtggtggtcccatgagattataataccatatttttactatatcttttctattaagatatgcttagatacccaaatacatagctatggtgttataattgcctgcagtattcagtacagtaacatgttgtacaggtttgtagccaaggagcaataggctatctcctatagtctgggtttgtagtagactgtaccatttagctttgtgtaagtacacactatgatgtttgcacaataatgaaatcacctgatgacacatttctcatgaggcatccatcattaagcaatgcatgactatcacagaaaggacactttaaagtacacaagtggaaacaagaaggcagagtggctcattgttcagcctcagctgggaatatgtgtgtcaggcaattcaaaatatttaccactctgcgtctccataaatgatgccaaaagtatcgtgagtgttgatttttagggttacagagaaattttggcaagtcggtgaatttgcaaatataggattaatgaataatgaggattaactgtatttcatgtgggacaggaaagatgaattgaaatcactgttgtttcttatattttttgttgtatttcctgaagtgttttctttttgcattgtaatgctgtattgaaccctgcatgcagtgagttagctgtgatttcacctcagctgagatcatctcatcatgaagttgccacttcagtcccactttatgctgcctgccttgttcacatctcctcatttagccctgggtctccttactttatggtatcacagagcttagaaatgttctggtcagctattcttagacccagaactgccattccaagcaagagagactgttatcatgtcttcttgggatttatacatcagttttggagagctgtataatacctgaaactcttctcacctttctcccttagctaggtcaaatatttatcatattcattaactcttctttatagtttgtgtgtttgggggtttggaactattttttaattttatggaaaatgtattttgtttttgttctcttactaccttttgattggtttaagggaagatcaaggcaaaattgcttttatttatattttattttattttttggtgacagggtctcgctctgttgccaggctggagtgcagtggcacgatgtcttttctaaatggattcttaccaaattaaaaatgcgtggcatgttcttggtcctaaggtgtttattccttcttaggcttaggctttcagttgatatattctccttaattcttccgtttcttttcattttttttttaggcaaggtctcactgtgtcacctaggctgaagtgcagtggtgcaatctcagctcactgcaacaactcccctccccactgcttcccccaggcttgagcgatcctcctacctcagcctctcaagtagctgggactacaggtgcatgccatcacacctggctaattttgttcttttgtgttttttttttgtatttttggtggaggcagggtctcgccatgttgcccaggctggtccctaactcctgatctcaagcagtccatccacctaggcctcccaaagtgctgggattacaggtgtgagccactgcgcccagcccttaattctctttaccatatatttgtgagagattgttactcatgtttttttctgattataaaactaattttttagaaaaagtgtaatatagaaaatatgtaatattcaagaacaaaaaacaaaagcaccctaaaatattagtgcccagagataacggctattttttgtaagtttttttcttattatttcctaggagccgattctaaaaagtagctcaaatgatgacagtctgttactgtcaaatgtggcattgaattagggatgattgccagtattccttctagttctgaaaattttgattctgtaaaattttatttttcttggtaaaccttttcaaagggtctcattttataggtagtatggtagattggtctgacagataataagtattaaatttgattggtggggaggttctcctttacacatatataaatattttttgtttttatttttatttttgagacagggtctctctttgtcacccaggctggagtgcagtggtgtgatcatagctcactgcagcctgtatctcctaggctcaagtgatcctcctgcctcagcctcctgtgtagctcgggactacaggtgcatgccaccatgcctaattttttttttttttttttttttttgtagagacggggtttcgctgtgttgcccaggcttgtctcaaactcttgggtgcaagtgatcctcccgcctcggcctcccaaagtgctgagattacaggcgtgagccactgtgtcagcctcctttatgtttttatagtatgattagttcatgtcaatgcctaaattaatgatttttaggatggtacgttatctcattgtgtgtactttctccttcttctccctcttaggctatgaccagggccagagcactcagatctcagtcagaggagtctgcttctgcctttagtgctgatgaccttatgagtatagatttagcagaacagatggctaatgactctgatgatagcatctcagcagcaaccaacaaaggaagaggccgaggaagaggtcgaagaggtggaagagggcagaattcagcatcgagaggagggtctcaaagaggaagaggtgagcactgagttcagtcctgtgcacattcacacttggcagttgagtggaaaatacagaattagatcttgtcagagttgaattataagttttatttctaaaacacggttctttaaaaatctatttttataatatataaagacagtctttaaggcagttctgacatgtgccttttacttaaataaattttgaatggccacatgcacttagggttttaattgttcttagcacataccttataaaagcttcactgtgtttgtcacgtagtaccttttggatacatttaatgtcatatgtattttcacatgtgcaaagtaataggcaaatatgagttgttaaagaaaatagctaaaagcctttggcaacaggaggaaaactccagatcatacaattattatttttgttactgtcataagatacaaatacacatatgcttatcaagtagtctttataaagtcagtttaagaaagaaaactgccccccaatttgattcctaaaactagtcattaacatagtcaacattgtatttactgtgagactattgtcattgaatagttcacgccaatagaaattggtcactcagtgactttctcacacattatgtcagttcatctctaaagattttttaaaattgtttttattaaatatgcatccataggaattttaagctggtgaaatgaatattaatttggtttaaaatctccagggagagaaatcctcatcttttaatgatgattattttcactattcttacatttacaaaatttttccttaaaaatttttatttttgttttttaatttttcttgagatggagtcttgtctttgctctgttgcccaggctggagtgcaatggtgcgatttcagctcactgcaacttccgcctcccaggttcaagcaattctcctgcctcagcctcccaggtagctgggattacaggggcccatcatcatgccagttaatttttgtatttttagtagaggtggggtttcaccatgttggccaggctagtcttgaactcttgacctcaagtgatcctcccgcctctgtctcccaaagtgctgggattacaggcgtgagctaccacgtccagcctatttccttacattttaattggataaattaaattggataaactgaagtgtggcctaaaagaatagtctctgaaaattggtcagactctagatgtttgttcttatatatatgtctggctttttacagacaaactatttgacataagtttatttagctttcattttttagtgttgtatgaaataaaccttagctgctgataggcttgtacattgactgttcatttttctaacagcagacactggtctggagacttctacccgtagcaggaactcaaagactgctgtgtcagcatctagaaatatgtctattatagatggtgagtatagactgcaagtgattatttataaattccaacattagaaagaccaaggtaatcaccattggtagcccttatttgtgttgcaatcattgggaagttataagggcaattaggatcacaggataaattattttttaaaagatctttgctatgcattagagttactgaagagggtaagcttttaaaatcatgttttataggccaggcacagtggatcacacctgtaatcccagcactttgggaggccgagacaggcagatcacgaggtcaggagatcgagaccagcctggccaacatggtgaaacccggtctctactaaaaatacaaaaatcagccaggcgtggtggcacatgcctgtagtcccagctacttgggaggctgaggcaggagaatcacttgaacccaggaactggaggttgcagtgagccaagatcatgccattggactctaccctagcaacagagagagactccgtctcaaaaacaaaacaaaacaaaacaaaaattatgttttataatttcttactttcagacaaatgctgtttctgtttggcagagagaccctggaaacaggaaagtgaagtagttggtcactatatggacagtggtcgaaagagagaggaactgtctctactgtttccttgcttcccccatactgccctgtcagtctctgctttccatatagagaagtcatgtgacctatatttaagagaaattatggctaggcccttggaattaatttgtgtatatcctatggtctaaaaattggcctcaaggggatctgtttaactatttttaatattatagatgatgagatcagcctaaaatgttagtcatatttacaaaaagtatgcattaagataggtggtgatacttttttctacctagcatttagaatatattcatatgtatattatttatattatcagttatttgaggttattgtttcacttttataattataaatattttttaaatattataattgtaatatttataatcttatagctaggattaattgttgacacactggggagctgaactaattctcagaagatgaagtttatcaagggtaatataaaccacatttatgtccaaaaggacagctgcacaagtagagttgtgagaggtatgtgagtttaacagcaacccaggtgaaaaagacttaggtcagtaagagttatgcaggcatacccaactgtccaaatctattgatattttaaacagcatttaatgagtcttgcagaggtgtccaagggagagaatacagtcatggattcttagtttctgtttctggttgggccagtaaagcccttttctcatccttcttttcctcatatcactagcgacagaaactaaaaaccatggcttcagctgctaaaagcctaaaacaaaagaaaacagaacgaaaacagaacaaaaacaataacaaaatgaggtgggttggacaagcttgcacagcaaggaagttctctctgtgtactaaattggccataacatgccaaggatactgtactcctctttggaattatatttcaaggagactgtcaactatatatgatcattcagaagagataccaaataatataaaaaatggttggccaggcgcagtggctcatgcctataatcctaccactttgggaggctgaggcgggcggattgcctgagctcaggagatcgaaaccagtctgggcaacaaggtgaaaccctgtcccctactgaaaatacaaaaaattatccaggcagggcggcgtgcacctgtagtcccagctacttgggaggctgaggcaggagaatacttgaaccgagaaggtggaggttgcagtgagccgagatcatgccactgaactgggtgacggagcgtctccaaaaaaaaaaaaaaaaaaaaattggttgaaggaacttaggatttaggatatctaacctgggaaacattcagatctttatgtagattatgttctatcgtgtaaaatgtggaatgaatagatttgatctgtttagtcccaaaggcaatgctttttaatctattttggcttatggattctctaaaaatctgatgaaagctatgtcttctctccttaaataagtactcacatgcaattgcacccaatttcaaagggttcagccactcccatgaggcgcattcgtgttttccagcttaagaactcctggcccaatggggatggatgggaatagctagaaacatactgatttaagtttctcatctgatagaatggacctggaagatttaagaacaactttgttcccctgttttatatgtgagggaactaagccaagcagttttgccctgagttgataaaaccactaatagtagcaataatagctaatatttatgaaactgcatgcctcttaacaggtctgtggggtaggtacttactatattatttctgttttacagaaaaggaaacaggctttaaaaagataggtagcttatcctagatctcataacttgtcagtaccagatctgggaatgatctcacattctctgcactctacaaccagtagttgaccactgtactagtttccagagcaaggtaagattagagacctagctactagttctccatagaataatttttgcattatgcagaataacctatgtaattaatataaagatggactaatttgccttggaagtaagtatcactccattaaaggaattttcaacatttatcaaatgacagctgacattgaagaaaagatacaaaatcaggttgattaaatgactcttaaaccttacaaaaaattccattgctatatttttactcaagtattatttagtacttcagaagagctagctaagatccttagctttttgcttcacaaacatgttgtctttattgccatttagggagtggtatctggaaagatgctgttccattcttggtaggtttaatataaaagcagagaggaagaaagagagaaaaggcagcctggaaaattgtaaaggattcatgctgagttcaaccttgcattcaacaaatgacagctttgtgacttgagacaaatcagtcactctcctagtttgtttagatatgattggaaataataatctctattgtattgggttattctgaagattaaatgatcaaaaagcctggcacagtaggcatttatcaagtgttcttttaaaaatgagaaaacaggaacatagaaaaagagtgaataaaataatgaacacttccatgttaaaccaccaaaattggttagcatgcaatcgacagagtcatagatgtagattacccacctttaccttagcccaaatcgtctttttttgtcctgtcttgttttatttttcttttttgtttttgtgtttttgtgtcctgtggaatccagtgtcctggcttgttttatgttaagctttccttgactccagtgggtagaattcatcacttaaaatgagtcgtctttgagtttccactgtaattaagaaatcagatatcagttaagcttgttggtttttgttttttaaaaaataacctgtttttctctcagcttgctgtttttggtgttctgcagtttcactgtgatgaatctaaagatggtactcttgtttagcctgcttagcaattattgggcttcatgaatctctgaactgctatcttccgtcacttctagaaaatccttagctattatcccttcagatgttacctctatgctattcttattctccttctgagtcttcagttaaataatgataagacctctttactctctcctcacatgactcttgtattttctgttttctctttctgtgctacattctgaataattatttctgatcactttttttttttttttttttttttgagacagagtctctctctgtcgcctaggctggaatgcagtggcatcatcttggctcactgcaacctctgcctcccggggttcaaacaattttcctgtcttagcctcccgagtcgctgggattacagatgtgcactaccacacctggctaatttttgtatttttagtagagacacggttttactgtgttggctagtctggtcttaaactcctggcttcatgtgatcctcctgcctcggcctcccaaagtgctgggattacaggcatgagccaccttgcccagcctatttgcttcctttaaaatatgctctgtcacttttaatagtttttagaagttttctgaagatatttttaggcctgttttaatttttcgtgtgtacacagtaaggacttcttttattttgtatctaataacctagtgtctgaatgtctttggcctctttctgttgtctgtttctgtgggttcttatttatggtgacttatttccttccatgctttgttacttactgtccctagaaaattatcaacaggaataatttgagaccttggatgaagccatcttccttcagagaagattcacgtttgtttctctaggtttgtagggcaccacaagtcatagaccactttaagctaaatttgagggtttcttggaccagtcatttgatacgtacttgtaactaaaatgcaggttcagtcacttgctgcttgcaaagtccaattaacaagagcaaggtgtggtataaagaaagtgactttttattccaaagcgaacttaggggaagaaatacaggcttcctaccttaagggtactgcttccccctttgcagcagaaagtggactcttttaaaggggacctatcaggagtggcatgcaggggaggaagcgagcaagtggggggtttgcattctagtttggtgtcttatctaccaggcagttgaattggcatcttcatgggtagaaataggctataaaggtggccgaatactctctaggttggcgagagtttcatagcaggactttggattgtgaattgactgttatctctagaggcaaccccctggtgggtgatagttcaactctggagcttccaagcacatagttagatgaactccccttttagggagtctctgatgaagaggaagtaaaagactatagttgcatttctaaagaactaagtagaaagtgggggaaaggagaaaagaagagagagaaaaagtaatgaactacctcttagaaaaatgagggtactcagttacatgcttatgaaatcctgtttacctctgcttctctcttcaaccactggggctccaccttaggaagggaaatgcatcggggttttcactttgggcagccgtgggctgtggtagccctctctatttttcttcaggattctcaaaaccaatgttaacattttcccaattgaaaagtgaactcagggaaaggactctgcttacctctctgagttctagcttttcttcagttttggcctggtaattccttggtatgtgatcagctcttcaatgccattgagaatttttttttttttttaaatgtttgaggtactaatttggattgttgtcagcagaagtgagtttgaagacaatgagaggtcattttgtctgaataacctagcctgcaatgactgttacccattgacaacatagaataaagcttctatttgtgtagaaagactggagaccagttatgatgccttaaaagttttacagaatggcttgactaatttttttaaggaaacagtattcatctatgaaaagaggctatgtaaataaactaaatacgaaacgtcagatttcctgaattatgttgtaagcaaaaatcttattatggtaccttttgcagcagagcatgatggttaagaatgcaggctctggagtcaggtccattgggtcagtcacagccagctctttactgctggcttagcacccttgcactgtaagtgctgtgagaaaggggtctgcatcattcctcctcatcactgtatccactatatttggcacataacatagtagatgcttgttaaatacttgacaatgactgagtaaaaattacttggagattgtgtagcgtaagggtgaagaccatggttctaaagtgaggaagatcttggtttggatcctgacttctcaattttactagttgtgtgtcctccagcaaatatgttaagtttttcatctttaggaatgagtgttctcatctgtaggatgggacaatgattgcgtccacctcattgcgttattttgaggattaatgagaaaatgcatgtgaagtatcaggcagtgtctatgcatattaagccctcagtaagtgcaaactggtgttattctacaagcatcagatcccttagctataaaatttgacaatgttgtactgacttcagagtaattttattaaatgagcttaagtatttacagtactgatcacagcacctggtaaaaatgcgacagatgatagctgttattaatattagtggtagtgttttgcaataagattatgaagatgaatattatgtgaatcattggtctaaatttgtcttttatctaattgatttgatataatggtttcgctaacttaactgattacctccagtactaggcctttttttgaaaaatgaactgattttttaagtataaatttgtgaaacatttttatcaggttggatttggtgggtttttttttaagtctctgacagaatacctgtgaagtagtaactatacttgtcatcactttgggacagaagcaacaaattaagactgtaacttctagatctctgttttaaatggaggagtgaagagataaataaaggtcaaattctcttataacaaggtccatggagtatggaaatttattattgtgctgcaattttattggaaaagataaaaattacacttgtagccacgggagttgtaaataggagttgacagcccagatttttccattgaagttagtcagcagaggatagtggctaggtgaataaaagtacctctgaagtcacggcctttacatttcatttataccactatgggtaccactgctgctactatgtttgctacccaaacagctacatgtatttgaatgctttctatctgctagacacttcctcttaccctctcagcagttttctgcatgaagtattaacactgttttacaggcgaggaaattgagttttaaagaagccaaggagcttggccatagtcaagctagtaagtcaaaatgagtctaactccaaaaccagagcttttaaccaccacactttattgtcttcctaacagaacatattgcttagttttctgataaaattatttcacaacatcactcatcttttgccttccagtgggataaaaagaaaggtatcttgttttctaggatctcagagttaaaggagtcagtgaataaatactgaacagaaatattctttgaaatcatcatgatcactggattttttattcagttgctctgtctagccttttgagtagagtaggatgtgaaaaaagtaactgagtaaagcagataagaacactgtttctgcctctcgtttctcctcttagatattacaagtttggggacagaacctagaataggaaacatgtgcaaacacaataaatttaggttagatagaaagattcgttagttttctgactaggagaattttggactttgcaggattttttgagtatttgtttgtttttctgtgccctatttagtttgtgagttatcttggggaagatatttttgatattagcaaactggtaaggcataggagaaaataaacctaaattagacgtttgaaatttattgtaggttttgttttgttttgttttgttttgttttttgagacggagtttcgctctgttgcccaggctggagcacagtggcacgatctcggctcactgcaacctctgcctcctgggttcaagcgattctcctgcctcagcctcccaagtagctgggattacaggcacctgccaccatgcctggctaatttttatatattttttagtagagttggggtttcaccatgttggccaggcttgtcttgaactctggaccttaagtgatccgcccgcctcagcctcccaaagcactgggattacaggcgtgagccactgcgcctggccttattgtaggtttcgatgtcaaggaaaaagaaagggaaagataaagagctagctaaacttcaagtatctaaccaagtttaaaaggaaaaaaggtatggatacaaaggaatttttatcatagaatgctgttttctagaattctcctctggaatatttcttagatattgaatatggctactaaggtagaggaaaatgagaaactactggaaccccatggctcctaatgtagcaacagggataaaggtatcgtcaacaacaaagaagggattaggaggctttccttcaatacatttgtagttcatttggttaggtgattagattttatccttcaggtgtttttctatgaaatatttttagtgtgtgtatttataaacactacagtatctcaataagctgggaaataatgagactgacagttgggcattgagttatgcgtacctataattctatctccctttagatttttaaaaatatcaaatagttttataattaggcatcattcagttttgcagataggactcagaaaatctttagctaaagaagtatgcaagtttttctaagttattttaagaataacataatgcacatttcatctttttcattctagcctttaaatctacaagacagcagccttcccgaaatgtcactactaagaattattcagaggtaagaaaaaaagttttatggttgtgtattaataatttatgttttctgcattatgaattgtcaactctctgatttacaaagtaaataaaagaagaaaaattatggaacattaaagctggaaggagctttaccaattatctctagggcttctaggatttgattttttttttcttggttgctctctttttttaaataatggttattatagaaatccataaatgttatgtatacagtaatgttttcaaggataacagtgttgaaccaaaagagctcatacatggaatactaatattgaaggtgagttcaatggttatagaggttttttctatgctggatttccttttgttacttatcttcccaaaatactagctgtgccttaacagctgttgctagacttaagatgaatgaaaaggctggagtccagcgatccatgtggtttgccctaggtttagcctgggccttctgctcttcctttcgattccaagaagagtccaatatgggcttgattctcttattacttcactttcaaaactgtgtgtcttaactcccgagccaatactcttccctttacatcagggtttctccatagtagcactgttgacattttggactagataattctttgttgtgaagggttgtcctatgcattgtaggatatttaacagcatccttagcctcaggggctgttcgttcagtatttggtctttggcttcatcctcatctgtacttaagttagatgaagatatggcaaatgtatgtatcaaatgtcaagataacaaaatgtagagaaatagtattttgggtggtagaatcaacagtcagaaatatctttattgggtcttaacactaacaaatggtatttaagagggacagatttaacagaaagatatctagtatttcccacatggtctgatacctcatttaaagttggagatggaacactgatggtctcacctctcataagaaactaagaggaaagtcataaggtctgcatatgagcctatgcaagtcattcaccagtgtaactgtgttcccttaggtgctcaggctcctgggatggccaggagagaggtgagcaaaaagtaacatttgtgaatgaagagggacattggagggaggtcagactgagtgttagttttaatggttatggctttctgtctccttttttgtggctcatatataacttaagatttaatcgtgtaattcatttcttcattttcatttttattcagagtctattctcacaaaaactgtttgttgctttgtttccttgccaggtgattgaggtagatgaatcagatgtggaagaagacatttttcctaccacttcaaagacagatcaaaggtaggtgcagtgattttctgcaaaagaaacatctgaaaaaaattaaaaattatccagaattccaaagttacacatttttctatgccatgtaagtttaacagacttattttcaactagtaaagtatgtagaggaatgaaaacagaccaagggctagtttatagagttgatgcagcattagtacaaggattttcagtgaaaattgaaatagcctgtaatttttttccttttgactttattagtgcttttctttctttttatttatttatttattttttgagacagtgcctcattctgtcgcctagactggagtgcagtagtgcgatcttggctcactgcaacctccactttctgggctcaagcaattctcccacctcagcctcctgaatagttgggattacagacgtgcaccaccacacgtggctaattttttgtatttttggtagacacagggttttgccatgttgcccaagctggtcttgaactcctgagctcaggcgatccacccacctcgacctcccaaagtgcctggattacagatgtgagccagtgcgcttggcctcagtgcttttcttaatggaagactgtgttctctccaaataacagaaaataattttgtattttgctatcatttgatttcagctttttgtcattgtcttatttttatattcttaactacacatggtactgtactaaacacttaaaaggggatcacgtagactcagtctgccttcagaggacttgcatgctcttcctgtgtgttttgggattttttgcctattgctgttaagcttgacttgattcactattaccatttgcttttatacgttaacattttggttgaatactgcttaactaaagctcgaataatgagaatttctacttaataaagtaatcaactgccttattttgtacttattttctgtttgagcattatattaggtctgatgagggaggggcataacgaatgttttaatatggcctctgccttcaggtaacttcaattatagtggaaaagagaaatgaacatatttgaattcatcaaagaatgaattagtacataattaggtgtagaattttatattacagacccataagtgtgagtgcttatgggctggtgaaaaaaggaacaaggaatgtgggctagaagaagcagcttcatggagggaataaaattgacctgaggtttcaaagataagatttggcttagtagggtggaaaacggtggtcccagctgagaataagggcatgagcaggaactccagaaagaagggtgattgaggaaaaagccttatatcagtgtttctcaagctttttttccattatctcagccatttcttgattatccaaggagaagaattaagtaacttagatgtaagtcaatttctccctaacgttagaaattaaatacttaaagaatgaaatttttttgggtatggttgagtctgagagggccaaaaaccgtagctttttcatcccactctatcccctggagccaatttttgttctttatgatactgaccccactgagaatataagctgtatgtgacttaaaggttaatgttagagcaagtgtaagtatagttccacgttcacttattagatccttcaaacatcatgctaggttctggggatagaaagataaatgtttcttccttcaaggaatttacactttagtggtatgctaattacagggcactgctaatccaccaagataaatgttttcttcaggtgtaatgaaacctaagggacgtgccagtatcttcctgggaaaggtcattgaaggttttacaaagaagataggtgacatttgagctggtgatcagccgatcagttagcatgcattaaaggaaatgatctggtgtagagagaagaaacagtggcacaggacgggcatctactttgaaggatggtcatggaaagcctctgaggaagctacatttaagcggaaattttaataagggaaatgtggccttgcaaaaagcagagggacaagtgcatgcagcctgtattagtccattttctcactgctgataaacacatacccgagactgggcaattacaaaacaaagaggtttaatggactcaaatttctacatagctggggaggcctcataatcatggcagaaggtgaaaggcatgtctcacatggcagcagacaaaagaagagaaaaagagccaagtgaaagatcttgtgagacctattcactaccacgagattagtatgggggaactgcccccgtgattcaattatctcccaccaggtccctcccagaatacttaggagttacgagagctacaattcaagatgagatttggtagggacacagccaaaccatatcacagtctattgaagaagcaagtttaataatgttatttaggagccaatgactaatgtgtggtggaaaaggaggttgtttgagatgagaatagaaaagagacacagggtaaatcatgctgcaggaacaggtgagcactacaaaggtattggatgttgttataaatgcagtgggaatccacagaaagattttaagagaggagtggcaccttgtgatttacatttacaaaggatcactgtggttgcagaacaagtgtaaacaagcttatctgaaaggagggtgctgcaggtagtctgagctaagagagacgatggaggcttgcacaggctggtggtaggtgaaatggaggaaacagatggtttcaggatatattttgaagatagacatgacaaaacttgaagatggattaaacatttggagtaagggagaataaggaatcaagactgattttctggtttcttgctggagcatttacattgtgccatatattgagaaggggacaaaagaaaggacagatgtgttgtagggaatgataggcatataattaaaagttccactttagatgtgaaaagtttgagatgcctagaaacttacatgaagggaagttataggcaattgaatgtgtgaattcagaactcagataagggtttttgttttgttttgtttcgttttgttttgttttgttttttgagacggagtctcgctctgtctcccaggctggagtgcagtggcgcgatctcggctcactgcaagctccgcctcctgggttcacgccattctcctgcctcagcctcccgaatagctgggactacaggccctgccaccatgcccggctaattttttgtatttttagtagagatggggtttcaccgtgttagccaggatggtctggatctcctgacctcgtgatccgcccgcctcggcctcccaagtgctgggattacaggcatgagccaccgtgctcgtcccagataaggggtttgaaatggtacttacatttacctctggacagcgtgcagatggtacttaaaaccattgggatggataggatcacctcaaaaaagaaggcagagcagaagagtgtttgttttcctagcctgcagttttaaccttactcagcctttgggtagagtagaaaaaaacaataaagacatgagaaaaatccgggagagtatagagttgcagaaggccgtactggcctttataggagtaaaaaataccaagatgggcgcagatgcaaatcagtttatatgtctatggtaagtagtggagggacttattttagctcacgaaggtttacttgaatttctcaggctcatttatgtgtatttaacaggactcctttggttccagctgatagaaacctaactcagattctcttacagaaaaggagatttattggaagattatcgggatacctcaggttttggaaggaagtaagggcccctttctgagtccttgtttggttgttcttgtctttgtaaattgaagcacacacaaatcagatctagctttctaagtttttttttttccagaaatggatcaaaatgctattctgatatttttgatatatgcttaaggatattaaagaaaaaatagtttgcttttgatatcacagtagattgtttacttttcagctgtataaatgtctgccgatttctttagacatgaaatagtaatataactcacagttgtttggtacttcctatgtgccaggcacttctctgagcattttacatgtgaattagcttgcgtggtgctcacaacttccccaggagatagattatagttataactttatcatccccattttacagatgaagtgtgaagcacagtggctaagtaacttacctaaggtcacccaactagtcatacagtccaggcattctgaccccaaactcatctctgttgttgcttcttggtatggtaactaacttctctgaccattgtgcaagcaataagaatcatttaagttttgagaggctgtttaacattttagaggcaatttccaaaattgacattttggaaacacatcagaaatcagctttggcagattggtgtttctaattacagcatctaaatgataatttagactgtttttgcagaatgttttagtaattgcaggttatgcatggtgttttatttataatttaaactatttaagctctgccacttaccagagtggaccttgataattgtgctaatctgctacctctgaaccttagttgctcttcaagtttgcctgataaatccttctgtcctttcctttagtgcaaaggacctgtgaatttttctatttacttctgacataagatctcgtgattctcattcttttttccagataaaacctttggacatatttcttttgctataatgacatcccaaagcatgttaataaaattgtagactaagaatttataaacactacttttattgaagacgggaatcagcagactttttcttaacaggccagataaggagtattttaggctcggcaggtcaagaggcaaaaccggggatattatgtaggtagacacttgtataaccatttaaaatgtaaccatttcaaaatgtgaaaaccattcttagcttataggccataaaaaaaacaaaacctggtggtgggctagatttgcttactggccccgatctaaagtgacttaaatttcttattaattaaaagacataggaatttactgcaagttaagctttgtaagagtaggaatcggctgggcgtggtggctcacgcctgtaatcctagcatttgggaggccgaggtgggcggatcacgaggtcaagagatagaggagatagagaccatcctggccaacctggtgaaaccccgtctctactaaaaatacaaaaattagctgggcatggtggcatgctgagggggctgatgcaggagaatcgcttgaactgggaggtggaggttgcagtgagccgagatggtgctactgcattccagcctggtgacagagcgagactccatctcaaaaaaaaaaaaaagagtaaaaagagtaggaattatgattttcttattaactgagatttgaatagaaaatatttcaatgttcccatggttttcagaagtggaagatggtaatgtatacattttggtacatgataagtactataataatataagtaagtattgttgtagtacttaatatgtgtcaggcactgttctaagtgtttaagcatattaacacatttagtctttataaaaccattatccccgttttacagatgaggaaattgaagcacagagaggttaagtaacttgctcaaagccacataggtagtaaagggcaaaaccagagttcaaacctcggccccagagtccttttccttacagttaagttttattgccgctaatgtagattttaagggaattgtgtgttatttatattcgtggcagctgctggattgaaaaacttagccagaaaggcacacttgatgaattatgtagttcattgtgtttgtttttgtttttgttttgcctcaggtggtccagcacatcatccagcaaaatcatgtcccagagtcaagtatcgaaaggggttgattttgaatcaagtgaggtaaataagtaatattgttaaattttaattaatttttaactttataaaatttaaatagagactgccagctagttgctgaacttttttttctttgataaataacttcatcttttatgttcagggagtacatgtgcaggtttgttacatgggaattgcgtgatgctgaggtttggtacagatcccatcacccaggtagtgagcagtaggcagttttccaacacacatcctactctcagcctccactctctagtagtccacagtgtctgttgttcccatcttcatgtccatgtgaactcagtgtttagctcccacttgtaagtgaggacatgtggtatttggttttctgttcctgttaatttgcttaggatagtggcctccagctgcaaaggacataattttgttctttttatggctgcatagtgttccatgttacatatgtaccaccattttctttatccaatccgtattgatgggcacttaagttgattccatgtctttgctactgtgagtaagtgctgcagtaaacatgagtgtatgtgtctttttggtagaatgatttcttttcctttggttatatagccagtaatgggattgctgggtcaaatcgtagctctgttttaagttctttgagaaatttccaaatggcttataatggctgaatgaatttacattccaacaatgtataagcattcccttttctgacaacctcactagcatctgttgtcttttgactttttagtaatagccattctgactggtatgaaatggtatcattgtggttttgatttacatttctccgatgattagtgatgataagcactttttgtttgttggctgctttgtgtgtcttcttctttgtaatgtgcctgttcatgtcctttgcccattttctgatgcagttatttgatttttccttactgatttatttacattccttttagagtcttgatattagacctttgttggatacgtattttgtgaatattttctcccattctgtaggctttttgtttactctgttgatagtttcttttctcttttttttttgacatggagtttcgctcttgttgcctgggctggagtgcaatggtgtgacctcagctcactgcaatctccgcctcccgggttcaagcgattctcctgcctcagcctcccgagtagctgggattacaggtgcgcatcaccacgcctagctaattttttgaatctttagtacagacagggtttcaccatgttggccaggctggtctcaaactcctgaccttatgatccacctgcctcggcctcccaaagtgctgggattacaggtgtgagccactgtgcccagcctgatagttttactgtgcagaagctctttagtttaatgaggtcctacttgtccatttgtatttttcttgcagttgcttttggggacttagccaaaaattatttgccaaggccagtgttgagaagggtattttcttggttttcttctaggattattatagtatgaggtcttactattaaatctttaattcatcttgagttaatttttgtatatggtgaaaggtagggatccattttcttctgcacattgctagccggttatcctagcaccatttattgaatagggagtcctttctccattgcttgtttttgtcagcattgtcaaagatcagatggctgtagatgtgcagctttatttctgagttctctgttctgttccattggtctgtgtgtctgtccttgtaccagtaccatattgttttggttactgtagccttataatatagttcaaagttgggtagtgttatacttctggctttgttctttttgcttagggttgctttgtctatttgggttcttctttggttccatgtgaattttagaatagttttcttctaatttctgtgaaaaatgacgttggtagtttgatagggatagcgttgaatctgtaggtagcactgggcagtatggtcattttaatgatactgattcttccagttcctaagcatggaatgtttttgcgtttgtgttatctgtgatttctttcagcagtgtttcatagttctccttgtagagatctttcacctccttggttagctatatagctatgtatttaattttctttgtagctattgtaaatgggattgtgttgttcttgatttgactctcagcttgaacgttattggtgtatagaaatgctactgacttttgtacactttttttttttattctgaaactttgctgaagtcgtttatcagttctaggagcctttgggcagggtctttagggttttccaggtacagaatcatatcgtcagcaaagagagagtttgacttcttttcctgtttggatgtcttttctttctttctcttgcctgattgctctggctaggacttccagtactatgttgaataggagtggtgagagtgggcattcttatctttttccagttctcagggagaatggttctagcttttgcttgttcagcatgatgttggttgtggattttcatagctggctcttattattttgaggtatattccttcagtgcctagtctgttgagggtttttatcatgaagggatgttggattttatcaaaagctttctctgtgtctgttgaagtgatcatatcgtttttgtttttaattctgcttttgtggtgagtcacatttatggatttgcatatgttgaatcaaccttgtatcccaagaataaagcatacttgatcatggtatattaactttttgatgtgctgctagatttggtttgctagtttcttgaggatttttacatctgtgttcatcagggatattggactgaagttttctttgttttgttgtgtctctgccagattttggtatcaggctgatgctggcttcgtagaatgagttagggaggagcctcccttgatttttttggaataatttctgtaggattggtaccagttctttgtatgtctgatagaatatggctgtgaatccatgtagtctagggcttttttggttggtcagttttttattactgattaatttcagaatttattattggtctgttcaggttttcactttcttcctggttcaatcttgggaggttgtgtgtttagagggatttatccatttcctctagattttctaatgtgtgtgaatagttattcatagtagtctctaaagatcttttgtatttctgtggggtcaattgtaatgtcatctttgtcatttctgattgtacttagttggatcttctctttttcctttgttaatctagctagcagcctatcaattttgtttattattttaaagaaccaattcttgatttcattgatctttggtatggatttttgcatctcagttttgttcagttcttctctaatttatttcttttcttctgctaatttgggggctggtttgttcttttatttctagttcctccaggtacaatgttaaattgttaatttgatttaaattaacaaattgttaatttgatttaaattaacaaattgttaatttgattctcttaatgaagacatttagttctgtaagctttccttttaacagttttagctgcatccctaagattttgtaagttgtgattctatttttattttcattaatgaaattaatttcattaattaatgaatgaatttttattaatttcaaagaatttttttatttctgccttaatttcattattgacccaggagttatccaggaataaattgtttaagttccatgtatttgtgtagttttgagagatcttcttaatattgatatctctttttattgcactgtagtccaagagtatacttggtatgattttgatttttttgaatttatttagacttactttgactgaacacgtgatctatcttagaatatgttctgtgtgtagatgggaagaatttgtatcctgcagttactggatgaagtattttgtagctttcaattaggtctgattggtcaagtgtcaagtttaagtcctgaatttgttagttttctgcctggatgttctttctaacactgtcagtggggtgttgaagcctcccactattactctgttgctgtctgagtctttttttaggttaagcagaacttgatttatgaatctgggcatgtatatatttggcatagttaggtcttcctgttgaatcaaaccgtttatcattatataatacctttctttgtccctttttactgttggttggtttaaaatcggctatatctgataaaagaattgtgactcctgcccttttttgtttttcatttgcatgttagatctttctccatccctttactttgagcctgtgtgtgtcattacatgtgaaatgggtctcttgatgacagcagtcaggtcttgtccttttatccaacttgccactgtattccttttaagtagtgacatttagacaatttatattcagagttagtattgatatatgagatttcgatcctgccatcgtattgttagctggttgttttgtagacttgattatgtagttgctttatagtgtctctaagctatgtccttaagtgtgtttttgtggtagtaggtggtggttttttgtttccatgtttagcactctattaaggacctcttgtaaggctgatctagttgtaatgaattcctcagcatttgcttgcctgagaaggattttatttctcctttgcttatgaagcttagtttggtgggatatgaaattcttggttagaatttcttttttctttaaggatgcagaaaataggtccccagtctcttctggcttgtaaggtttctgccgagatgtccgctggtagcctgatggggttccctttgtaagtgacctgacccttctgtctagctgcctttaagatcttttctttcatgttgaccttggtgaatctcatgactgtgccttggggatggtcatcttatataatgtctgataggaattctctgtatttcttaatttgcatgtcaacctttctagcacgattggagaaatttttctggactgtatcctcgaatatgttttccatattgcttattctctcttctctctcaggaatgccaatgagtcataggttttgcctctttacataatctcatatttctcagaggttttttttttccattcttcttcattctttttcctttatttttctctgaccaagtagatttgaagaactggttttgaagctctgagattctttcctcagtttggtctgttatgttgttaatactttcagttgtattatgaaatccttgtagtgaaattttcaattccagaagttcagtatggttctttcttaaaatggctattttacctttgtaaaattgttttactggattcattggattgggttttaactttctcctgaatcttgatgagcttccctgccatccagattctaaattgtatgtctgtctttcagtaacttcaatctggttaagaactattgttggtgagctagcaggctcatttggaggtaaggggacattctggctttttgaattgccagaattcttgcactgattctttctcatgttagagggctattgttcctttaactgcagtgtaagtcgagtatagtcaactggccttgtttctgggtgctttcagagggccacagctctatatagatctttactgtgcctagattcttgccctgggtgtcacagagatgtatattggcagaattattttggtgttgtaattttggctgtgatccagtagctggcatttaacattagtgtccagtggataggctcttactcagctgcatagttcttttgtatttctgtgtgttcacagccgtgctctgtggtggggttggggagagagatgaccactcataagggccactcctggaccatgggtgaggtccctcctatcactggcactgtacctgcattactgttgtttggtgtcttgggttgcagggctcccttagacagaggccatggctgccagacaggccacacccttcccagaccagcactgtggaggaaggcatgtcccattcctgcactggcccacgaacccacgtgtctcactcctttcagtgttctgaaagtgggatttctcccctacttgagtgccagccccagctcttagctcgacagccccagctgtgtgctgtagccctgtagcactgggaccagcctgtggctccatcgtctggaccctcagggtcaggcaccagctgtgctggggaatctgaaatgctcccaggctgccaggaaggtactcaggtggaaccaccagcaaaaaacaaggctaggcagcagaggctgccctgtgcacacattcctgcagggcagcttggcaggggccctggaaggggctgtaggggaggagggcctgcagaacagatgttcctctgtcccacagggaagctggccccaggctggcctgccccagcattcaggtggggctagtcctactccaggggaaataagaagtcttaggggatgggcgcctatggccaccttctgctgcagctgccttagatatgaaaacccctgggctccatgtattctggagctctgtctctgcctactgtttgggccaatccccctgccagttgaaacgtctccagggggcatggaatcttgtagctaggatctctgaggtccatagtgagagtgtgctgccccatcatccattcactcacccctttctaggagcctttcaaggccaagaaccagccctggcattgggcaacccccacaaggttaccagcttcctccctcttcagcttccagtttgtatcacctctctatcagctcttggtgctttttctccaaagatctgctcaaaatatgttggcttactcgatattttggtctttattagtggcagtggtgcttcttggccctgtctagttggccatcttgtccttcttccactaaaaattatttttaaaaatagtttcaggctgggcgcggtagctcatgcctgtaatcccagcactttggaaggctgaggcaggcggatcacctgaggtcgggagttcatgaccagcctgaccaacatggagaaaccccgtctctactgaaaatacaaaattagccggacatggtggcacatgcctgtaatcccacctactcaggaggctgaggcaggagaatcgcttgaacctgggaagtggaggttgcagtgagccaagattgcaccattgcactccagcctgggcaacacgagcgaaactccatctcaaaaaaaaaaaatagtttcattgataaccttcctttgaactatagttaatgttaagagttaacaagtaacatatgttgagtgcccatcagtgtaatacctcagatataaaagtcctgtagatttttaaaatatgatattcactcagttcttatttgcccagttaacagtgggatcggaattttttttagcttctaccatttacttatatttggagaaatgatgatgatgatgatgatatcccaagagcttttaatattactttaatgaatatttattaagtactcactatatgctctacatgtgtcatgtagagggtggcgcatggtggtgatttcatgacatacaggtattcaggcattgtccgaaatgttctctgggaggatgtctggaaaaaactccagttccagatcgcgtctgcaaccatgaaatctccccaccatgaatgaggaggaggaggaagaggaagagttataagtcaggacttacctcttgcctttattaatttgctgtttcaattaagtttaaataaaactacatgactgaaggatactgcccttcccctttccttcaaggctgccatttgaagggcctttgctagtttttgttgatttgcttgaaagtgtttctcttaggcccatgacccctttcatttatttttttatttaaaaaattgttaattgtagcaaaagcataacataaaactaaccattattaagtgtacagttcagtagtgttaaatagatccatattaaacagatcttcagcactttttcattttgcaaaactgaaaatctatatccctgaaataacaagtctctgtttccccttcttcatcccctggtaactaccattccactttctctttctatgaattcaactactctaggtacttcatagaagtagaatcatatagtatttgcctttttgtgactggcttatttcacatagcgtaagtacctgaaggtttatctacgttgtagcctgtgacttacacctttcatttttagctttggctgctgctgccatgttccctgtatttaagctgtggtttaaaacagcttgagaggactcaactcaggctgccaagaaaaatggcagcaagagctcattctacctattaaatactaacatgttgcttccaggagggaagtgagcaattattgtttattccaaaacatctggatatatatgcggttatatgttacagttaaaaatttgtatactagttcatgttaactgcaaagacaaactattagcaaattatctattagacttcatttggatttgtctctggtttatttaagttttgtctttgatagcagcagaaaatgaatcaataaatgaaaatgaatttatatttcttaaggcatccattactcatcagagatagttaatttagctaacatttggaagtgctgataccaccaacaaagcctagcatcaaataatttcttttaatttcttttaatgtcttaaacacaaataaaaaacttataaacaaatttgctttattttctgaatatttatagaatacgtaagaattggttttatcttcataaaattatataattgggcttatctgaggtttgttttcattctctttaattaaattattagttaatatctgatattcctatttattcttaccatgcatacaatctatagcccaatagcatgggaactcttttttttttttgagatggagtctctcgctctgtcgccgaggctggagtgcagtggcacgatctcagctcactgtaagctctgcctcccagtttcacgccattctcctgcctcagcctcccgagtagctgggactacaggcgcccgccaccacacccggccaattttttgtatttctagtagagacggggtttcaccgtgctagccaggatggtctcgatctcctgacctcgtgatccacccgcctcggccttccaaagtgctgggattacaggcgtgagccaccgcgcccggccagcatgggaactcttgaaataactgcatgtatttctttttttatccaaaaaactatttgaaagcttgctttgctaggttgttttttgcataagtgtgagagtagctagctatttctagtattaaatggtaatgggaaataaaattacagctgtttctgagttggatctccatgtggcttcattattttttcgctgtgaatttccagaagagtagatacaactgtaataaaatgtaaatgagaaaatatattcaaaaaccaaatataaaatgacttgaattatttttctggcttacctatacttcatttatctttattaaggttagtaagggaaatgtgtgtggtttatattgtagatacatgcacacacagcaggataaattttcattttaatgctcattaagaatttaattgtacttaatatattttgcagttataaaggaaatagaaaaataaagtctatcccatgtgaaatgactctcactggtattgttttgcccataagaacttctgtcttgtttcagtgaagcagggaacaatcactaatacaacatttgtatctcatttcaggatgatgatgatgatccttttatgaacactagttctttaagaagaaatagaagataatatatttaatggcactgagaaacatgcaagatacaggaaaaatgaaaatgttacaagctaagagtttacagtttaagattttaagtattgtttcctgagcataactccataagtaagaaatttctagttcacagacatacaatagcattgattcaccttgtttttttaacctggttgttgtagtaagagctttgtttcaatatcactcttgagtaaagattaaaataaagctaccattttacatttctatttcataatgaaaaactatgtcagtattttaatatggttacatttagccaaagttgagggaaagagcttataaaatttaacttcttcataattttagtaatttcctagaggttctgggttttctgaaagtaaaacaatttatgcgaacctatgtctaaattcactgtttgttactatgtatgtttttttccaatgcttcttataagactaaatgattagaagtacctaatagtttgaacagatatgtttttatttaaaagagtagaataacctttcagaattactgagttttttattccagttgtagcaaagatttcaaaagattgtgttcccattaagtggtagtaatttcctttattattctgtatccttaatggtgttctctctctctctctctctctctctctctccctctcccccccgttccccactcttcctttctcctttgctttttcttctctttcatacatatatgcgtgcctagttctaggaggaaacgggttaaaaattgttttaaactacatcttgaaaatattgaagaatttgttttaggtagagtggtcagttgaaccttacagtaaagtatagaaatatatttaatgtggaatgtcaatgccaggatttctcattaacaatattttatctcaactttggttcctgtgatacatttctgaatgggcaattccagaaatcttagtagcccatgttaagcttctattttttacttgttttcggggagaaataagaattagacatcttcagatttaagttaaataatcccattctttataatcctctgtaaaaagatccctgagattattccttcttctagttttatgcgacagctttactttaaaattcaagttatacatcttgggagtacaatggcccgacatttcttcataggtagaaacaaatacttgactcagtgatactcatgaccattagaatagtcatacctggaatgtgtcaaattataagagacagacacttggttagtggctgcctcatatagcacttttgaagaggcctaagtcaaaacttgcaatataacattctattgactttcttaaaaatattttttctgtacctaacttgagcataagggttatttgagcaagtaacattaactcagtggaaggcattgtcctgtgaaatattcttaggcagatctgcccacatctttattgaacttgaaatctaatatttctagtatttgaacaaagcagaaggttaagtcagggaagagcagtgctgtccatgatgtaatggaagctaccaggggaggcagtgtctggatgatgctgtgctacctacccctgcacaagccatgctggctcagtctgagctgtgggccacatcagctagtggctcttctcatgcatcagttaggtgggtctgggtgagagttatagtgagggaatggtcactaaagtatcctgacaagttcctaggaaaaaaggaataaagtttttttccttaaaaaaaaaaaaattgctcttggctgtgaaaagaggtactaaatgcgattcagttcaccgctaaggaaagtgatgacatagcagttacagagggtgataaatctctccagctaattcaggtcattttgtgaatactatgtatcaagccctgaaaatatggtaaataaaacgtgacagggaaacctttttttgattgaatattgttacatagttaaatgtgctatatatccttaatattttatattgatcctgcaaaatctgttggttttaggggagttttgttttttgtttctaacaattttcagacctgttggtataggaatgtagaagtctttcagatgatttgaaagcagctgcatttgctcttggaggctttgggagagcaggaatgaaaacattcagaggaagacatctgtagggaattcttctgttacttaccaaagaataagtgtctttctggtgttttatttcctatcataaaaatacaacagtgcatttacaaggttaaagattcctcgaagttctaggaaattcttgaaaatataagtggtgcttagaaaattcaagcatttaggaatgtgacctttaattcaggtatgtaaaagacttttttcccaaacttttaaaagtaggaaatacaataaatacagaaaagtcatatggttgaataaataattataaattgagcactgatggaatccctctacaggtcaagaaatagcgcagtgtcctggatgcccattatattgttttctcctttctgggtaacaagccctaacttctgtaatttaaaagctcctacttttgccacaaggtggtgcttctgccattagacgcagttaggaggatgcaactgcaaatctaaaattacgaagttagtgtagttgcaataaacttagaacatatgcattaatactaaacctatgcagtaataccataattagccttctaatcatgtaatttgctttacttaggtatttcatttggttcagcctgttatggaatttaccagcttgataaatttgcctataaagttttataaagaaaaggaatattttgttttcataaagaggaaaatccattcttagaaaaaaa

(The sequence listing continues in the following parts.)

What is claimed is:

1. A method for classifying relative deleteriousness of a mutation in a nucleic acid sequence of a gene to a mammalian cell comprising:
   providing an isolated mammalian cell comprising a genome comprising a single functional copy of a first gene and a non-functional copy of the first gene;
   transforming the cell with a nucleic acid construct comprising a nucleic acid sequence from a second gene comprising the mutation to be classified, wherein the nucleic acid sequence from the second gene comprises a mutated first gene or a mutated fragment of the first gene, wherein the nucleic acid sequence from the second gene is flanked by two nucleic acid sequences to allow recombination with the genome of the cell in the first gene;
   detecting a frequency of recombination of the nucleic acid sequence from the second gene in the functional copy of the first gene,
   detecting a frequency of recombination of the nucleic acid sequence from the second gene in the non-functional copy of the first gene,
   comparing the frequency of recombination in the functional copy of the first gene to the frequency of recombination in the non-functional copy of the first gene, wherein an equal or higher frequency of recombination of the nucleic acid sequence from the second gene in the functional copy of the first gene compared to the non-functional copy of the first gene is indicative of a non-deleterious mutation to a mammalian cell, and wherein a lower frequency of recombination of the nucleic acid sequence from the second gene in the functional copy of the first gene compared to the non-functional copy of the first gene is indicative of a deleterious mutation to a mammalian cell.

2. The method of claim 1, wherein the nucleic acid sequence from the second gene comprising a mutation comprises a fragment of the first gene that is present as a single functional copy in the cell.

3. The method of claim 1, wherein the first gene, or the second gene, or both the first and second genes are suspected of being tumor-suppressor genes.

4. The method of claim 1, wherein the cell comprises a library of cells comprising members comprising different single functional first genes.

5. The method of claim 1, further comprising providing a library of nucleic acid constructs comprising a nucleic acid sequence from a second gene.

6. The method of claim 1, wherein the mutation in the second gene is in a gene region selected from an intron, an exon, a 3'-UTR, 5'-UTR, transcriptional regulatory region, translational regulatory region, and a region at a junction between two of the regions.

7. The method of claim 1, wherein at least one of the flanking sequences is not present in a non-functional copy of the first gene in the mammalian cell.

8. The method of claim 1, further comprising performing a functional assay on a cell after detecting recombination.

9. The method of claim 1, wherein the mammalian cell is a somatic cell.

* * * * *